United States Patent 9,878,056 (MODIFIED POLYNUCLEOTIDES FOR THE PRODUCTION OF COSMETIC PROTEINS AND PEPTIDES) - sequence listing, part 4

SEQ ID NO: 4289 - DNA, 510 bp, Artificial Sequence
  Description of Artificial Sequence: Synthetic coding sequence
atgcggggcacccccggcgacgccgacggcggcggccgggccgtgtatcaaagcatgtgcaaacctatcactggcaccattaatgacttgaatcagcaggtttggaccctccagggtcagaacctggtcgcagtgccgagaagcgactctgtcacacctgtcactgtggctgttatcacatgcaagtatcctgaagcgctcgaacagggaaggggagaccccatctatctgggaatacaaaaccccgagatgtgcttatattgtgaaaaagtgggcgagcagccaacgctgcagttgaaagagcaaaagatcatggatctgtatggacagcctgaacccgtcaaaccgttcttattctacagagccaagaccggccgcacctctactctcgagtctgtcgccttccctgattggttcattgcctctagcaagagagatcaacctatcattctgacatcagagctcggaaagagctataatacggcctttgaattgaacattaacgattag

SEQ ID NO: 4290 - DNA, 117 bp, Artificial Sequence
  Description of Artificial Sequence: Synthetic coding sequence
atgcggggcacccccggcgacgccgacggcggcggccgggccgtgtaccagagtatgtgtaaacccatcacaggaacaattaatgatcttaaccagcaggtctggacccttcagtag

SEQ ID NO: 4291 - DNA, 657 bp, Artificial Sequence
  Description of Artificial Sequence: Synthetic coding sequence
atgagcttcgtgggcgagaacagcggcgtgaagatgggcagcgaggattgggaaaaggacgaacctcaatgttgtctggaggatccagcagggtcacctctggagcctggacccagcctcccaaccatgaacttcgtccacacgtcacccaaggtgaaaaacctcaatcccaagaagttttcgatccacgatcaggatcacaaggtcctggtgctcgattctggaaacctaatcgctgtccctgataagaactatattaggcccgaaatattttttgcactagccagcagtctgtcgtctgctagtgccgagaaaggatcccctattctcctcggagtgtccaagggagagttttgtctctactgtgataaggataagggtcagagtcatccgagtctacagctgaagaaagagaagctaatgaaactggcagctcaaaaagaaagcgcccggaggccatttatcttctatcgagcccaagtaggatcctggaacatgcttgagagcgcagcccaccccggctggttcatctgtaccagctgtaattgtaatgagccagtcggcgttactgataaatttgaaaatcgcaaacacattgagttttccttccagcctgtgtgtaaggccgaaatgtccccttccgaggtctcggactag

SEQ ID NO: 4292 - DNA, 579 bp, Artificial Sequence
  Description of Artificial Sequence: Synthetic coding sequence
atgagcggctgcgaccggcgggagaccgagaccaagggcaagaacagcttcaaaaaaaggctgcgtggccccaaggtgaaaaacctaaaccctaaaaagtttagtattcatgaccaggatcataaagtgttggtactggacagcgggaacttgatcgctgtgccggacaaaaactacattcgacccgaaatattctttgccctggctagttctcttagttctgcaagtgccgagaagggatccccgatactgctgggcgtgagtaagggcgagttctgcctgtattgcgacaaagacaagggtcaaagccatccctcactccagctgaagaaagagaaactgatgaagctggcagctcagaaagaatcggcccgtcgccccttcatattctatcgggcccaagtgggctcctggaatatgttggagagtgccgcccaccccggctggtttatttgcacctcttgtaactgcaacgaacctgtaggtgtaacggacaaattcgagaataggaagcacattgaattctccttccagccggtttgcaaagctgagatgagcccaagcgaggtgagtgattag

SEQ ID NO: 4293 - DNA, 474 bp, Artificial Sequence
  Description of Artificial Sequence: Synthetic coding sequence
atgagcttcgtgggcgagaacagcggcgtgaagatgggcagcgaggactgggaaaaagacgagccgcagtgttgcctcgaagaaattttctttgcgctggcatcatccttatcgtccgcatccgcggaaaagggaagcccaatccttctgggagtgtctaaaggggagttttgcctttattgcgacaaagacaaggggcagtcacatccatcactgcaactcaaaaaagagaagctgatgaaactggctgcccagaaggagtcagctagaaggccatttatattttaccgggcccaggtcggctcctggaatatgctcgaatcggccgcacaccccggttggtttatttgtacttcatgcaattgtaacgaacccgtcggcgtaactgataagttcgaaaaccgaaagcacattgaatttagctttcagcctgtttgtaaggcagagatgagccccagcgaggtctctgactag

SEQ ID NO: 4294 - DNA, 594 bp, Artificial Sequence
  Description of Artificial Sequence: Synthetic coding sequence
atgagcttcgtgggcgagaacagcggcgtgaagatgggcagcgaggattgggagaaggacgagccacaatgctgcctagaagggccaaaggtcaaaaacctcaatcctaaaaaattttcaatacacgaccaggaccacaaagtgctcgtgctggactcaggaaatttgattgcagtccccgataaaaattacattcggcccgagatctttttcgcattagcgagttcactgagttcagcctccgccgagaaaggaagtcccatactgcttggagttagcaaaggcgaattctgtctgtactgtgataaagacaaaggccagagtcacccttccttgcagctgaagaaagagaagttgatgaagttggccgcacagaaggaatccgcacgccggccttttatattttatagagctcaggtgggaagttggaatatgctggaatctgccgctcacccaggatggtttatttgcacaagttgtaattgtaatgagcctgtgggcgtgacagacaaatttgaaaatagaaaacacattgaattcagctttcaaccagtgtgtaaggctgagatgagcccttccgaagtcagcgactag

SEQ ID NO: 4295 - DNA, 537 bp, Artificial Sequence
  Description of Artificial Sequence: Synthetic coding sequence
atgagcttcgtgggcgagaacagcggcgtgaagatgggcagcgaggattgggagaaagacgaaccacagtgttgcctggaagaccctgcaggctcccctcttgaacccgggccgtcacttcctaccatgaatttcgtccacacgaagatcttttttgcacttgccagctctctcagtagcgcttcagctgaaaaggggagtccaatactcctcggagttagcaagggtgaattctgcctgtattgtgataaagataaaggacagagtcacccttccctgcagctgaagaaggagaagttaatgaaattagcagcacagaaagagagcgcgcgccgcccttttattttttaccgggcacaggtaggctcttggaacatgctggagagtgcagctcaccccggatggtttatttgtaccagttgtaactgtaacgagccagttggcgtgaccgacaaatttgagaacaggaaacacatagagttcagtttccagccggtttgtaaggcagagatgtccccgtccgaggtgtcggattag

SEQ ID NO: 4296 - DNA, 1770 bp, Artificial Sequence
  Description of Artificial Sequence: Synthetic coding sequence
atgcccaacgacgacttctgccccggcctgaccatcaaggccatgggcgcagaacgggctccccagcggcagccctgtactctccaccttctggttttggtgcccatcctgctgtcactggtggccagccaggactggaaagctgaacgttcccaggatcccttcgagaaatgcatgcaggatcctgactacgagcagctgctgaaggtagtgacttggggcctaaacagaacgcttaagccccagcgcgtgatcgtcgtcggggccggcgtcgccggactcgtcgctgcaaaggtgctttctgacgcaggacacaaagttacaatcctggaggcagataatcggataggggggaggatcttcacctatagagatcaaaataccgggtggatcggtgaactgggggccatgaggatgccttcaagtcaccggatcctgcataaactgtgtcaaggcctggggctaaacctcaccaagttcacccaatacgataagaacacgtggactgaggttcatgaggttaaactcaggaattacgtcgtggagaaggtccctgagaaactgggatacgcactaagaccgcaagagaagggacattctccggaagatatttaccagatggctctcaaccaagccctgaaggacctcaaagcgctagggtgcaggaaagctatgaaaaaattcgagagacacaccttgctggaatacttactgggagagggcaacttgagtcgccctgccgtacaacttctgggcgatgtgatgtcagaggatggctttttctacctatcttttgctgaggcactgagagcccactcttgcctgtccgatcgcttgcagtactcccggatagtaggggggtgggatctgctgcctagagctctgctgtcgtccctcagtgggctggttctgctgaacgcacccgtggtagcaatgacgcagggcccacacgacgtacatgtgcaaatcgaaacgtctccaccggcccggaacctgaaagtgctcaaagcagatgtggtgttgctgactgcatctggcccagccgtcaaaagaattaccttcagtccaccacttcctaggcacatgcaggaagctttgcgaaggttgcattatgtgcccgccacaaaggtgttcctgtcctttcggcgcccattctggcgggaagaacatatagaaggggggcacagcaatactgatagaccaagtcggatgatcttttaccctccgcctcgggagggagccctgctactggctagctatacttggagtgatgccgccgcagcgttcgccggactgtctcgggaagaggctctgaggttggccctggatgacgttgctgctctccacggacctgttgtccggcaactatgggatggaaccggcgtggtgaaaagatgggcagaggaccaacatagccagggcggctttgtcgttcaaccgcccgcactctggcagactgagaaagacgactggaccgtcccttacggtcggatatacttcgcaggagagcataccgcctacccccacggctgggttgagacagcagtgaagtcagctcttagagccgccatcaaaattaacagtcgaaagggaccagcctccgacaccgctagccccgagggccatgctagcgacatggaaggccagggtcacgttcatggcgtcgcctcctcaccatcccacgatctggctaaagaagagggctcacatccccctgtgcagggccagcttagcctccaaaatacaacgcacacaaggaccagtcactag

SEQ ID NO: 4297 - DNA, 1704 bp, Artificial Sequence
  Description of Artificial Sequence: Synthetic coding sequence
atggcccccctggccctgcacctgctggtgctggtgcccatcctgctgtcgctcgttgcttcccaagattggaaggcagaacgctcgcaagatccattcgaaaaatgtatgcaagacccagactatgagcagttacttaaggtcgtgacctggggactcaaccgtactcttaagccccagagggtgatcgtggttggtgcaggagtcgccgggctggtggcagccaaggtgctttccgatgctggccacaaagtgacgattctagaggcagacaacaggatcggggggagaatcttcacttacagggatcagaacaccggttggatcggcgagttgggggcaatgcggatgccaagcagccatcgaatcctccataagctctgtcaggggctggggctaaaccttaccaagtttacccagtatgacaaaaatacctggaccgaggtgcacgaagtcaagctgagaaactacgttgtggaaaaggtccctgagaaactggggtacgctttacgacctcaagaaaaggggcatagtcctgaagacatttatcagatggctttgaaccaggcgctcaaggacctcaaggctttggggtgcaggaaagcaatgaagaaatttgagagacatactctgttagaatatttattaggggagggaaacttgtctaggcccgcagtgcaactgctcggggacgtgatgtccgaagatggatttttttacctctcgttcgcagaagcactgcgggcccattcctgcttatctgacaggctgcagtacagccgaatagttggcggttgggacctactccctagagctttgctcagtagcctgagcgggttggtacttttgaatgcaccggttgtcgcaatgacccaagggccccatgacgttcatgttcagatcgaaacatccccacctgcccgcaacctgaaagtgttaaaagctgatgttgtgctgttgactgctagcggccctgcagtcaaacgtatcaccttcagccctccactgccacggcatatgcaagaggccctgcgtaggctgcattatgtgccagcaacaaaggtcttcctctccttcagaagacccttttggagagaggagcacatcgagggtggccacagtaatactgacagaccgtcgcgcatgatcttctaccccccccccagagaaggcgcactcctgcttgcgtcatacacttggtccgacgccgccgcagccttcgctggattatcgcgcgaggaggcattgcgcctcgccctcgacgacgtggccgccctgcatgggccagtcgtcagacaactgtgggatggaactggagtggttaagcgatgggcagaagatcaacacagtcaaggtggatttgtggtgcaaccccctgcactatggcagacggaaaaagatgattggaccgtgccttacggcagaatttacttcgccggtgaacacaccgcctacccacatggatgggtggaaactgccgtgaaatctgccctgagggcagctatcaagatcaatagcagaaagggcccagcatcggataccgccagtccggaaggccacgctagcgacatggagggacagggccatgtgcacggtgtcgcctccagtcctagtcacgacctcgctaaagaggaagggtcgcacccacccgtccaggggcagctgtctcttcagaacacaacacacacccggaccagccattag

SEQ ID NO: 4298 - DNA, 1770 bp, Artificial Sequence
  Description of Artificial Sequence: Synthetic coding sequence
atgcccaacgacgacttctgccccggcctgaccatcaaggccatgggcgccgagcgtgctccacaaagacaaccctgtaccctgcatctattggtgttggtgccaatcttgctttctctggtggccagccaggattggaaagccgagcggtctcaggacccgtttgaaaagtgtatgcaggaccccgactacgagcagttattaaaagtggttacatggggcctgaatagaacactcaaacctcagagagttatcgtcgtaggggccggggtggccggcctggtggccgctaaggtgctctcagacgctggacacaaagtgactattttggaggccgataaccgcatcggcgggcggattttcacctatcgcgatcagaacacagggtggattggtgagctgggcgcgatgcggatgccatcctcacacagaatcctccacaagctttgccagggtctggggctgaatctcacaaaatttacccagtacgataaaaatacatggacagaggtgcatgaggtcaaattaaggaactacgtcgtcgagaaggtccctgagaaactgggctacgcactcagacctcaagagaaaggccattcacccgaagacatatatcagatggctctgaatcaggcgttgaaggacctgaaggctttgggctgtcgcaaggccatgaagaagttcgaaaggcacacattgctggagtacctgttgggggaaggcaacctgtcgagacctgccgtgcagctcctaggcgacgtgatgtccgaggatggcttcttctatctgtctttcgccgaggcactgagagcccactcatgcctgagtgaccgcctgcaatattctcgaatagtgggcgggtgggatctcctcccccgggcactactctcatctctctcaggccttgtattgttgaacgcacccgtggtggctatgacccaggggccccacgacgtccatgtgcagatcgagacttcaccacccgcaagaaacctgaaagtcctgaaagcggatgtcgtgctgttgaccgcaagcggacctgccgttaaaaggatcacctttagtcctcctctgccccgacacatgcaggaagcgctccggagattgcactacgtgcccgccactaaggtgttcctgtcatttcggagacctttctggcgggaagaacacatcgagggcggccatagcaacacggatcgtccaagcagaatgattttctacccaccgcccagagagggggctttgctgcttgcatcttacacatggagtgacgccgccgcggcattcgctggtctgtcccgcgaggaagccctcagattggcactcgatgatgtcgcagccctccacggaccggtcgtgagacaactgtgggatgggacgggggtcgtaaaacgctgggccgaagaccaacacagtcaaggtgggttcgtagttcagcctcccgcgctgtggcagactgagaaggatgactggaccgtcccgtacggacgcatatatttcgccggggaacacaccgcatacccacatggatgggtggaaaccgcggtgaaatcagctctaagagccgcaattaagataaattcccgaaagggccccgcaagcgacactgcctctccggaggggcacgcttccgatatggaaggccaggggcacgttcacggcgtggcttcttctccctctcacgatctggccaaggaagagggatctcatcccccagtgcaagggcagttgtctcttcagaataccacacacaccagaacttctcactag

SEQ ID NO: 4299 - DNA, 462 bp, Artificial Sequence
  Description of Artificial Sequence: Synthetic coding sequence
atgggcctgaccagccagctgctgccccccctgttcttcctgctggcatgcgctggaaacttcgtgcacgggcacaagtgcgacatcacactgcaagagattataaaaacactgaacagtctgaccgaacaaaagacactttgcaccgagctgaccgtaacagatatattcgcagcctctaagaacactaccgagaaagagacattctgccgggccgcaactgtccttagacagttttacagtcatcacgagaaagacacaagatgcctcggggccactgcacagcaatttcatcgacataagcagcttattcggttccttaagagactggaccgaaacctctggggcctagctggtcttaacagttgcccagtaaaagaagcaaaccagtcaactctcgaaaattttctggagagactcaaaaccatcatgagggaaaagtactcgaagtgttcctcctag

SEQ ID NO: 4300 - DNA, 435 bp, Artificial Sequence
  Description of Artificial Sequence: Synthetic coding sequence
atgctgctggccatggtgctgaccagcgccctgctgctgtgcagcgttgctggccaggggtgccctacactggccggaattcttgatatcaatttcctgataaacaagatgcaggaagatccagcaagcaagtgccactgcagtgctaacgtcacctcatgtctgtgccttggcatacctagcgacaattgtaccaggccttgcttctctgaacgactgtcgcagatgactaatacgacaatgcagactagatatcctctgatcttctccagggtgaagaagtccgtcgaagtgctgaagaataataagtgtccatatttttcctgcgagcaaccatgcaatcagacaaccgctgggaacgccctcactttcctgaagtctctgctggaaatctttcagaaagaaaagatgcggggtatgagaggcaagatctag

SEQ ID NO: 4301 - DNA, 2109 bp, Artificial Sequence
  Description of Artificial Sequence: Synthetic coding sequence
atgcggcccatgcggatcttcgtgaacgacgaccggcacgtgatggccaagcactcctctgtttacccgacccaggaggagctggaagccgtgcagaacatggtatcacatacagaaagagccttaaaagccgttagcgactggatcgacgaacaggagaagggttccagcgaacaggcagaatctgataatatggatgtacccccggaggatgatagtaaggaaggagccggcgaacagaagaccgaacacatgacgcgcaccctgagaggcgtcatgcgagtcggactggtggctaagggccttctgctgaaaggggatctggacctggagctggtactgctgtgtaaagagaagccaaccacagcactcctggataaggtggctgataacctcgcaatccagcttgctgctgtaacagaggacaagtatgagatattgcagtctgtagacgacgccgctattgtgattaagaacacaaaggaacctccgctgtcccttacaattcaccttacctcccctgtggtgagagaagagatggagaaggttctggctggggagacccttagtgtcaacgatccaccagatgtgctggacagacagaagtgcctcgccgccttggcctcattaaggcacgctaaatggtttcaagctcgagccaacgggttgaagagctgtgtaattgttattcgcgtcttgcgcgacctatgtactagggtgcctacttggggcccgctcaggggctggcccttggagttgctgtgtgagaagtccatcggaactgctaatagaccaatgggcgccggcgaggctttgcggcgggtcctagagtgtcttgcgtccggcatcgtgatgccagatgggagtggaatatatgatccctgtgagaaagaggcaactgatgcgatagggcacctggacagacaacagcgcgaagacataacgcaatctgcccaacatgctttaagactggccgctttcggccaactgcacaaggtgctagggatggacccccttccttcaaaaatgccaaaaaagccgaagaatgagaatccagtggattatacggttcagatccccccctccaccacctatgccatcactccgatgaagagaccgatggaggaggacggagaagaaaaaagcccatccaagaagaagaaaaagattcaaaagaaggaggagaaagccgaacctccccaggccatgaatgccctgatgaggctcaaccaactgaaacccggactgcagtataaactcgtatcccagaccggacctgtgcatgcccccattttcactatgagcgttgaggtggacggcaatagttttgaggcatccggaccatctaagaagactgctaaactgcatgttgccgtgaaggtattgcaagacatggggctgcctacaggcgccgagggcagagacagctctaaaggtgaggactcagctgaagaaacagaagcaaaaccggccgttgtggcacccgctcctgtcgtggaagctgtcagtactccatcggcagcctttccttccgatgcaaccgccgaacaaggtcccatcctcactaagcatggcaaaaaccccgtcatggagctgaacgagaaacggcgggggcttaagtacgagctcatatctgagacaggcggttcacacgataagcgttttgtaatggaggtggaggtggacggtcagaagtttcagggggccgggtcaaataaaaaggtcgctaaggcatatgcagccctcgcagcacttgagaaactcttccctgatacaccgctggcactcgatgctaacaagaaaaagcgtgctccagtgccggtgaggggcggccctaagttcgcggcaaaaccccacaatcctggttttggcatgggtggccccatgcataacgaggtgccaccccctccaaacctgagagggcgaggccggggcggcagcattagagggaggggcagaggccggggttttggcggggctaatcacggaggatacatgaacgccggcgccggatacggttcatatggttacggaggcaattcagcaactgccggatattctgacttttttactgattgctatggctatcacgacttcggctcgagttag

SEQ ID NO: 4302 - DNA, 2109 bp, Artificial Sequence
  Description of Artificial Sequence: Synthetic coding sequence
atgcggcccatgcggatcttcgtgaacgacgaccggcacgtgatggccaaacactcttccgtatatccaacacaagaggaactggaggccgtacagaacatggtgagccacacagagcgtgctcttaaagcagtgtcagattggatcgatgaacaggagaaagggtcctcagagcaagctgaatcagataatatggatgtcccgcctgaggacgactctaaagagggagcaggagagcaaaagaccgaacacatgactcgcaccctgagaggcgtcatgcgcgtgggactcgtggccaagggtctactgcttaaaggcgacctagacctggaacttgtattattatgtaaggagaagcctaccacagctctgctggacaaggtggcagacaacctggcaattcagctggcagcagtgactgaggacaaatatgagatccttcagtcagtcgatgacgccgccattgtgataaagaatacaaaggaaccccccctgtctcttactatccacctcacatccccagtggttagggaggaaatggagaaggtcctggctggcgagacacttagtgtaaacgacccccccgacgttctagacagacagaaatgtctagctgctcttgccagtctccgccacgctaaatggttccaagctagagccaacgggctcaagagttgcgtcatcgtcatacgtgttttgagagacctgtgcacccgagtgcctacctggggacctttgagaggatggcctttggaattactctgcgagaaatcaatcggcactgcaaaccgtcctatgggcgcaggggaggccttacggagggtgctagagtgcctggcgagcggcatagtcatgccagatggttccggaatctacgatccttgtgagaaagaggcaacagatgccattggccacctggataggcaacagagagaagacatcacacaatctgcccaacatgcactgcgtctcgctgctttcggacagctgcacaaagtgctgggcatggatcccctcccctctaaaatgccaaagaagccgaaaaatgagaacccagtggactacacagtgcagatcccaccatcaacaacttacgccattacaccgatgaagcgtccaatggaagaagatggcgaggagaagagtccatccaagaagaagaagaaaatccagaaaaaggaggaaaaagctgaaccgccacaggccatgaacgcgctcatgcggctaaaccaactgaagcctggcctacagtacaagctcgtaagtcaaaccgggcccgtgcatgcgccaattttcacaatgtcagttgaggttgacgggaattcctttgaagctagcgggccctccaaaaaaacggccaagcttcacgtggccgtcaaggtcttgcaggacatgggcctgcctaccggtgccgagggccgcgacagcagtaaaggggaggatagtgcggaggaaacagaagcaaaaccagctgtggttgcccccgctcccgtagttgaggctgtgagcactccatctgccgccttccccagtgatgcaaccgctgagcagggaccgattctcaccaagcatggcaaaaatccagttatggaactcaacgaaaaacggagaggcctgaagtacgagcttatctccgagactggcggtagccatgataagcgatttgtgatggaggtggaggttgacggacagaagtttcagggggctggtagcaacaagaaggtggccaaggcctatgcagccctggcagcgctcgagaagttattccctgacacacctctggcacttgacgctaacaagaagaagcgtgcgcctgttcccgtgcggggcgggcctaagttcgcagccaagcctcacaaccccggattcgggatgggcggaccgatgcacaacgaagtacccccacctcccaatctgcggggtagaggccgaggtgggtctattagaggaaggggcagaggaaggggatttggaggtgcaaatcatggcggttatatgaacgccggcgccggatacggcagctacggctacggtggaaacagcgccacagctggttacagcgatttcttcacagactgctatggatatcatgactttggatcgagctag

SEQ ID NO: 4303 - DNA, 2685 bp, Artificial Sequence
  Description of Artificial Sequence: Synthetic coding sequence
atgcggcccatgcggatcttcgtgaacgacgaccggcacgtgatggcgaaacatagcagtgtatatcccacgcaggaggaattagaggccgttcaaaacatggtgtcacataccgagagggctctcaaagccgtgtcggattggatagatgagcaggagaaagggagctctgaacaggctgagtccgacaatatggacgtgccaccagaggacgacagcaaggagggagccggggagcaaaagaccgagcacatgaccagaactctaagaggggtcatgagagtgggattagttgccaaagggcttttgctcaagggagatctcgacctggaactcgtcttgctgtgtaaagagaagcccacaaccgcactactggacaaggtggcggacaacctggctattcagctggccgctgtgaccgaggataaatacgaaatcttgcagtctgtggacgacgcagctatcgttattaagaatacaaaagagccaccgttatctctgaccatacatttgacatccccggtcgtccgagaggaaatggagaaagtcctcgcaggtgagactcttagtgtgaatgaccctcctgacgtcctggatcgtcagaaatgtttggccgctttggcctccctcaggcatgccaagtggttccaggccagggccaatggtcttaaatcttgcgttatcgtgatccgggtgctcagggacctctgtaccagggtgcctacgtggggaccgttgagagggtggccactggaattgctgtgtgagaaatcaataggaacagcaaatcgaccaatgggggcaggagaggcgctgcgtcgcgtcctggaatgtttagcttccgggatcgtaatgccagacggaagcggcatttatgacccctgcgaaaaggaggccactgatgccattggccatctcgatcggcaacaacgagaggacattacccagtccgcccaacacgcgttacgcctcgcagcctttgggcagctacacaaagtgttagggatggatcctctaccctcaaagatgccaaagaagccaaaaaacgaaaaccccgtcgattatacagtgcagattccaccttctaccacgtatgccatcacaccaatgaagcgacctatggaagaggacggagaagaaaaaagccctagcaagaagaagaagaagattcagaagaaagaggagaaggcagaaccaccacaggccatgaatgccttgatgcggctgaatcagttgaaacccggcctccaatataaactcgtgtcgcagaccggccctgttcacgccccaattttcacgatgtccgtggaggtggatgggaatagttttgaagcttccggaccttcgaaaaaaaccgccaaacttcacgtggccgttaaagtactgcaggatatgggcctcccaacgggggccgaaggacgagatagcagcaagggagaagactcagctgaagaaaccgaggccaagccagctgttgtggctccagcccctgtggttgaagctgtgtcaacaccgtctgccgcattccccagcgatgctacagccgaacaggggccaatcctcactaagcacggaaagaaccctgttatggagttgaatgagaagcgccggggcctgaaatacgagttgatctccgagactggggggagccacgataaaagatttgtgatggaagtggaggtagatggccagaagtttcagggtgcagggtcaaacaagaaggtcgccaaagcatatgctgcgttggccgcactggagaagctgttccctgacacccccctggccctggatgctaataaaaagaaaagagccccagttcctgtacgggggggccccaagttcgcagctaagcctcacaatcccggatttgggatgggcgggcctatgcataatgaggtgcctcctccaccaaatctgcggggcagaggacgcggcgggtcgatccggggacgggggcgaggcagagggttcggaggtgcaaatcacggcggatacatgaacgcgggggcaggttacggatcatatggatatggcgggaatagcgctactgctggctacagccaattttactcaaacggcgggcattctggtaatgctagtggaggcgggggcggaggaggaggcggttcttctggctatgggagctattatcaaggggacaactataactctccagtgccccccaagcatgcaggcaagaaacagcctcacggtggccagcagaagccatcatacgggagcggctaccaaagccatcagggccagcagcagtcctacaatcaatcaccatactcgaactacggacctcctcagggcaaacaaaagggatacaaccacgggcaggggtcatattcctactccaactcctacaacagccccggtggggggggggggtctgactacaactatgagtccaagtttaattacagtggaagcggtggaaggagcggcggaaactcctatggcagcggtggggcttcttataatccaggcagccatggtggttacggcggaggctccgggggaggaagctcgtaccagggaaagcagggcggctattcacagtctaattacaattcaccaggaagtggacaaaattatagcggtccaccctcatcctatcaaagttcacagggcggctatggccgaaatgctgaccactccatgaactatcagtaccgctag

SEQ ID NO: 4304 - DNA, 2295 bp, Artificial Sequence
  Description of Artificial Sequence: Synthetic coding sequence
atgcggcccatgcggatcttcgtgaacgacgaccggcacgtgatggcgaagcattcaagcgtataccctacccaagaagagctcgaagccgtccagaatatggtgagtcataccgaaagagcactgaaagctgtgtctgactggatagacgagcaggaaaaagggtcatcagagcaggccgagagcgataacatggacgttcctccagaggacgacagtaaggaaggcgccggggagcagaagacagagcacatgaccaggacgcttaggggagtgatgcgcgtgggtctggtggcaaagggccttctgctaaagggagatctggatcttgagttggttttgttgtgtaaagaaaagccgaccacagcactgctggacaaagtggctgacaacctggcaattcagcttgccgcagtcacagaagacaagtatgagattctgcagagcgtggatgatgcggctatcgtgattaaaaataccaaggagccccctctcagtctcactatccatctgacctccccagtggtcagggaggaaatggagaaagtccttgcgggggaaacactgtccgtgaatgatcctcccgacgtgctggataggcagaagtgccttgcagctctagccagccttcgacacgcaaagtggtttcaggctcgggctaacggcctgaaatcctgcgtgattgtcataagagttctcagagatctgtgtactagagtgccaacctggggacctctacgcggatggccattggagcttttgtgcgaaaagtcgatcggcactgcaaaccgccccatgggagccggtgaagccctgagaagggtactggagtgcctggcttccggcatcgtaatgccagacggctccgggatctacgatccttgcgaaaaagaggctaccgatgcaattggtcatttggaccgtcaacagcgggaagacataacacagagtgcacagcacgcacttcgcctggcagccttcggacagctgcacaaggttctgggaatggaccctctgccgtcaaagatgcctaaaaagcccaaaaatgagaatcccgtcgattatacggtacagattcccccaagcacaacttacgcaatcacgcccatgaaaagaccaatggaggaagatggcgaggagaaatcaccaagtaaaaaaaagaaaaagattcagaagaaggaggaaaaagctgagccgcctcaggctatgaacgccttgatgcggctcaaccagttgaaaccaggactacagtataagttagtgtcacagaccggcccggtccatgcccccatttttactatgtctgtagaggtggacggtaatagctttgaagcttccggcccttctaaaaaaacagccaaactccatgtcgcggtgaaggtcttacaggatatggggctgccaactggagctgaaggaagagactcctcaaagggtgaagacagcgctgaggagaccgaggcgaaaccggctgtggtcgcccccgcccctgtggtggaagccgtctctaccccgtcagcagctttccccagcgacgcgactgcagaacaggggccaattctgactaagcacgggaaaaatccagtgatggagctgaacgagaagcgccgagggctcaagtacgagctcatcagcgaaaccgggggaagccacgataagcgcttcgtcatggaagtcgaagtggatggacagaagtttcaaggggccggttcaaacaaaaaagtcgctaaggcttacgccgcactcgccgctctggagaaattattccccgacacaccactggcgctggacgctaacaagaaaaaaagagctccggttcccgtgagagggggccccaagttcgctgcaaaaccacacaacccggggtttggtatgggtgggccaatgcacaatgaggtgccgccaccgccaaatttgaggggtcgtggacgcggcggctccattcgtgggcggggtcgtggccggggctttggcggcgccaatcacggcggctatatgaatgctggagccggttatgggtcatacggctatggaggtaactcagctacagctggctacagcaaaagttctaggcccccacctccgtcgagaccacgctgttgtgtggtgagatgttctgggtccccttgcgggccctcgtgcgatccgtacttggctgtgtttggcacaccttgcctgcagtggtttgtgtcctgccattacaatttcgtatgggtggaatttctcagcttttgtagcagtgttagcctttgtctctttactttgcgagtatctggaaattccgtatgtctttag

SEQ ID NO: 4305 - DNA, 2121 bp, Artificial Sequence
  Description of Artificial Sequence: Synthetic coding sequence
atgcggcccatgcggatcttcgtgaacgacgaccggcacgtgatggcaaaacacagcagcgtgtaccctacccaagaggaactcgaggcggtgcagaacatggtaagccataccgagcgtgctctcaaagccgtttccgactggatagacgagcaagagaaaggctccagcgaacaggctgagtccgataatatggacgtccctcccgaggatgacagcaaggagggagcgggggagcaaaagactgaacacatgactcgcaccctgagaggcgtcatgcgtgttggccttgtggcaaaagggctgctgctgaagggtgacttggatcttgaacttgtgctgctgtgtaaggaaaagcctaccaccgctcttcttgataaagtcgccgacaacctcgcaatacagctggcagccgttaccgaggataaatacgagatactgcagagcgtagatgatgcagccatcgtcatcaagaataccaaggaacccccactgagccttaccatccacctcacgtcacctgttgttcgggaagagatggagaaggtgctggccggagaaaccctgagtgtcaacgatcctcctgacgtgctggatcggcagaagtgcctcgccgctctggccagtctccggcatgctaaatggttccaggctcgcgccaatggactcaaaagctgcgtgatcgtcatccgggtgctcagggacctgtgcactagggtgcctacctggggaccgcttaggggttggccactcgagcttttgtgtgaaaagagcataggaacagccaaccgtccgatgggggcaggggaagccctgagaagagtgctcgaatgtctggcttctgggatcgtgatgcccgacggctcggggatatatgatccctgtgagaaggaagctactgatgcaattgggcacctcgacagacagcaacgggaagacatcacacagtcagcccaacatgccctccgactagcggccttcggacagctccacaaggtgctaggcatggaccctctaccatcaaaaatgcccaagaagccaaagaatgaaaacccggtcgattacacagtacaaattcctccgtctacgacgtatgccatcacccctatgaaaagacccatggaagaagatggagaggaaaaatccccaagcaaaaagaagaagaagatacaaaaaaaggaagagaaagccgagcccccacaagcgatgaatgcactgatgcggctcaatcagctcaagcctgggctgcagtacaagttagtcagtcaaacaggcccggtgcacgcacctatctttactatgagtgtcgaggttgacggcaactcattcgaagcttcgggcccttccaagaaaacagctaagctgcatgtcgctgtgaaggtgctccaggatatgggcctccccacaggggccgagggtcgtgattcttccaagggggaggacagcgctgaagagacagaggccaagcctgcagtggtggccccagcccctgtcgtggaagccgtgtcaacaccaagcgctgccttcccaagtgatgccacggccgagaacgtgaagcagcaaggacctattctgacgaaacacggcaaaaaccccgtcatggaactgaatgaaaaacgaagaggtctcaagtatgagctcatttcagaaacgggcggatctcatgataagagattcgtgatggaagtcgaggtggacggccagaagtttcaaggcgcaggcagcaacaaaaaagttgcaaaagcctacgcagctctcgccgcactcgagaagctgtttcctgataccccacttgcactagatgctaataaaaaaaagagggcaccagttccagttcgcggaggcccaaaatttgccgcgaaaccccacaacccggggtttggtatgggcggcccgatgcataacgaggtaccacctccccccaaccttagaggaagagggcggggaggcagcatccgcgggcgagggcgcggcagaggatttgggggcgccaaccatggcggctacatgaatgctggcgcaggttacgggagttatggttacgggggtaattcagctacggccggctactccgacttctttactgactgttacgggtaccatgatttcggctctagttag

SEQ ID NO: 4306 - DNA, 2073 bp, Artificial Sequence
  Description of Artificial Sequence: Synthetic coding sequence
atgcggcccatgcggatcttcgtgaacgacgaccggcacgtgatggccaaacatagtagcgtctacccaacccaagaggagctagaggctgtgcaaaatatggtgtcccacacagagcgggctctgaaggccgtgtctgattggatcgacgagcaggaaaaaggttccagcgaacaagcagaatcagacaacatggacgtgccccccgaagacgactccaaagaaggggcgggcgagcagaaaacagaacatatgactcggaccttgaggggggttatgagagtggggcttgtggccaaagggctgctgctgaaaggggacctggatcttgaactcgttctgctgtgcaaggagaagcctacgaccgcactcttagacaaagttgctgataacctcgcgatccagctggccgctgtgacagaagacaaatacgagatcttgcagagcgtggacgatgctgctatcgtaatcaagaataccaaggaaccaccattgagcctgaccattcatctcacatcaccagtggtacgggaggaaatggaaaaagtgttggcaggtgaaactctgtcagtgaacgatccccccgacgtcctggacaggcagaagtgtctggctgctctggcctcacttcgacacgctaagtggttccaggcccgagctaacggcctgaagtcgtgcgtgattgtgatcagagttttacgcgatttatgtactagggttcctacttggggcccattgagagggtggcccctcgagctgctgtgcgaaaagagcatcggcaccgcgaatagacccatgggggcgggggaggccctaagaagggtattagaatgtttggcttcaggcatcgtaatgccagacggcagtggaatttatgacccttgcgaaaaggaggccactgatgctatcggacacctggacaggcagcagagagaagacatcacacagagcgctcagcacgccctccgccttgcggcatttggccagttacataaggtgctgggcatggatcccttaccttcaaaaatgccaaagaagcctaaaaatgagaatcctgtcgattataccgtgcaaattccaccttcgaccacctacgccatcacaccgatgaaaagacccatggaagaggacggcgaggagaagtccccctccaagaagaaaaaaaagatccagaagaaggaagagaaggccgagcccccccaggctatgaacgctcttatgaggctgaatcagcttaaaccgggtttgcaatacaagttagtcagtcaaacgggccccgtgcacgccccaatattcactatgtctgtcgaagtggatgggaactcgtttgaagcctcagggccctcaaaaaagacagccaaactgcacgtggctgtgaaggttctacaggatatgggcctaccaacaggggcggagggacgagattcctccaagggcgaagacagcgccgaggagaccgaggccaagccggccgtggttgcccccgcacctgtggtggaggctgtgtctacaccttcagcggcctttccaagcgatgccaccgcagagcagggtcccattctgaccaaacacggcaaaaaccctgtaatggaactaaatgaaaaaagacgcggactgaaatatgaactcatctccgagactggcggcagtcacgataagaggttcgtcatggaggtggaggtggacgggcagaagttccagggagctggcagcaataaaaaggtggctaaggcatatgccgcactcgccgccctcgagaagctgttccccgatactcccctggctctggacgccaataagaaaaagcgcgctcccgtccctgtgcgtggcggtcctaagtttgcggcaaaacctcacaacccaggatttggaatgggggggccaatgcacaacgaagtgccaccccctcccaacctgaggggtagaggcagaggagggtctatacgcggccgcggccgcgggcgtggcttcggaggggcaaaccacggcggttatatgaacgccggagccggttatggaagctacggctatggagggaactcagctaccgccggatatacaggttttgtatag

SEQ ID NO: 4307 - DNA, 2697 bp, Artificial Sequence
  Description of Artificial Sequence: Synthetic coding sequence
atgcggcccatgcggatcttcgtgaacgacgaccggcacgtgatggccaagcacagctcagtgtatccaacacaggaagagttggaagccgtccaaaatatggtcagtcacacagagcgggccctgaaagcagtgtcagattggattgacgagcaggaaaaaggaagctccgaacaggccgagagcgacaacatggacgtgccgcctgaggatgacagtaaggagggagccggagagcagaaaactgaacacatgacgaggacacttagaggcgtgatgcgcgtgggactcgtcgcaaagggcctcctcttgaagggcgatctcgacctggagctggttctcttgtgtaaggagaagccaaccacggcattgctggacaaagtggctgataatctagctattcaactcgccgccgtgacagaggacaagtacgaaattctgcagtcggtggatgacgctgccatcgtcatcaagaacaccaaggaacccccgctgagcctgaccattcacctgacatcccccgttgttagggaggagatggagaaggtactggctggggagacactgagcgttaacgacccccccgacgtgctagaccgccagaagtgcctggccgccctcgcatccctccgacatgccaaatggtttcaggctcgtgccaatgggctgaagtcatgcgtgattgtaatcagagtgctgcgggatctctgtacacgggtccccacttggggtcctctccggggctggcccctggagctcctgtgcgaaaagtcaatcggaacggccaaccgcccgatgggagccggagaggccctgagaagagtgctcgagtgtcttgctagcggcatcgtgatgccagacgggagtggcatctatgatccctgtgagaaggaagccaccgacgcaattggccacctggacaggcagcagcgcgaggatattactcagagcgcgcagcacgccctcaggctggccgcctttggacaactccataaagtattagggatggatcccctgcctagcaagatgcccaagaaacctaagaatgaaaatccagtggattacactgtgcagatccccccatcaacgacctacgctattacccccatgaaaagacccatggaagaggacggtgaggagaagagtccctccaagaagaaaaaaaaaatccagaaaaaagaagaaaaggcggaaccgcctcaggccatgaatgccctgatgagacttaatcagttaaaaccaggtctgcaatataagctggtgagtcagacaggcccagtgcacgcaccgatcttcaccatgtccgtcgaggtggacggaaatagctttgaggcaagtggtccgtcaaagaagacggccaaacttcatgtggcagtgaaggtgcttcaggatatgggattacctaccggcgcagaggggcgggatagttccaaaggggaggactccgctgaggaaaccgaggccaaacctgccgtggtagcacctgcccccgttgtggaagcggtgtccacaccgtctgcggccttcccttccgatgccacggcagagaacgtgaagcagcaaggcccgatactcacgaaacacggcaagaatcccgttatggagcttaacgagaagcgacggggccttaaatacgagctgattagcgaaacgggaggctctcacgacaaaaggtttgtaatggaggtagaagtagacggccaaaagttccaaggtgccggctcaaacaagaaggtggctaaggcctacgccgccctggcggctctagaaaaactcttcccggacactccactggcccttgacgcaaacaaaaagaagcgggcgcccgtccccgtgagaggcggtccaaaattcgcagcaaagcctcataacccaggcttcggcatgggaggccccatgcacaatgaggttccccctccccccaatctgagaggacgcggacgaggaggctctatccggggccggggaaggggcagaggcttcggcggagcaaaccacggaggctacatgaatgccggtgcgggttacggctcttacgggtacggtggcaattccgctactgcgggatactctcagttctactccaacggagggcattcaggaaatgccagcggaggagggggtggaggaggggggggcagcagcggttatggctcctactaccagggcgacaattacaatagccctgtgccacccaagcacgccgggaagaaacagccacacgggggccaacagaagccttcctacgggagtgggtatcagtcgcaccaaggtcagcagcagtcctacaatcagtccccatattccaactatggccctcctcagggtaagcaaaagggatataaccatggacaaggatcatacagttattccaattcttacaactcaccaggcggagggggagggtctgactacaactacgaaagtaagttcaattactccggaagcggcggtcgttccggggggaattcgtacggttctggcggagcatcctataaccctgggtcacacggaggctacggcgggggttcaggcggggggtcaagttaccagggaaaacagggcggatactcccagtctaattacaactcccccggcagcgggcagaattactcaggtccgccttcttcttaccagtcctctcagggagggtacggccggaatgctgaccattctatgaattatcaatacagatag

SEQ ID NO: 4308 - DNA, 882 bp, Artificial Sequence
  Description of Artificial Sequence: Synthetic coding sequence
atggccaccgcccggcccccctggatgtgggtgctgtgcgccctgatcacagcactgctcctcggcgtgaccgaacacgtactcgccaataacgacgtgtcttgcgaccacccatctaacactgtaccatctggtagcaatcaggacctgggtgccggggcgggggaagacgctcggtctgacgacagcagctcacgtatcattaacggctctgattgtgacatgcacacccagccttggcaggcagcccttctcctgcggccaaatcagctctattgcggcgccgtcctggtgcacccccagtggcttctgacagcagctcactgtaggaagaaggtttttcgcgttagacttggccattactcactgagccccgtttatgagtccggacagcagatgttccagggcgtgaagtccattccacaccctggttatagtcatcctggtcattccaataatctcatgctaattaagctgaacagacggatccgtccaaccaaggacgtcaggcctatcaacgtttcatcacattgcccctctgctgggaccaagtgcctggtctctggttggggaaccaccaagtcaccccaggtccatttccctaaggtcctccagtgcctaaatatctccgtcctttcacagaagcgatgtgaggatgcttacccgagacaaattgacgacacaatgttttgcgctggtgataaggctggccgtgattcgtgccaaggcgatagtggcggtcctgtcgtttgcaacggctctctgcagggactggtctcatggggggactatccatgcgccaggcccaatcgacctggcgtctatactaacctatgtaagtttactaaatggatacaggagactattcaagctaattcctag

SEQ ID NO: 4309 - DNA, 882 bp, Artificial Sequence
  Description of Artificial Sequence: Synthetic coding sequence
atggccaccgcccggcccccctggatgtgggtgctgtgcgccctgattacggcactgttactgggggttaccgaacacgtgttggcgaacaatgatgtgtcttgcgatcatccctcaaacactgtgccgtcgggctctaaccaagacctgggcgccggggctggtgaagatgctcgaagtgacgactccagtagccggatcattaatggctcggactgcgatatgcatacccagccttggcaggcagccttgcttctgaggcccaaccagctatattgtggcgcagtcctcgtgcacccacagtggctgctcacagcagctcactgccgcaagaaggtattcagggtgagattggggcactattcactgtcccctgtgtatgagagcggccaacaaatgtttcagggcgtgaagtcgatccctcacccaggctactcacaccctggccatagcaacaacctgatgttgataaaacttaataggcgcatccggccaaccaaagacgtgcggcccatcaacgtcagcagccattgcccttcagcaggcactaagtgtctggttagtggttggggaactacaaagagcccccaggtacactttcctaaagtgcttcagtgcttaaacatcagcgtcctctcccagaagcgatgcgaagacgcatatccgaggcagattgacgacacaatgttctgcgcgggggataaggcaggtcgggacagttgccagggagacagcggcggcccagtggtgtgcaacggatctctgcagggcttggttagctggggcgactacccttgtgcgcggcccaacaggccgggagtatacaccaatttatgcaaattcactaagtggattcaggagacaatccaagccaactcatag

SEQ ID NO: 4310 - DNA, 882 bp, Artificial Sequence
  Description of Artificial Sequence: Synthetic coding sequence
atggccaccgcccggcccccctggatgtgggtgctgtgcgccctgatcactgctctgttactgggcgtcaccgaacatgtccttgccaataatgatgtgtcttgtgaccatcctagcaatacggttccgtccggcagcaatcaagacctgggcgccggggctggtgaggatgcacggagtgatgattcatccagtcgaatcataaatggatctgactgtgatatgcacactcaaccgtggcaagccgcactattgcttagacccaatcagttgtactgcggtgcagtgttagtacatcctcagtggcttctgactgctgcccactgtaggaagaaagtgttccgagtgcggctagggcattactctctgtcaccagtgtacgagagcggacaacagatgtttcagggggttaagtctatcccccaccctgggtatagccatcctgggcatagcaataacctcatgctgataaagcttaataggcgaattcgtccaaccaaggatgtgaggcccattaacgtgtcgtcccactgcccatctgccgggactaagtgtctagtcagtggctggggcactaccaaatctccgcaggttcatttcccgaaggtactccagtgcctcaacatttccgtgctgtcccaaaaacgatgcgaagacgcctatcctcggcagatcgatgacactatgttctgcgcgggcgacaaagccgggagggactcctgccagggtgactctggcggcccagtggtctgcaacggttcattgcagggcctcgtctcttggggggattacccctgcgccagacctaatcgccccggcgtttatactaacttgtgtaaatttactaagtggatccaggagaccattcaagccaacagttag

SEQ ID NO: 4311 - DNA, 2109 bp, Artificial Sequence
  Description of Artificial Sequence: Synthetic coding sequence
atgcccatcaacaagagcgagaagcccgagagctgcgacaacgtgaaggtagtggtacgatgcaggccccttaatgagcgggaaaagtccatgtgctacaagcaggccgtttccgtggacgagatgcgcggcacaattactgttcacaagacagatagtagcaacgagccccccaaaacgttcacgtttgatactgtgttcgggcctgaatctaaacagctcgatgtgtacaaccttaccgcccggccaatcattgattccgtgctcgaggggtacaacgggaccattttcgcttacggccagacggggacaggaaagacatttaccatggagggcgtgcgagccattcccgagttacgcggcatcattcccaactcatttgctcatatttttggacatatcgcaaaggctgagggtgacacacggtttttggtccgagtctcatatctggagatctacaacgaggaggtgagagacctgttgggtaaggaccagacccaacgactcgaggtcaaggaaaggcccgacgtgggcgtgtacatcaaggacctgtccgcgtatgtggttaacaacgccgatgatatggatcgcattatgacactggggcataagaatcggtcagtgggcgccacgaacatgaacgaacactccagccgcagccatgctatcttcacgatcacgatagaatgtagtgagaaggggatcgacggaaacatgcatgtccggatgggcaaattgcaccttgttgacctggcgggttcggagcgacaggctaagactggcgccacaggacagagactgaaggaggcaactaaaatcaatctctctctgtccaccttgggaaatgtaatctctgccctcgtggacggaaaatctacccacgtcccttacagaaacagcaagctgacaaggctactacaggattccctaggtggcaattcgaagacaatgatgtgcgcgaatattggaccagccgactacaactacgacgaaacaattagcaccctgcgatacgctaatcgagcaaagaacattaaaaataaagcaagaattaacgaggacccgaaggatgccttattgcgccagtttcagaaggaaatcgaagagcttaaaaaaaaattagaggaaggagaggagatctccggctcagacatttccggaagcgaagaagatgatgacgaagaaggagaggttggcgaggatggagaaaaaaggaaaaaaaggcgggatcaggccggtaagaagaaggtgagcccagacaagatgatcgaaatgcaggccaaaatagatgaggagcggaaggccctggaaaccaaattggatatggaagaggaagagaggaataaggcccgcgccgagctggagaaacgcgagaaagatctgctcaaggcccaacaggagcaccagtccttacttgagaagctctcagctctggagaaaaaggttatcgtcggcggggtcgatttgcttgcgaaggccgaagaacaggaaaaattgctggaggagagcaacatggagctggaggaaagacgaaagcgggctgagcagttgagaagggagctcgaagagaaggaacaggagcgcctggatatcgaggaaaagtatacttcactccaggaagaagcccaaggtaagacaaagaaacttaagaaagtgtggaccatgctgatggccgctaaatctgaaatggccgacctgcaacaggagcaccagcgcgagattgaagggctgctggagaacatccgtcagctctctagggaactgcgattgcagatgttgatcattgataatttcatccctcgcgattatcaagagatgattgaaaactatgtgcattggaacgaggacattggggagtggcaactcaagtgcgtggcctataccggaaataatatgaggaagcaaacccccgttccggataaaaaggagaaggatccattcgaagtggacctctctcacgtatacttggcctataccgaggagtcactccggcagagcctaatgaagttagagcgtcccagaacaagtaaaggaaaggcccgccccaaaacaggccgtcgcaaaaggtccgccaaacccgagactgtgatcgatagtctactgcagtag

SEQ ID NO: 4312 - DNA, 2100 bp, Artificial Sequence
  Description of Artificial Sequence: Synthetic coding sequence
atgcccatcaacaagagcgagaagcccgagagctgcgacaacgtgaaagtggtggtccgatgccgccctctcaacgaacgggagaagtccatgtgttacaaacaggctgtgtctgtcgatgagatgcgcggaacgattactgtgcacaaaacagattcctccaacgaaccaccaaaaactttcacatttgataccgtctttgggccagaaagcaagcagttggatgtgtacaatctcactgcccggccaataattgatagtgtactagagggctacaacggtaccatattcgcttatgggcagactggtactggcaaaactttcacaatggaaggcgtaagggctataccggagctacgcgggataattcctaactctttcgcacacattttcgggcatatagccaaggcggaaggggacacacgatttctggtccgggttagctatctagagatctacaacgaggaagtgcgcgatctgctgggtaaggaccagacccagcgccttgaagtgaaggaaagacctgatgtgggcgtatatattaaagatttgtccgcatatgtagtcaacaacgccgacgatatggaccgcatcatgaccttaggacacaagaaccggagtgttggggctactaacatgaacgaacacagcagccgatcacatgcaatctttacgataacaatagagtgtagtgaaaagggaattgatggaaacatgcacgttcgtatgggaaagctccacctagttgatttggcaggctctgagagacaagccaagactggcgctacaggccagcggttaaaggaggctactaagatcaatctgagcctgtcaactctcggcaacgttattagcgcccttgtggatggaaagagcactcatgtgccttacagaaacagtaagctcacccgcttgctgcaggattcactcggtggaaactcgaagaccatgatgtgcgccaatattgggccagcagactataactatgatgaaactattagcacactccgctacgcaaatcgcgcaaagaacattaaaaataaagccagaattaacgaggatccgaaagatgcacttcttagacagtttcagaaagagattgaagagttaaagaagaagctggaggaaggcgaggaaatctcggggagcgatatctcgggatcagaggaagacgacgacgaagaaggtgaggtgggggaggacggggagaagcgcaagaagcgaagagggaagaagaaagtgtccccagataagatgatagagatgcaggcgaaaattgacgaggagagaaaggcattagagacaaagttagacatggaggaggaagagcgaaataaagctcgagcggagctggagaagcgtgagaaggaccttctaaaagcacagcaggaacatcagtctcttcttgaaaagctgtcagccctggaaaagaaggtaatagtcggtggcgtcgatctgctggctaaggcagaagagcaggaaaaactactggaggagtctaatatggaactcgaggagcggcggaagagagcggagcagctcagaagggaactggaagagaaggaacaagaaaggttagatatcgaggaaaagtacactagcctccaggaggaggctcagggaaaaacaaaaaaactaaaaaaggtatggactatgctgatggctgccaagtccgagatggcagatctgcagcaggagcaccagcgcgagatagaagggctacttgaaaatataagacagctatcccgtgaacttcggttgcagatgctaattatagacaacttcatccctcgggactatcaggagatgatcgagaattatgtgcactggaatgaggatatcggcgagtggcagttgaaatgtgtagcatatacaggaaacaatatgaggaaacaaactccagtaccggacaaaaaggaaaaggatcccttcgaggttgacctatctcacgtgtacctggcatacaccgaggagtctctaaggcagagcctaatgaagttagagcgacccaggacctccaaaggaaaagccagaccaaaaaccggccggaggaaacgaagtgcaaaacctgaaaccgttatcgacagccttttgcagtag

SEQ ID NO: 4313 - DNA, 1230 bp, Artificial Sequence
  Description of Artificial Sequence: Synthetic coding sequence
atgtgctacaagcaggccgtgagcgtggacgagatgcggggcaccatcacagtgcacaagaccgactcctcaaacgaacctccgaaaacctttacgttcgatacagtgttcggaccggaatccaagcagttggatgtttacaatcttaccgctcggcccatcatcgattcggttcttgaagggtataatggtacaattttcgcatacgggcaaaccgggaccgggaagactttcacaatggaaggcgtcagggctatccctgagcttagagggattatccccaacagcttcgcccacatcttcggccacatcgcaaaggcagagggagatacacgattcctggtccgcgtttcttatttggagatttacaacgaggaagtgagggatctgctcggtaaagatcaaactcagcggcttgaggtgaaagagcgccctgacgtgggcgtgtacatcaaggatctgtccgcctatgttgtcaacaacgcggatgacatggacagaattatgaccctgggacataagaaccgtagtgtgggtgccaccaatatgaacgagcactcatcacggagccacgcgatcttcaccattaccattgagtgttctgaaaagggcattgacggcaatatgcatgtgagaatgggaaaattgcacctggttgatctggctgggagcgagcgacaggccaagaccggcgcaacaggacagcggctgaaggaagctaccaagattaaccttagcttgtcaaccttgggaaatgtgatctctgccctcgtcgatgggaagtctacacatgtgccttacagaaattccaagctgacccggttgctgcaggacagtctgggagggaactccaagactatgatgtgtgccaacattggacccgccgactacaactacgatgaaaccatttcaacactccgctacgccaatcgggcaaagaacattaaaaacaaagccagaatcaacgaagatcctaaggatgcactgttgcgccagttccagaaagaaatcgaggaactgaagaaaaagttggaggagggagaggagatcagcggcagtgatatctccggctcagaggaggacgacgacgaggagggagaggtcggtgaagatggagagaagaggaagaagcggcgcggaaagaagaaagtttcccctgacaaaatgattgaaatgcaggcaaagattgatgaagaacgcaaaaagaagaaaaagaagaagaaaaaatag

SEQ ID NO: 4314 - DNA, 2181 bp, Artificial Sequence
  Description of Artificial Sequence: Synthetic coding sequence
atgcccatcaacaagagcgagaagcccgagagctgcgacaacgtgaaggtagtggtgcgctgccggccactgaatgagagagaaaaaagcatgtgttataagcaagccgtttccgtggatgagatgaggggcacgatcactgtacacaagacagattctagcaacgagcctccgaagaccttcacctttgacacagtgtttggtcccgagtcaaagcaactggatgtgtataatttaaccgctcggccaataatcgacagcgtacttgagggatacaacggcaccatctttgcctatggacagactggcacaggaaaaaccttcactatggagggcgtgcgcgctatacccgagctgagggggataattccaaacagcttcgcccatatattcgggcacattgcaaaggcagagggggatacccggtttctcgtgcgcgtgtcttatctggagatctacaacgaagaagtcagggatctgctcgggaaagatcaaacgcaaaggcttgaagtgaaggaaaggcccgatgtgggcgtctacatcaaagacctgagtgcttacgtggtgaacaatgccgacgatatggatcgaattatgacattgggtcacaagaaccggagcgttggagccactaacatgaatgaacattcatcccgcagtcatgcaatcttcactattacaatcgagtgtagtgaaaaaggcattgacggtaacatgcacgtgcggatgggcaagttacacttggtggacctggcgggttccgaacggcaggctaagacaggagctacagggcagagactcaaagaggccacaaaaatcaacctgagcctaagtacccttggcaatgttatttccgctctcgttgacggaaaaagcacccacgtgccctaccgtaatagcaaacttactagactgttgcaggacagcctcggcgggaatagtaagaccatgatgtgcgctaatattggtcctgcagactacaactacgacgagaccattagcactttgcgctatgctaacagggccaagaatatcaagaacaaggcgcggattaatgaagacccaaaggacgccctgctacgacaattccaaaaggagattgaggaactgaaaaagaagttggaggagggtgaggaaatttctggaagcgatattagtggatcagaagaagacgacgacgaggaaggggaggtgggagaagacggggaaaaacggaagaaaaggcggggctctagcagttcatcatcgagtgactccacttgttctgtgattgaaaagcccctggacaaattcctccctattcagattggcaagaagaaagtaagcccagataaaatgatagaaatgcaggccaagatcgacgaagagcgtaaagcactggagacaaaactggatatggaagaggaggagagaaacaaagctcgggccgagcttgaaaaaagggagaaagacctgcttaaagcccaacaggagcatcaaagcttgctagagaaactgagtgccttggagaaaaaggttatagtcggcggagtggatttattggcaaaagctgaggagcaggagaaactgctggaggagtccaacatggaacttgaggaacgtcggaaacgcgcagaacaactgcggcgcgagctggaggagaaggaacaggaaagattggacatcgaagagaagtacactagcctgcaggaagaagctcaagggaagacgaaaaagttgaaaaaagtatggaccatgctcatggccgctaagagcgagatggctgatctgcagcaggaacatcagagagagatcgaggggctactcgaaaacattcgacagttgagtcgggaacttcggcttcagatgctgatcatcgataattttatcccgcgagactaccaggaaatgatcgagaactatgtacattggaacgaggacattggggagtggcagctgaagtgtgtcgcttacactgggaacaacatgagaaaacagacccctgtgcccgataagaaagagaaagatccgttcgaggtggatctcagccatgtgtacctggcttacaccgaagagtctttgaggcagagtctgatgaagttggaaaggcccaggacttctaaggggaaagcgagacctaagacaggccgacggaaaaggtcagctaagcctgagactgtgatagatagcctcctgcaatag

SEQ ID NO: 4315 - DNA, 1035 bp, Artificial Sequence
  Description of Artificial Sequence: Synthetic coding sequence
atggtgagcgtgaacagcagccactgcttctacaacgacagcttcaaatacaccttatatgggtgtatgttctcaatggtcttcgtccttgggttgatctccaattgtgtggctatctatatctttatatgtgtacttaaggttcgaaacgaaaccacaacatacatgatcaatctagcaatgagcgacttattgttcgtgttcaccttgcctttcagaatattttatttcaccaccaggaactggccatttggcgatcttctttgtaaaataagcgttatgctcttctacacaaatatgtacggcagtattctgttcttgacttgtatcagtgtagaccggttcctagccatcgtctatccgttcaaatccaaaactctgcgtactaagaggaacgctaaaatcgtgtgcactggtgtatggctcactgtcattggtggatccgcccccgcggtgttcgttcagagtactcattcccaggggaataacgcctcagaagcttgttttgagaacttcccggaggctacctggaagacctacttatcaagaatcgtgattttcatagagatcgtagggttctttataccactgattctgaacgtgacttgttcatctatggtattaaagaccctgacaaaacccgttacgctgtcaaggtcaaagatcaataagaccaaagtactcaaaatgatcttcgtgcacctcataatcttctgtttctgtttcgtcccctacaatattaacctaattctatatagtctcgtacgtacacaaacattcgtcaactgcagcgtagtagccgcagttcgcactatgtatcccattaccctctgtattgccgttagtaattgctgtttcgaccccattgtttactactttacctctgatacgatacagaacagcattaagatgaaaaactggagtgttcgccggagcgactttagattctccgaggtgcatggtgcagagaatttcatccagcacaacttgcagacacttaagagtaaaattttcgataatgaatcagccgcatag

SEQ ID NO: 4316 - DNA, 1035 bp, Artificial Sequence
  Description of Artificial Sequence: Synthetic coding sequence
atggtgagcgtgaacagcagccactgcttctacaacgacagcttcaagtacaccctgtatggttgcatgttctcaatggtctttgtccttggcttaatttcaaattgcgtggcaatttatatattcatctgtgttctcaaggtgcgcaacgagacaactacctatatgattaacctggctatgagcgaccttctatttgtcttcacgctaccatttaggatcttctattttactaccagaaactggccatttggcgatctgctctgtaagataagtgttatgttattttacaccaacatgtatgggagcatactgttcctgacctgtatctccgtggatcgcttcctggctatcgtgtatccctttaagagcaagactcttcgtacaaaaaggaatgccaagattgtgtgtactggcgtatggctcacagtaattggcggatctgctcctgctgtctttgtgcaatccacacatagtcagggaaataacgcctccgaagcctgtttcgagaatttcccagaggccacgtggaagacctacttgagccgcattgtaatatttattgagattgtcggattcttcattcccctcatattgaatgtgacctgtagctccatggttctcaagaccttgaccaaacccgtgacacttagcagaagcaaaattaacaagacaaaagttcttaaaatgatttttgtccacctgatcatcttttgcttctgctttgttccctacaacatcaatctgatattgtatagccttgtcaggacacagacctttgtcaattgtagcgtcgttgccgccgtccgaaccatgtaccccataacactctgcatcgccgtgagtaattgctgttttgaccctattgtgtactacttcactagtgatacaatacagaacagtattaagatgaagaactggagcgtgcggaggtcagactttcggttttccgaagttcatggagccgaaaactttatccagcacaacctccagacactcaaatcgaagatatttgacaacgagtctgccgcatag

SEQ ID NO: 4317 - DNA, 795 bp, Artificial Sequence
  Description of Artificial Sequence: Synthetic coding sequence
atgctgcggggcccctgggccttccactacaacgtgagcagccacggctgccagctgttgccctggacacaacacagcccccacacacgcctcagaaggagcggcagatgcgacttgtttcagaagaaagactatgttagaacgtgtattatgaacaacggagtcgggtatagaggcacgatggccacgactgtgggcggcctgccttgtcaggcatggagccataagttccccaatgatcacaaatatactcctaccttaagaaatggccttgaggagaacttctgcagaaatcccgacggggatcccgggggaccatggtgttatactaccgaccctgctgtcagatttcagagttgtggaataaagtcttgccgtgaggcggcgtgcgtctggtgtaatggagaggaataccgcggggcagtcgatcggacagaaagtggcagggagtgtcaaaggtgggatttacagcatccccatcagcacccctttgaacctggtaagttcttagatcaaggacttgatgacaattactgtcgtaaccccgacgggtcggagaggccctggtgttatactaccgacccgcagatcgagagggagttttgtgacttgcctcggtgtggttctgaggcccagccacgtcaagaggctacaacagtgtcctgtttccggggcaaaggtgaaggctaccgggggaccgcaaacacaacaactgccggagtgccctgtcaaagatgggacgcccaaattccccaccagcatagatttacgcccgagaaatacgcttgcaagtag

SEQ ID NO: 4318 - DNA, 2178 bp, Artificial Sequence
  Description of Artificial Sequence: Synthetic coding sequence
atgggcctgtggtgggtgaccgtgcagccccccgcccggcggatgggatggctcccacttctgcttctgctgacacagtgcctcggcgtccctggccagagatcccctctaaatgacttccaggttctcagaggcactgaattacagcacctgttacacgccgtggtgcctggcccctggcaggaagacgtggcggacgccgaagagtgcgctggcaggtgtggtccccttatggactgccgcgcttttcattacaacgtgagcagccacggttgccagctcctcccctggacacaacactctcctcacactaggctacgccggagcggacgctgtgatctgtttcaaaagaaggattacgtgcggacctgcataatgaacaacggcgtggggtatagagggactatggccacgactgtcggtggcctgccttgccaggcctggagccataaattcccaaatgaccataagtatactcctaccctgcgaaatggcctggaggaaaatttctgccggaaccccgatggcgacccagggggaccatggtgttacaccaccgaccccgcagttcggtttcagtcatgcggtatcaagtcctgtagggaggctgcttgtgtatggtgcaatggcgaggaataccgaggcgcagtggatcgtaccgagagcgggagggagtgtcagaggtgggacctccagcatccgcaccagcatccgttcgaaccagggaaattcttagaccaaggcctcgacgacaactattgtcggaacccagacggatccgaacgtccgtggtgttacacgacggaccctcagatcgaacgggaattctgtgacttgccgcgctgcggttctgaggctcagccgaggcaggaagctaccactgtatcttgctttcgaggtaaaggggagggctaccgcggcaccgccaatacaaccactgcaggagtaccttgccagcgatgggatgcccagatcccccatcagcacaggttcacgcccgaaaagtacgcatgcaaggaccttagagaaaatttctgtaggaacccagatggaagcgaggctccatggtgtttcactctccgaccaggcatgcgggcagcgttttgttatcaaatccgcaggtgcactgacgacgtgagaccacaggattgttaccacggagcgggagaacagtacagaggaactgtgagcaaaacacggaagggggtgcaatgtcagaggtggagcgcagagactccgcacaagccacagtttacattcacaagcgaacctcatgcccagctagaggaaaatttctgcagaaatccagatggggactctcacgggccttggtgttatactatggatcctcgcacaccctttgactactgtgccctgcggcggtgtgcagacgatcagcccccttcaatccttgaccccccggaccaggtccagttcgagaagtgtgggaaacgggttgataggctcgatcagagacgctccaagctgagagtagtgggaggacacccaggaaacagtccttggactgtgagtctgcggaaccggcaggggcagcatttttgtggtggatctttagttaaggagcaatggattctgaccgcacggcaatgcttttcatcttgtcatatgcccttgacaggatatgaagtctggctgggaaccctgttccagaacccacagcacggcgagcccagtcttcagcgtgttcccgttgcaaaaatggtctgcggacctagcggaagccagttggtgctcctgaaactagaaagatccgtgaccctaaatcagagggtggcattgatttgtctgccccccgaatggtacgttgttcccccaggtactaagtgcgagatcgccggctggggcgagaccaaggggactggaaatgatacagtcctgaacgtggctctcctcaatgtaatttccaaccaggagtgtaatataaagcacaggggccgcgtgcgtgaatccgaaatgtgtactgagggacttttagctcccgttggagcatgcgagggcgattatggaggtccattggcttgtttcactcataactgctgggtacttgaagggataatcattccaaacagagtgtgtgcacgatccaggtggcccgccgtattcactcgtgtaagcgtcttcgtcgattggattcataaagtcatgcgactggggtag

SEQ ID NO: 4319 - DNA, 495 bp, Artificial Sequence
  Description of Artificial Sequence: Synthetic coding sequence
atgggctggctgcccctgctgctgctgctgacccagtgcctgggcgtacctggccagaggtccccgctcaacgatttccaggtactgcgtggtaccgaactgcagcatctgcttcacgcagttgtgcctggtccctggcaggaagacgttgcagatgctgaagagtgcgcaggacggtgtgggcctctaatggactgccgggctttccattacaacgtgtcatctcacggctgccagctcctgccttggacccagcattcacctcacacacgcttaagaaggagtggaagatgtgacctgttccagaagaagggtacccgccctctgagcggcatggcctggaagcggacatccgccgtcacacttatggccacacccgaggtgctgggagcgacccagcagactttgttgtgtgcctcccgggccgccgcgtccaatcctgctgggcggcctcgagttagtggagccatggctagaaacaccgcggctaggtag

SEQ ID NO: 4320 - DNA, 2070 bp, Artificial Sequence
  Description of Artificial Sequence: Synthetic coding sequence
atggcccccgcccccgtgaccctgctggcccccggcgccgccagctcgatgtcttgttcccagccaggccagaggtcccccagcaacgacttccaggtcctacgcgggacagagcttcagcacctattgcatgccgtggtgccagggccttggcaggaggatgtcgccgatgcggaggaatgcgccggccgatgcgggcccttgatggactgctgggcattccactataacgtttcaagccatggttgtcaattgctgccgtggactcagcactcaccgcattcccgcctgtggcattccggaagatgcgatttgttccaggagaaaggggaatggggttacatgcctacactcaggaacgggctggaggagaatttttgtcggaaccctgatggcgaccccggaggaccgtggtgccatacaactgaccccgctgtgcgatttcagtcgtgctccattaagtcttgtcgagtggcagcatgcgtgtggtgcaacggtgaagaataccggggggcagtcgatcgcactgagtcaggcagggagtgtcagcgctgggatctacagcatccccaccagcacccttttgaacccggcaagttcctggatcagggcctagacgataattactgtaggaacccagatggcagcgagagaccatggtgctacacaactgaccctcaaatcgagagagaattctgtgaccttccccggtgtggctctgaggctcaacccagacaggaagcgacctctgtaagctgctttagggggaaaggcgagggatatagaggcacggccaatacaactactgccgcctatctcgcgtctgtgggcactcgaaaatcccatatcagcaccgacctacggcagaagaataccagagcttcagaagttggtggcggggccggggttggaacctgttgctgcggggatcttagggaaaatttctgctggaacctggacggaagtgaggcgccgtggtgtttcactttgcggcccggaacccgagtcggattttgctatcaaatccgccgctgtactgacgatgtgagaccacaggattgttatcatggggcaggtgagcagtatcgagggacggtgagcaaaacccggaaaggggtgcaatgtcagaggtggagtgcagaaactccacataagctccaggctcttacccttggaagacacgcattgatgtctgggacaagagcctggaagtggctgcgacttccctgccacgattttgcacctgcccccgcttccgtgcatatctatctgcgcaccgcatgcactaccggcggggagctgcttcccgatccagacggtgatagccatggaccgtggtgctacacaatggacccccgcacgccctttgactattgcgcccttagacgatgtgatcaggtgcagtttgagaagtgtgggaagcgcgtggaccgccttgatcagcggcgctccaagttgcgggtggctggtggacaccctggtaattccccgtggactgtgagcttacggaatcgacacatgcctttgactggctacgaggtctggctgggcacactgtttcagaatccccaacatggggagcccgggttgcaacgcgttccagtggctaagatgttatgtggcccatcaggatctcagcttgtgctgcttaagctggaaagaagtgtaactctgaaccaaagagtggctctgatctgcctcccccctgaatggtacgtggtgccccccgggaccaagtgcgaaatcgccggatggggggaaacaaaaggcactgggaacgatacagtgctgaatgtggccctgctgaatgtgatttcgaatcaggaatgcaacataaaacatcggggccacgtgcgggaatccgagatgtgtaccgaaggactcctcgcacccgtgggcgcctgcgaaggcgattacggagggccgttagcatgctttactcataactgctgggtactcaaagggatccgaatccccaacagagtttgcacacgatcacgctggcccgctgtgttcacgcgagtgagcgtgtttgtcgactggattcataaggtgatgcgactgggttag

SEQ ID NO: 4321 - DNA, 1698 bp, Artificial Sequence
  Description of Artificial Sequence: Synthetic coding sequence
atgaccagccggtgcagcggcgcccagagctacctgctgcacgccgtggttcccggtccatggcaggaagatgtggcggatgctgaggagtgcgccggacggtgcgggcccctgatggattgttgggcgttccattacaacgtgtcgtcacatggctgccagctgctcccgtggacccagcattcgccgcacagccggctttggcactccggcagatgcgatctttttcaggagaaagattatattagaacctgtataatgaataatggagtggggtacaggggtacaatggccactacagtgggcggcctctcatgccaggcctggagtcacaagtttcccaacgatcacaagtacatgcccacattacggaatggcttagaggaaaacttttgccggaacccagacggcgatccgggaggcccatggtgtcacaccaccgaccctgccgtgagatttcagtcctgcagtatcaagtcatgtcgggtcgctgcctgcgtgtggtgcaatggagaggagtatcgaggcgccgtggataggacagagagtggtagggaatgtcagaggtgggacctgcagcaccctcatcagcatccgttcgaaccgggcaaatttctggaccagggtttagacgataactactgccgcaacccagacggtagcgagcgtccctggtgctatacaaccgatcctcagatagagcgagagttctgtgatctgccccgttgcggctctgaagcccagcctagacaagaagcaacttcagtgagctgtttcagaggcaaaggcgagggctacaggggaaccgcaaatacgacaacaggtgtcccttgtcagcgatgggatgcacagattccccatcaacatagatttacccccgagaagtatgcttgtaaggatctcagggaaaatttttgctggaatcttgacggtagcgaagctccttggtgcttcacactgagacccggaacacgggttgggttttgctatcaaatcaggagatgtaccgacgacgtgcggccgcaagattgctatcatggggcaggcgaacagtaccggggaaccgtttctaaaacacgcaagggggtgcagtgccagcgctggtcggcggaaactccccacaagttgcaatttaccttcacctccgagccacacgcccaattggaggaaaacttctgccaaccggatggcgattctcacgggccatggtgttacaccatggacccaaggactccgttcgactattgcgccctgcgaagatgtgcagacgaccagcccccgtctatactggatccccccaatcaggtacagtttgaaaagtgcggaaagagggtggaccggctggatcaaaggaggtccaagctgcgagtagccggcggacatcccggtaactcaccctggactgtgtcacttagaaaccggcagggccagcatttctgcgctggatctctggtcaaagagcagtggattctgaccgcccggcaatgtttctcaagctgtcacatgcccctaactggatacgaagtatggttgggaaccctgttccagaatccgcagcacggagaacctggtctgcagcgagtgccagtggctaagatgctctgtggaccatcggggagccagcttgtgctgctgaagcttgaacgtagcgtgacactcaatcagagggttgccctgatctgcttgcctccagagtag

SEQ ID NO: 4322 - DNA, 2148 bp, Artificial Sequence
  Description of Artificial Sequence: Synthetic coding sequence
atggcccccgcccccgtgaccctgctggcccccggcgccgccagcagcatgtcatgctctcagccaggccagagatccccaagcaacgactttcaagttctccgggggaccgagctccaacacctactccacgctgtagtgcctggcccttggcaggaggatgtagccgacgctgaagaatgcgcagggagatgcggtccactaatggattgctgggctttccactacaacgtttcatcccacggttgccaacttctgccttggacacagcacagcccacactctagactgtggcattccggtcgatgtgacctgtttcaggaaaagggagaatgggggtacatgcctaccctgcggaatggtctggaggagaacttctgcagaaatccagacggcgatccaggtggcccttggtgtcatacgacagaccctgctgtcagattccagagctgcagtattaaatcctgcagagttgccgcctgtgtgtggtgcaacggcgaagagtataggggagctgtcgatagaacagagtccgggcgcgagtgtcagaggtgggacttacagcatccccaccagcatcccttcgagccaggcaagttcttggatcagggcctcgatgataattactgccgcaatcccgatgggtctgaacgtccatggtgttatactaccgatccacagatcgaaagagagttttgtgacctgcctcgctgcgggtccgaagcccaacctagacaagaggcaacgagcgtcagttgttttaggggtaagggggaaggctacagagggactgcaaataccacgacagccgcatacctggcatctgtggggactcgaaaaagccatattagcaccgatctccggcagaagaatactagggcctctgaagtcgggggaggggccggcgttggcacgtgttgctgtggagacttgcgtgagaatttttgctggaacctggacggctctgaggctccctggtgcttcactctgcgtccagggacccgagtcgggttctgttatcagatcagacggtgtactgatgacgtcagaccacaggattgttatcacggagctggcgagcaatatcgcggaaccgtctccaagacaagaaaaggagtccagtgccaacggtggagtgcagagacacctcacaagctgcaggccctgaccctagggcgtcacgcgctgatgagcgggacccgcgcctggaaatggttgcggctgccctgtcacgactttgctcccgccccggcgtcagtgcacatttacttacggaccgcatgcaccaccggcggcgagctcctgcccgatcccgatggagactcacacggaccatggtgctacaccatggatccgcgtacacccttcgactattgcgctctgaggcggtgtgaccaagtgcagttcgagaagtgcggtaagagggtagataggctcgaccaaagacgctcaaagctgcgggtcgctggcggccacccggggaacagtccatggacggtgtccctgcgcaaccggcaaggccagcacttctgcgcagggagccttgtgaaggaacaatggatcctaactgctcgacaatgcttttcgagctgccacatgcctctcaccggctacgaagtgtggctgggaaccctatttcagaaccctcaacacggcgagccaggcctgcagcgtgtgcctgtcgccaaaatgctgtgcggacctagcggctctcaactggtcctgctaaagcttgaacgaagtgttacgctgaatcaaagagtcgccctgatctgtctacctccagaatggtatgtggtgcccccaggaaccaaatgcgagatcgcggggtggggagagactaagggcactggcaacgacactgttttgaacgtggcgctcttgaatgttatttctaatcaagaatgtaacattaagcaccgagggcatgtccgggagagcgagatgtgtactgaaggcctgcttgctccagtgggggcctgtgaaggagactacggagggccactagcctgcttcacgcacaactgctgggttcttaagggcattaggatccccaatagggtctgcacccggagcagatggcccgccgtttttactagggtgagtgttttcgtagactggatacacaaggtgatgcgactaggctag

SEQ ID NO: 4323 - DNA, 1101 bp, Artificial Sequence
  Description of Artificial Sequence: Synthetic coding sequence
atgcgggtgatggccccccgggccctgctgctgctgctgagcggcggactagctctgacagagacatgggcctgtagccactccatgaggtattttgacacagccgtaagtcggcctggaagaggtgagcctcggttcatctcagtgggctacgtggatgatacacaatttgtgcgattcgactcagacgccgcaagccctcggggggagccacgggctccttgggttgagcaagagggcccggaatattgggacagggaaactcagaaatacaaacgacaggcccaggctgaccgcgtgtcgctgaggaatctgcgggggtactataatcaatccgaggacggctcccacactctgcagcgaatgtcgggatgtgacctgggccccgatggcagactcctgcgcgggtacgaccagtcggcttacgacggcaaggattacatcgcgctgaacgaggatctacgctcttggaccgccgccgacactgccgctcagattacacagcggaaactagaagccgctcgagccgcagagcagctccgcgcatacctagaggggacctgcgtagagtggctcagacggtatctggagaacgggaaggagaccctgcagcgcgctgagccccccaagactcacgtaacacaccacccgctgagcgaccatgaagctaccctcaggtgctgggccttgggattctatcccgcagagattacactgacctggcaacgggacggcgaggaccagacacaggacactgagctggttgagaccaggccagccggtgacgggaccttccagaaatgggcggcggttgtagttccatccgggcaagagcagaggtatacttgtcatatgcagcacgaaggcctccaagagcctttgacactgtcatgggagccctctagccaacccaccattccgataatgggaattgtggcgggactggccgtgctggttgtgctggctgttttgggtgctgtcgttacagccatgatgtgtcgcagaaaatcttctggcggaaaaggtggcagctgttctcaagcagcctgctcgaactccgctcagggctctgacgaaagcttgataacctgtaaggcatag

SEQ ID NO: 4324 - DNA, 396 bp, Artificial Sequence
  Description of Artificial Sequence: Synthetic coding sequence
atgcgggtgatggccccccgggccctgctgctgctgctgagcggcgggctggcccttacagaaacatgggcatgttctcatagcatgaggtactttgacacagcggtgtcaagacccggaagaggtgagccacgatttattagtgtcggatatgtggatgatacccagtttgtacgattcgactccgacgctgccagcccacggggcgagccacgcgctccatgggttgaacaggagggtcctgagtattgggacagagagacccaaaagtataagcgccaagcccaggcggaccgtgtgtcattgcgaaacctgaggggttattataaccaatccgaagatgaggacgtttggcttaggccgggagcccgtcgcgcccctccacctcgtgtgtag

SEQ ID NO: 4325 - DNA, 1119 bp, Artificial Sequence
  Description of Artificial Sequence: Synthetic coding sequence
atgcgggtgatggccccccggaccctgatcctgctgctgagcggcgcactcgcgctcaccgaaacctgggcctgttctcattccatgcggtatttctacacagcagtgtctagaccaggccgaggggagccccgtttcattgcggtaggttatgtcgacgatactcagtttgtgcaattcgattccgatgccgcatcacccagaggggaacctagggccccctgggtggagcaagaagggcccgaatactgggatcgggagacccaaaaatataagcgccaagcacagaccgaccgcgttaatttacggaaattgaggggatactacaaccaaagcgaggcaggatctcacactttgcagagaatgtacggttgcgatctcggaccagatggacgccttctgcggggttataatcagttcgcatatgatgggaaagactacatcgccctgaatgaggatttgcggtcttggacagcagcagataaggccgctcaaatcacacagaggaagtgggaagccgctagagaggcggaacaaagaagagcttatctggagggcacatgcgtcgagtggctgcgacgatatctggagaacggtaaaaaaacattgcagagagccgagcatcccaaaacacatgtgacacatcatcccgtgagtgaccacgaagcgacacttcgctgctgggcccttggtttttatcccgcggagataacgctgacctggcagagagacggagaggatcagactcaggacaccgagctggtcgaaaccagaccagctggtgatggcacctttcagaaatgggcagcagtcgttgtgccttccggcgaggaacagcgttatacgtgccacgtgcaacacgaaggccttccagagccgctgacgttacggtggggtcctagcagtcagccaacaattcccatcgtggggatcgtggccggactcgccgttctggccgtcctggccgtgctgggcgcagtcatggccgtggtgatgtgtaggagaaagagctccggtcattttctgccaacaggaggcaagggaggttcatgttcacaggccgcgagctcaaattccgctcaaggcagcgatgagtctctcatcgcctgtaaagcttag

SEQ ID NO: 4326 - DNA, 1119 bp, Artificial Sequence
  Description of Artificial Sequence: Synthetic coding sequence
atgcgggtgatggccccccgggccctgctgctgctgctgagcggcggactggctctgactgagacctgggcgtgctcccatagcatgcgctattttgacaccgcagtcagccggccaggccgcggtgagccccgttttatttctgtcggctatgtggatgatacccaattcgtcagatttgattctgatgccgcaagtccgcgtggggagcctcgtgcaccttgggtggagcaagagggacctgaatattgggatagagagacacagaagtacaagcggcaggcacaagcggaccgggtctccttgagaaacctgaggggctactacaaccagtcagaggacggttcccatacgttacagcggatgtctggttgtgacctcggacctgacggccgactgcttcgcggctacgatcagagcgcttacgatggaaaggattatatcgcattgaatgaagaccttcggagttggacagccgcagacacggccgcccaaataacccagaggaaactcgaagctgccagggccgccgagcagctccgggcctatctcgaaggaacatgcgtcgagtggcttcggaggtatctcgaaaatgggaaggagactctgcagcgcgcagaacctcctaagacccacgtgacccatcaccctttgagcgatcatgaggcaacacttcgctgctgggccctgggcttctatccagcagagattacgctcacctggcaacgggatggggaggaccagacgcaagataccgagctggtagaaactcgccctgccggagacggtacttttcagaaatgggctgcagtagtcgtgcccagtgggcaggagcagagatatacctgccacatgcagcatgaaggactgcaggagcccctaacattatcttgggagcctagctcccagccaaccatacccattatgggcattgtggctgggctggctgtgctggtggtgctagctgtcctcggcgcagtggttaccgcaatgatgtgccgtcgaaaatcctccggacactttctccccactggtgggaagggcggcagctgtagccaggccgcctgctctaattcagctcagggctccgacgagtccttgattacctgtaaagcctag

SEQ ID NO: 4327 - DNA, 1194 bp, Artificial Sequence
  Description of Artificial Sequence: Synthetic coding sequence
atgcgggtgatggccccccggaccctgatcctgctgctgagcggcgctctggcactgactgagacatgggcctgctctcattctatgcggtatttctataccgccgtctcccgcccagggcgtggggagcctagattcattgccgtgggatacgtggacgacactcaattcgtccaattcgattctgacgccgcgtcaccccgtggcgagcctcgggccccttgggtggagcaggagggacccgaatactgggatcgggaaacgcagaaatacaagcggcaggctcagactgacagggttaatttacgaaagctgcggggatattataaccagtctgaagccgggagtcacacactgcaacggatgtacggctgtgatctgggccctgatggcagacttctgcggggatacaatcagtttgcatatgatggcaaggattacattgcattgaatgaggacttgagaagctggacagccgctgacaaggcagcccagataacccaacggaagtgggaagcagcccgtgaagccgagcagcggcgcgcctatctagaaggcacatgcgttgagtggctgcgccgctacctggaaaacggcaaaaagaccttacagagggcagagcaccccaagactcatgtcacccaccatccagtaagcgaccatgaagccaccctgcgatgctgggcactgggtttttatcctgcagagatcaccctaacctggcagagagacggcgaggaccagacccaggacaccgagctggtggaaactcggcctgcaggcgatggcacatttcagaagtgggccgctgtcgtagttcccagcggagaagaacaacgatatacatgtcacgtacagcacgagggtctgcctgagccactgacactcagatgggggccctcttcacagcccacaatccctattgtggggatcgtcgccggccttgctgtgctggcagtcctggctgtcctcggagcggtgatggctgtcgtgatgtgccgcaggaagagttccggcagggaaggcgtgcggagtggtgtgtggcccgcaactgtgccacgcgccctgatgtctctttccagccttgttaaacctgagaccgccgcttgcgtaggcctccgatgcaggatctcatctcatctgagcttcgtgacatctagggcttctggcatcagcttttgcaaagggatttag

SEQ ID NO: 4328 - DNA, 1119 bp, Artificial Sequence
  Description of Artificial Sequence: Synthetic coding sequence
atgcgggtgatggccccccggaccctgatcctgctgctgagcggcgccttggcactcaccgaaacctgggcttgcagtcactctatgagatacttctacacagccgtcagtcggccgggccgtggagaaccaagatttatcgcagttgggtatgttgacgacacccagtttgtgcaatttgacagcgacgccgcgagcccaaggggcgaaccacgggctccgtgggtggaacaggaaggacccgaatattgggatcgtgagacacaaaagtataagagacaggctcagacggatagagtgaacctccggaaactccggggctattataaccaatcagaggcaggttctcacactctccagagaatgtatggctgcgacctggggccggatggccgcctgctccgcggatacaatcagtttgcttatgatgggaaagactatatagccctgaatgaagacctgcgatcctggactgccgccgataaagcggctcagattactcagcgaaaatgggaggcagcacgtgaggctgaacagagacgtgcttacctggaaggcacatgtgttgagtggctgcgcaggtatttggaaaatggtaaaaagacgctccagcgggccgagcaccccaagacccacgtaacacatcacccagtgtctgaccatgaggccacactgcggtgctgggccctcggattctaccctgcagagatcacactcacctggcaacgggacggcgaggatcagacacaggacacggaactggtcgaaacacgtcccgccggtgatggtacattccagaagtgggcagccgtggtcgtcccttctggagaggaacagaggtatacatgccacgtccaacacgagggcttgccagagcccctcacactgcgctgggggccttccagtcagcccaccatccctattgtaggaatcgtggccgggctggccgtgctggctgtcctggccgtgttaggggccgtgatggctgtggtaatgtgccgccggaaatccagtggtcactttttgcccacaggcgggaaaggaggaagctgctcccaagccgcttcaagcaactcggctcaggggagcgacgaatctcttatagcctgcaaggcatag

SEQ ID NO: 4329 - DNA, 1194 bp, Artificial Sequence
  Description of Artificial Sequence: Synthetic coding sequence
atgcgggtgatggccccccgggccctgctgctgctgctgagcggcggcctggcccttaccgaaacgtgggcctgttcacatagcatgcgatacttcgatactgctgtgagccgccccgggaggggcgaaccccgctttatctctgtgggctatgttgacgatacgcagtttgtcagattcgactctgacgccgcctcccctcgaggcgagccccgggcaccctgggtggagcaggaaggcccagagtattgggacagagagacccagaagtacaaacgtcaggctcaagccgaccgagtcagccttcggaatctccgagggtattacaatcaatctgaagatggctcccacactctgcagaggatgtctgggtgcgacctcggtccagatggccggttgctccgggggtacgaccagtctgcttacgatggcaaggattatatcgcactgaacgaggatctgcggtcctggaccgctgcagacactgccgctcagatcacccaacgcaaactcgaggctgccagagccgctgaacagttgcgggcgtatctcgaaggcacatgcgtagaatggctcaggaggtacttggagaacgggaaggaaacactacagcgagccgaacctcccaagacccacgtgactcaccatccccttagcgaccacgaagcaacactgaggtgctgggctctaggcttctacccggcagagatcactctcacctggcagcgggacggcgaagaccagacccaggacacagagctggtcgagacgcggccagctggcgatggcaccttccagaaatgggccgcagtcgtggttccttctggacaggagcagcgttatacatgtcacatgcagcacgagggccttcaggaaccactgactcttagctgggagccttccagccagccgacaatccctataatgggtattgtggcaggccttgcagtgttagtagttctggcagtgctgggagcagtcgtgacagctatgatgtgccggaggaagtcgagtggccgcgaaggggttaaatctggcgtgtgggccgcgacagtgcccagggcattgatgtctctaagttctttagtgaagccagagaccgccgcatgtgtcgggctcagatgtcggattagcagtcacttgtccttcgtgactagccgtgcatcaggaattagcttttgcaagggtacatag

SEQ ID NO: 4330 - DNA, 1101 bp, Artificial Sequence
  Description of Artificial Sequence: Synthetic coding sequence
atgcgggtgatggccccccggaccctgatcctgctgctgagcggcgcgctcgccctgacagagacatgggcatgtagccacagcatgcgctatttctacacagcagtgtccagacctggacgcggagaaccccgctttatagctgttggatatgtagacgatactcagttcgttcagttcgattccgacgctgcctcacccagaggggagcccagggcaccatgggttgagcaagaaggacctgaatattgggacagagagacacaaaagtacaaaaggcaagctcagactgatagagtcaacctccggaaacttcgaggatactacaaccagtcagaggccggcagccacacactgcaaaggatgtatggatgtgacctgggccccgacgggcgcctgctgaggggctacaaccaatttgcatacgacgggaaggattacatcgccctcaatgaggacctgcggtcgtggaccgccgccgataaagctgcccagattactcagcggaaatgggaggcagctagagaagccgaacagagaagggcatacctcgaaggcacttgtgtagagtggctgcgtcgctacctggagaatggtaagaagaccctgcagcgtgctgaacatcctaaaactcatgttacccaccaccctgtgtccgaccacgaagccactctcagatgttgggccttgggtttttacccggctgaaatcacattgacctggcaacgcgacggcgaggaccagacacaggatacagagttggtggagacgaggccagctggagatggaaccttccagaagtgggccgccgtggtggttccatcgggcgaggaacagcgttacacctgtcatgtgcagcacgagggtcttccggaacctttaacactaagatggggtcccagctcacagcccactatcccaatcgttggtattgtggccggtctggcagtgctcgctgtcctggccgttctcggcgctgtgatggcggtggtgatgtgtagacggaaatcatccggtggcaaaggaggctcctgctcacaggcagcctcctccaatagcgcacagggaagtgatgaaagcctgatcgcatgtaaggcctag

SEQ ID NO: 4331 - DNA, 1101 bp, Artificial Sequence
  Description of Artificial Sequence: Synthetic coding sequence
atgcgggtgatggccccccggaccctgatcctgctgctgagcggcgcgcttgctctgactgagacctgggcctgttcccacagtatgagatatttctacaccgctgtgtcccgccccggtcggggcgagccccgatttatcgcggttggatacgtggacgatactcagttcgtccagttcgattcggacgccgccagtccaaggggtgaaccccgggctccctgggtggaacaggaggggcctgagtactgggacagagagacccagaagtataaacgacaggcccagacagatcgcgtgaacctgcgaaaattacgggggtactataatcagagtgaggctggctctcatacactccagcgcatgtacggctgtgacctcggcccagacggaaggctactcagaggttataatcagttcgcgtatgacggtaaagattatattgccctaaacgaagatttgcgctcttggaccgccgcagataaggcagcccagatcacccagcgcaaatgggaagcagctagagaggctgagcagaggcgcgcttatcttgagggcacttgcgtggagtggctgaggcggtacctggagaacggcaaaaagacactgcagagagctgagcacccaaaaacacacgtcactcatcaccccgtctcagatcatgaggctactttgcgctgctgggcactgggtttttatcccgcggaaatcacgctcacttggcagagagatggagaggaccagacacaggacaccgaactggttgagacccgacctgcgggggacggcacctttcagaagtgggcagctgtcgttgtgccaagcggagaggaacagagatacacatgccatgtccagcacgaaggtctccccgaaccactaaccttgaggtggggaccctccagccaacctacaatccctatcgtcggaattgtggctggacttgctgtactggccgtcctagccgtgctaggcgcagttatggcggtggtgatgtgtcgtcggaagtcgtctgggggaaaaggcgggagctgttctcaggctgcctcttccaactctgcacaggggagtgatgaaagcctgattgcgtgtaaggcatag

SEQ ID NO: 4332 - DNA, 1194 bp, Artificial Sequence
  Description of Artificial Sequence: Synthetic coding sequence
atgcgggtgatggccccccggaccctgatcctgctgctgagcggcgccctggcacttactgaaacatgggcctgcagccactcaatgcgctatttctatacagctgtaagccgtcctgggagaggagagcccaggttcattgcagtgggctatgtcgacgacactcagtttgtccaatttgactcagatgccgccagtccccgcggggagccaagagccccatgggttgaacaggaagggcctgaatactgggatagggagacacaaaaatataagcggcaagctcagaccgaccgggtgaatttgcggaaactgagaggatactacaatcagtccgaggcaggttcacatacactgcagcggatgtacggttgcgatctcggtcctgacggccgtttactgaggggatataatcagttcgcttacgatggaaaggactatattgcgttgaacgaggacctgcggagttggacagcagctgataaggcggcacagattactcagaggaagtgggaagccgctcgcgaggctgagcagcgcagggcataccttgaaggaacgtgcgtcgaatggttgagacgctatctcgagaacgggaaaaagaccttgcagagagcggaacacccgaaaacacacgttactcaccaccccgtctctgaccatgaggcaacgctgcgttgctgggcccttggtttctacccagcagaaattacgctcacatggcaaagagacggggaagaccagacccaagataccgaactggtcgaaaccagacctgcgggcgacggcacattccagaagtgggctgctgtggtggtgccatccggagaggagcaaagatacacatgtcatgttcagcatgaggggcttccggaacccctgactttgcgatgggggccgtcttcccagcccacaatcccaattgtgggcatcgtggctgggctggcggttctggcggtcctcgctgtgctgggagccgtgatggccgtcgttatgtgtcgtagaaaaagtagtgggagggagggcgtgcgctctggggtgtggccagccaccgtgccccgggcacttatgtctctcagcagtctggtcaagcctgaaacagcagcgtgtgtgggactccggtgtcggatctcaagccatttgtccttcgtgacgtctcgggccagtggaatctccttctgtaagggcatctag

SEQ ID NO: 4333 - DNA, 1194 bp, Artificial Sequence
  Description of Artificial Sequence: Synthetic coding sequence
atgcgggtgatggccccccggaccctgatcctgctgctgagcggcgccctggccctcactgaaacttgggcatgcagtcattccatgcgatatttttacacagctgtgagcaggccaggtaggggcgaaccccgtttcatcgccgtggggtatgtagatgatactcagtttgtgcgctttgactccgatgccgctagccctagaggtgagccaagggcaccctgggttgaacaagaaggccccgaatactgggatcgggagacccaaaaatacaaacgtcaggcgcagactgatcgcgtgagtctccgtaatctgagaggttattacaatcagtcagaagccggcagtcacacacttcagtggatgtatggttgtgatctggggccagacgggagactgctgcgagggtacgatcagtccgcctacgatggcaaggactacatcgctcttaatgaggatctccggtcctggaccgccgccgatactgctgcgcagatcacccagaggaaatgggaagccgcccgcgctgcggagcaacaaagagcatatctcgaagggacctgcgtggagtggcttaggaggtacctcgagaacggcaaagagactttacagcgggccgagcatcctaaaactcatgtgacgcatcatcttgtctctgatcatgaggccaccctgaggtgctgggctttaggtttctatcctgcggaaattacactgacatggcagagagatggtgaagaccagacccaagatacagagctggttgagacgagacctgccggtgacggaacatttcagaagtgggccgcggttgttgtgccgagtggtgaggaacagcgctatacatgtcacgtgcagcatgagggcctgcccgaacccttaactcttagatgggagcccagtagccaacctaccattccaatcgtcgggatcgtcgcgggtctcgccgtgttagcagttctggcagtgctcggggccgtcgtagctgtggtcatgtgtagacgtaaaagttccggcagggagggggtgagaagcggggtctggcctgctaccgtaccacgggcattaatgtctctgagttcattggtcaagcccgaaacagccgcatgcgtaggcctaaggtgtcgcattagctcccatctctctttcgtgacatctcgcgcctccgggatctctttttgcaagggaatttag

SEQ ID NO: 4334 - DNA, 786 bp, Artificial Sequence
  Description of Artificial Sequence: Synthetic coding sequence
tgacgggtgatggccccccgggccctgctgctgctgctgagcggcggtctggctcttaccgaaacttgggcttgtagtcattcaatgcgttattttgatacagccgtgagccgaccagggcgaggcgaacctaggtttatatcagtgggctatgttgacgacacgcaatttgtgcggttcgacagcgatgctgcttccccacggggcgagccaagagccccttgggtggagcaagagggacctgagtactgggatcgggagacccagaagtacaaaagacaagcgcaggcggaccgagttagtttacgcaacttgcgcggttactacaaccaatcggaggatgggtcccacaccctgcaaagaatgtcaggctgcgatctcggtccggatggtagactgctaagaggctacgaccagagcgcttacgatggcaaagactacatcgcccttaacgaggatttaagaagctggaccgcagcagatactgctgcacagattacacagcggaaattggaggccgctcgagctgccgagcaactacgtgcatatctggagggtacctgtgtggagtggctcagaaggtacctggaaaatggcaaagagacactgcagcgggctgaacccccaaaaacccatgtcactcaccatccactctctgatcacgaggcgtccaggcgctggaacctgcctgaagtcggtagctgcggtggggccttctggacaagggcggagatccacgtcccatacgccgcccggggtgcggctagggctccccacccagaatag

SEQ ID NO: 4335 - DNA, 1119 bp, Artificial Sequence
  Description of Artificial Sequence: Synthetic coding sequence
atgcgggtgatggccccccggaccctgatcctgctgctgagcggcgccctggcccttacagaaacctgggcgggtagtcactctatgaggtatttctatacagccgtgagtaggccaggcagaggagagcctcattttattgccgttggatacgtcgatgacacccagtttgtaaggtttgacagcgacgccgcgtccccacggggtgagccaagggcaccctgggtggagcaagaagggcctgagtattgggaccgcgagacccagaaatacaaaaggcaggctcagactgatagagtgagtctgcgtaacctgaggggttattacaaccagagtgaagccggcagccacatcatccagaggatgtacggttgcgacgtcggaccagatggtcgactgctgagggggtacgaccagtatgcttatgatggaaaagattacatagcacttaatgaagatctccggtcttggaccgccgccgatacagcagctcagatcacacaacgtaagtgggaagccgcacgagaggctgagcaactgcgggcttacttagaagggctctgtgtcgaatggttgaggcgttacttgaaaaacggtaaagaaacactgcagcgtgcggagcaccctaagacacacgtgactcatcacccggtttctgatcacgaagccacccttaggtgctgggccctgggattttatcctgcagaaatcacattgacctggcagtgggatggcgaagaccaaactcaagacactgaactggtggagacgaggccagccggcgatggaacattccaaaaatgggctgcagtggtggtgccttcgggagaagaacagagatacacatgtcacgtgcagcatgaagggctgcccgaaccactcacactgcgttgggaaccttcttcacagccaactatacctattgtcggtattgtcgcaggtttggctgtgctggccgttcttgctgttctcggcgcagtggtggcggttgtaatgtgccgtaggaaaagctcgggacactttctcccaactgggggtaaggggggcagttgcagccaggctgcttcaagtaacagtgcccaaggaagtgacgagtctctcatcgcctgcaaagcgtag

SEQ ID NO: 4336 - DNA, 1020 bp, Artificial Sequence
  Description of Artificial Sequence: Synthetic coding sequence
atgcgggtgatggccccccggaccctgatcctgctgctgagcggcgccctggctcttactgagacttgggcgtgtagtcacagcatgcgttacttttatactgcagtttctaggcctggccgcggggaaccaaggttcatcgccgtaggctacgtagacgacacacagttcgtgcggttcgacagtgacgctgcaagcccccgtggagagccaagagcaccgtgggtggaacaagaaggcccagagtactgggacagggagacccaaaagtacaagagacaggcacaaaccgatagagttagtctgaggaacctccgaggttactataatcagagtgaggctggatcccacaccctacagtggatgtatggctgtgatctaggaccagacgggcggctgctgcgcggctatgaccaaagtgcctacgatggaaaggactatatcgcactgaacgaggatctgcggagctggacagcggccgatacggcggcccagattacacagcgtaaatgggaagcagcacgcgcagcagagcagcagcgcgcctacttggagggcacttgcgttgagtggttaaggaggtatctcgagaacggcaaggagacccttcaaagggccgaacaccccaagacccatgtaacacatcacctggtgtccgaccacgaagccaccctgcgttgctgggcactgggcttctaccccgcagagattactcttacctggcagcgagacggggaggaccagactcaagacacggagctggtcgaaacccgacccgcaggggatggtaccttccagaaatgggctgcggtagtcgtcccaagcggagaggagcagcgttacacgtgtcatgtgcagcatgaaggcctgcccgagcccctaacactccgatgggagccatcctctcagccaactatacctattgtgggcatcgtggccggcctcgccgtcttggcagtgctcgccgttctcggggctgtcgtggctgtggtgatgtgtagacggaaatcaagcgcgtag

SEQ ID NO: 4337 - DNA, 1101 bp, Artificial Sequence
  Description of Artificial Sequence: Synthetic coding sequence
atgcgggtgatggccccccggaccctgatcctgctgctgagcggcgcccttgccctaactgagacttgggcttgttcccacagcatgcgttattttgatactgccgtttcccggcccggccggggcgaacctcgcttcatttcggtggggtatgtggacgacacacaattcgtaagattcgactctgatgccgccagcccccggggcgaaccgcgcgccccttgggttgagcaggaggggccggaatattgggatcgggagacacaaaagtacaagcgccaggctcaggctgatagagttaacctgcgaaaactaaggggttactataatcagtccgaggacgggtcacacaccctccagtggatgtacgggtgtgatctgggcccagacgggcggctgcttaggggttatgaccaatccgcgtatgatggtaaagactacatagccctaaacgaagacctccggtcatggacagcggcagacactgccgcacagattactcagcgaaaatgggaagcagctcgggaagccgagcaatggagggcttacctggagggtacgtgcgtggagtggctgcgcaggtacctcgaaaacggaaaggagactctgcagcgcgccgagcacccgaagacccatgtcacccaccatcctgtgtcagatcacgaggccactctccgatgctgggccctggggttttacccagcagagataacattgacatggcagcgcgacggggaagaccaaacacaggatactgagctcgtcgaaactcgacccgctggagacggaacttttcaaaaatgggccgcagtcgtcgtccctagtggcgaggaacagagatacacctgtcacgtccagcatgaaggtttacccgagcctttgactctgcggtgggagcctagcagccagccaaccattccaattgtgggcattgttgctgggttagccgtgctggcggtgctggcggtacttggcgccgtgatggcagtagtgatgtgtagacgtaagagcagcggaggtaagggcggttcatgtagccaggccgcctccagcaatagtgctcagggttccgacgagtccctaattgcctgcaaggcatag

SEQ ID NO: 4338 - DNA, 1107 bp, Artificial Sequence
  Description of Artificial Sequence: Synthetic coding sequence
atgcgggtgatggccccccgggccctgctgctgctgctgagcggcgggctggccctcaccgagacttgggcgtgctcacacagcatgcggtatttcgacaccgccgtcagcaggcctggccgtggggaacctaggttcatctccgtaggatatgtcgatgacactcagtttgtcaggttcgactcagacgccgcaagtccacggggagaacctagggccccctgggtggagcaggaaggacctgagtattgggatagggaaacccagaattacaaacgtcaagcccaggctgacagggtcagcctgaggaacctgcgtggatactacaatcaatccgaagatggctcccatacactgcagcggatgtacgggtgcgatttgggcccggacggccgtctcctcagaggctacgaccagagtgcgtacgatggcaaagattacattgcactcaatgaggatctccgatcatggacggcagccgatacggccgcccagattactcaacgtaagcttgaggccgctcgcgccgctgagcagcttcgggcgtacctggagggcacctgtgtggaatggctcaggcgttatcttgagaatggcaaggaaactctacagagggccgagccacctaaaactcacgttacccaccaccctctcagtgatcacgaggccactctcagatgctgggctcttggattctaccccgctgaaattacgctgacatggcagagggacggcgaggaccagacacaggacactgaactcgtggaaacaagacctgcaggagacggcacttttcaaaaatgggccgctgtcgtagtgccaagcggacaagagcaacgctacacctgccatatgcagcacgagggactacaggagcctttgacgctgagctgggagccatcaagccagcccactatccctataatgggaatcgtagccgggttggccgtgctggtggtgttagcagtgctcggggccgttgtgaccgccatgatgtgccgtagaaagtcctctgcggcatgtgtggggctgagatgccggatctcctcccatctgagttttgttacctcaagagcttcaggaatatcgttctgtaaaggcgtgtag

SEQ ID NO: 4339 - DNA, 1194 bp, Artificial Sequence
  Description of Artificial Sequence: Synthetic coding sequence
atgcgggtgatggccccccggaccctgatcctgctgctgagcggcgccctcgctcttacggagacttgggcctgtagtcactctatgaggtacttcgatacagcggtttcccggcccggacgaggcgagcccaggttcatctccgtgggatacgtggatgacacccagttcgtcaggttcgattctgacgccgcttcacccaggggcgagccacgggcaccctgggttgaacaggaaggccccgaatactgggatcgtgagacacaaaagtacaaacgacaggcacaggctgatagggtcaacctccggaagttgagagggtactacaaccagtccgaagacggtagtcacacgctgcagtggatgtacggatgtgatctgggcccagacggccgccttctgaggggttacgatcagagcgcttatgatggcaaggactacattgctctgaacgaagatctgcgcagctggactgccgccgacacagctgcccagattacacaaaggaagtgggaggctgccagggaagctgagcaatggcgtgcctatctggaaggcacctgtgtcgaatggcttagaaggtatttggaaaatggcaaggagaccctgcagagggcggagcaccctaaaactcacgttacccaccaccctgtcagcgatcacgaggcaactcttagatgctgggcgttgggcttctacccagccgagatcacacttacatggcagagggatggtgaagaccagacccaggataccgagttggtggaaactcgccccgcaggcgatgggacatttcagaagtgggccgctgtggtggttcccagcggggaagaacaaaggtacacctgtcacgtacagcatgagggactcccagagccactaactctgcgatgggagccaagcagccagccgacaattccaatcgtcggcattgtggctggcctggccgtcctcgctgtgctagcagtgcttggagccgttatggccgtggtgatgtgtagacgcaagagctctggtcgcgaaggcgtgaggagcggtgtctggcctgctaccgtccctcgagcactgatgtcgctgtccagtcttgtcaaaccagaaactgctgcctgcgtgggcctaaggtgccgtatcagcagccacctgtcgttcgtgacctctagagcgtctggaatctctttctgcaagggcatttag

SEQ ID NO: 4340 - DNA, 1119 bp, Artificial Sequence
  Description of Artificial Sequence: Synthetic coding sequence
atgcgggtgatggccccccgggccctgctgctgctgctgagcggcggcttggccctgaccgagacttgggcatgttcgcacagtatgcggtactttgacacagctgtctctagacccggtcgaggtgaacctcgcttcatcagtgtgggatatgtggacgacactcagttcgttaggttcgatagcgacgcagctagcccgcgcggagaaccaagggcaccttgggtggagcaggaggggcccgaatattgggatagggaaactcagaactataaacggcaggcacaggcggatcgcgtatctctgagaaacctccggggatactacaaccagtctgaggatggcagtcacactttacagaggatgtacgggtgtgacctgggcccagatggtcgactgctgcggggatacgaccaatctgcctacgacggaaaagattatatcgcactgaatgaagacctccgcagttggaccgccgccgataccgctgcccagattacccaaagaaaactggaagccgcgagagccgcggagcaactccgggcctacctagaaggaacatgtgtcgaatggcttagacgatacctggagaatgggaaggagaccctgcagagggcagaaccacctaaaacacacgtgacacatcatccactcagcgaccacgaagccactctgaggtgttgggctcttggcttttacccagccgagataacactgacctggcagagggacggcgaggaccaaacgcaggacacagagctcgtcgagacccggcctgccggagatggcacctttcagaaatgggcagcagtcgtggtgccctctgggcaggagcagaggtatacatgtcacatgcagcacgaaggactgcaggagcccctcaccctgtcttgggagccaagttctcagcctactattccaattatgggcatcgtcgccggactggctgtactggttgtccttgccgtgttgggagccgttgtaacagcgatgatgtgcaggagaaagtcctccggccacttcctccccactggggggaaggggggtagttgctcacaggcagcttgtagtaactcagctcagggatccgacgagtctctgatcacttgtaaggcatag

SEQ ID NO: 4341 - DNA, 1101 bp, Artificial Sequence
  Description of Artificial Sequence: Synthetic coding sequence
atgcgggtgatggccccccgggccctgctgctgctgctgagcggcggtctcgctctcactgaaacttgggcctgtagtcactccatgaggtacttcgatacggcggtctcgcggccaggccgcggagagccccggttcataagcgtgggctacgtagacgacacacagtttgtacggtttgacagcgacgcagcctctccaagaggcgagcccagggccccatgggtggagcaggaggggcctgaatattgggatcgcgagacgcaaaactacaagagacaagcccaggcggatcgcgtttcactccgtaatttgagggggtactacaatcagtccgaagatggatcccacactctccagagaatgtacggctgtgacttgggtcccgacgggagattactgcggggatatgatcaatcagcatacgacggcaaggattacatcgctctgaacgaagatttgaggagctggactgcagctgataccgcggctcaaattactcagcgcaaactggaggcagcgcgggcggctgaacagctgcgggcatatttggagggtacttgcgtggagtggctccgccggtatctcgagaatgggaaagagactttgcagcgggcggagccacccaaaactcacgtaacccatcaccccctgagcgatcatgaagcgacactccggtgttgggcattggggttttacccagccgaaattacgttgacttggcagcgcgacggggaggaccagacccaagacacagagcttgtggaaacaaggccagccggggacggaacattccagaaatgggcagccgttgtagtgcctagcggacaggagcaaaggtatacatgtcacatgcagcatgaaggtctgcaggaacctctgacgctgagttgggagccgagctcccagcctactattccaatcatgggaattgtggcaggattagcagtccttgtagtcctggccgtcttgggcgctgtggtcacagccatgatgtgccgccgcaagtcatcaggcggcaaaggtggcagctgctcacaggccgcatgcagtaatagcgcccagggttccgacgagagtctcatcacctgcaaagcgtag

SEQ ID NO: 4342 - DNA, 1107 bp, Artificial Sequence
  Description of Artificial Sequence: Synthetic coding sequence
atgcgggtgatggccccccggaccctgatcctgctgctgagcggcgctctagcactgactgaaacatgggctgggtctcattcgatgaggtatttttacacagcagtaagcaggcctggtagaggggagccccactttatcgccgtggggtacgtggacgacacccaattcgtaaggtttgactcagatgccgcctcacctaggggtgagcctagagccccatgggttgagcaggaggggccggagtattgggatagggaaactcaaaagtataaaagacaggctcaaactgatagagtaagccttcgcaacctgcggggatattataatcaaagtgaggccgggtcccatataattcagcggatgtatggctgtgacgtgggcccagatgggagactcctgcggggctatgaccaatatgcctacgacggaaaagattacattgccttaaacgaggatctacggtcatggacggctgcagatacggcagctcagattactcaacgtaagtgggaggcagcgcgggaagctgaacagctcagagcctatctagagggactatgtgtggagtggctgcgacgttatctgaaaaacggaaaagagaccctgcagcgggccgagcacccgaaaacccacgtgacacatcatccagtgtccgatcatgaggctacactcagatgctgggctctcggtttttatccggcagagattacgctcacatggcagtgggatggcgaggatcagacccaggacacagaattagtagaaacacgacctgctggagatggcacctttcagaagtgggccgctgtggttgttccttccggagaagagcagcgctatacttgtcacgtgcaacacgaaggactccccgagcccctgaccctgagatgggaaccatcatcgcagccgacaatccccatagttggcatagtggccggccttgcggtgcttgccgtcctggccgtgctgggtgcagtggtcgccgtggttatgtgcagaaggaagtctagcgccgcctgcgtgggccttaggtgtaggataagttctcacctgtcctttgtgactagtcgtgcctcggggatttccttttgtaaaggaatttag

SEQ ID NO: 4343 - DNA, 1194 bp, Artificial Sequence
  Description of Artificial Sequence: Synthetic coding sequence
atgcgggtgatggccccccgggccctgctgctgctgctgagcggcggcttagccttgacagagacctgggcctgcagccactcaatgagatactttgataccgccgtatccagacctgggcgtggggaaccgcggttcatctcagtgggctacgtagatgatactcaatttgtcagatttgactccgacgctgcttcaccacggggggagcctcgggcaccatgggtcgagcaggaaggcccagagtactgggatcgcgagacacaaaactacaaaagacaggctcaggccgatagagtctcgttgcggaatctaagaggttattacaatcagtccgaggacggtagccataccttacaacggatgtatggctgtgatctggggccggatgggaggctgctccggggctatgaccagagtgcgtatgatggtaaagattacatcgccctcaacgaagatctccggtcttggacggcagcagataccgcggcccaaattacacaaaggaaactagaggccgcgcgggccgcagagcagttaagggcctacctggaaggaacatgtgtcgagtggcttaggcggtaccttgaaaacggcaaagaaacactgcaaagagccgagccgccgaaaactcacgtcacccaccaccccctgtccgatcacgaggccaccttgagatgctgggccctgggattctacccagcagaaatcactctgacctggcagcgcgacggggaggatcagactcaagatacagagttggtcgagacccgacccgcaggagatggtacctttcagaaatgggctgcggtcgttgtgccctctggccaggagcaacgctatacgtgccacatgcaacatgagggtctgcaagaaccccttaccttaagctgggaaccttccagccaacctacaatccctattatggggattgtggcaggtctggccgtgctggtagtgcttgccgtactgggagctgtggtcacagccatgatgtgccgccggaagtcctccggacgcgagggcgttaaaagcggcgtgtgggccgcaaccgttcctcgcgcattaatgagcctttctagtcttgtcaagcccgagacagcagcctgtgtcgggctgcgttgccgcatttctagtcatctgtctttcgttacatctagagccagcggtatctcattttgcaaaggagtctag

SEQ ID NO: 4344 - DNA, 1068 bp, Artificial Sequence
  Description of Artificial Sequence: Synthetic coding sequence
atgcgggtgatggccccccggaccctgatcctgctgctgagcggcgccttggccctgacggagacttgggcgggcagccatagcatgcggtatttttacaccgcagtgtcacgccccggacggggagaaccacatttcatcgccgttgggtatgtcgacgatacccagttcgtccgttttgacagcgatgccgcaagtcccagaggagaaccaagggcaccttgggtagaacaggaaggccccgaatattgggatcgcgagacccagaaatataagcggcaggctcagacagatagggtgagcctgaggaaccttcggggctattacaatcagagcgaagccggtagccatattatccagaggatgtacggctgcgacgtcggccccgacgggcgactcctccgtgggtatgaccagtacgcttacgatggcaaagactatatagccctgaacgaggacctgagatcgtggactgcagccgatacggccgcacagataacacagagaaagtgggaagccgcacgggaggcagagcagcttcgcgcctatctcgagggactctgtgtggaatggctgaggaggtacctgaagaatggcaaggaaacactgcagcgcgccgaacacccaaagactcacgtcactcaccatcccgttagtgatcatgaagccacccttagatgctgggcactgggattttacccagcagaaatcacactcacatggcagtgggatggagaggaccagactcaagacactgagctcgttgagacccgtccagccggcgacgggaccttccaaaagtgggctgcagtcgtcgttccctccggcgaggaacagaggtatacttgccacgtgcagcacgaggggttacccgaaccactgacgctgcgctgggaaccaagcagccagccaacaattcccatcgtaggaattgtcgccggtctggccgttctggctgtgctcgccgtgctgggcgcagtcgtcgcagtggtgatgtgccgccgcaaatcttctgcttcaaacagcgcccagggctcagacgaatctctgatcgcgtgcaaagcgtag

SEQ ID NO: 4345 - DNA, 1107 bp, Artificial Sequence
  Description of Artificial Sequence: Synthetic coding sequence
atgcgggtgatggccccccggaccctgatcctgctgctgagcggcgctctcgctcttactgagacctgggcctgttctcactccatgcggtatttctacaccgccgtgtcgaggccaggaagaggcgagcctcgtttcattgccgttggatacgtggacgacacccagttcgtccaatttgacagtgatgcggcttctcctagaggagagcctagagctccttgggtagaacaggagggaccagagtattgggacagggagacacagaagtataagagacaggcacagaccgacagagtgaacttacgaaagttaagagggtattacaaccagagcgaggcgggatcccacactctgcagcgcatgtacgggtgcgatttaggacccgatggtcggctgctccgagggtataatcagttcgcctacgatggtaaagactatatagccctcaacgaggatctccggtcttggactgccgccgataaggccgcccagatcacacagcgtaagtgggaggccgcaagggaagccgagcagcggagggcttatctagagggcacctgtgttgaatggcttaggcgctatctggaaaacggcaagaagactctgcagagagccgaacatccgaagacccatgtaacacaccatcctgtgtcagaccatgaggcgactcttcgctgttgggccctgggcttctaccccgccgagattacgctgacctggcagagggacggggaagatcaaacccaggatactgagcttgtggagacaagacctgccggagatggtactttccagaagtgggcggcggtggtggtcccgagtggcgaggaacaacggtacacttgtcacgtacagcatgaggggctcccagagccgctgacactgagatggggacctagcagccagcccactatacctattgtcggaatcgtcgcggggcttgctgtcctggccgttctcgccgtgcttggcgctgtgatggccgtggtaatgtgtcgaagaaagagctctgccgcctgtgtgggactccgctgccggatctcaagccatctttctttcgtgacatcacgcgcctctggtatatctttctgcaagggcatttag

SEQ ID NO: 4346 - DNA, 786 bp, Artificial Sequence
  Description of Artificial Sequence: Synthetic coding sequence
tgacgggtgatggccccccggaccctgatcctgctgctgagcggcgctttagcgcttaccgagacttgggcttgctcccacagcatgcggtacttctacacagctgtgtcccgcccagggcggggtgagccaaggttcatagccgtgggttacgtagacgacacacaattcgtcaggtttgattcagacgctgcatcaccaaggggagaaccccgtgctccatgggtcgagcaagaggggccagaatattgggaccgggagacccagaaatataagaggcaggcacagacagaccgtgtgagcctgaggaaccttcgcggatactacaaccagtcagaagccgggtctcacactctgcagtggatgtatggctgtgatttgggaccggacggcaggttgctgcgcggttatgaccagtcagcctacgacggcaaggactacatcgccctaaatgaagaccttcggagctggacagccgcagacaccgcggcccaaattactcagcgcaaatgggaggcagcccgggccgcggagcaacagcgtgcttatcttgaaggtacttgtgtggaatggctgaggaggtacctcgaaaatggtaaggaaactctacaacgcgcggaacatccaaagacccatgtgacgcaccatctcgtgtcggatcatgaagctagtcggagatggaatctgccagaggtcggcagctgcgggggcgcgttctggaggcgggctgaaatacacgtgccatgtgcagcgcggggtgctgccggcgctcctcacccggaatag

SEQ ID NO: 4347 - DNA, 1101 bp, Artificial Sequence
  Description of Artificial Sequence: Synthetic coding sequence
atgcgggtgatggccccccggaccctgatcctgctgctgagcggcgcattagccctcactgagacctgggcttgttctcactccatgaggtatttctacaccgccgtgtctcgccctggccgcggtgagcctcgcttcatagccgtgggatacgtggatgatacacagttcgtcaggttcgattccgatgcagctagcccccggggcgagccgcgggctccctgggtggaacaggagggtcctgaatactgggatcgggagacccaaaagtataagcggcaggcacagactgaccgtgtctcactccgcaacctccgtggttactataatcagagcgaggccggcagccatacccttcagtggatgtacgggtgcgatctcgggcctgacggccggctcctgagggggtacgatcaaagtgcctacgatggcaaggattatatcgccctcaatgaggacctccgctcctggaccgccgctgacaccgctgcacaaattactcagcgaaaatgggaggctgcaagggccgcagagcagcagcgtgcgtatcttgaagggacatgtgtcgaatggctccggaggtatttagagaacgggaaagagactttgcagagagccgagcatcccaagacgcatgtaactcaccacttggtttccgaccacgaagctacgctgaggtgctgggcgcttggtttttatcctgccgaaatcacgctcacttggcagcgagatggggaggaccagacccaagacaccgaattggtggagacccgacctgctggcgatggcaccttccagaagtgggccgctgtggtcgtgccctcaggcgaagagcaaaggtacacttgccatgtccaacacgaaggattacccgagccgctcaccctgcggtgggagccgtcctcccaacctacgattcctatagtcggcattgtagcaggcctggccgttttagccgtcctcgccgtcctgggtgctgttgttgccgtcgttatgtgtcggagaaaatcatccggcggaaagggagggtcctgcagtcaggctgcatcatccaacagtgcccagggctcagacgaaagcctaatcgcttgcaaagcatag

SEQ ID NO: 4348 - DNA, 786 bp, Artificial Sequence
  Description of Artificial Sequence: Synthetic coding sequence
tgacgggtgatggccccccggaccctgatcctgctgctgagcggcgcattagctctcacggaaacatgggctggctctcatagtatgcgctacttttacaccgccgtcagcagacctgggcggggcgaaccgcatttcattgccgttggttacgttgacgacacccagtttgtgaggttcgattccgacgccgcctctccccgcggagagccacgagccccctgggtcgagcaggagggaccagagtattgggatcgtgagacccaaaaatacaagaggcaggcccaaacagaccgcgtgagcctgagaaatctgcgcggttactataatcagtctgaagcgggaagtcacattattcaaaggatgtatggctgtgatgtcgggccagatggacggctgttgagggggtatgatcagtacgcatacgatggtaaggactacatcgccctgaatgaggatctgcgtagctggacagctgctgataccgctgctcagatcacccaacggaagtgggaagccgcccgcgaagccgagcaacttcgggcctatctggaaggtctttgcgttgagtggcttcgcaggtatctaaaaaacggaaaggaaacactacagagggctgagcacccgaagacacatgtcacccaccatcctgtatccgaccatgaagccagccggagatggaacctgcctgaggtgggatcctgcggtggcgccttttggagacgagcagagattcacgtcccatgcgccgcccggggggccgccggggctccacacccagagtag

SEQ ID NO: 4349 - DNA, 786 bp, Artificial Sequence
  Description of Artificial Sequence: Synthetic coding sequence
tgacgggtgatggccccccggaccctgatcctgctgctgagcggcgcattggccctgaccgagacttgggcttgttcacacagcatgcgctacttttacacagccgtgtccagacccgggagaggcgaaccaagatttattgctgtaggttacgtggatgatacccagtttgttcaattcgatagtgacgcagccagcccgcgcggagagcctcgggcgccttgggtagaacaggaagggccggagtactgggaccgcgagacacagaagtacaaacggcaggctcagaccgatagagttaatctgcgcaagttgcgcggctattacaaccagtcagaggccggaagtcacaccctgcagagaatgtacggctgcgatctgggacccgacggcagattactgaggggctataaccagtttgcgtacgacggaaaagattacatcgctttgaacgaggatctgagaagttggactgccgccgataaggctgctcagattacccagagaaaatgggaagcagcacgcgaggcagagcagcgaagggcgtacctcgaaggaacctgcgttgaatggcttagaaggtatcttgagaacggcaaaaaaacgctgcagagagctgaacacccaaagactcatgtcacacaccacccagtgtccgatcacgaggcgtcccgtcggtggaatctgcccgaggttgggtcttgcgggggcgccttctggcggcgagcggaaatccacgtgccatgcgcagcacgcggagctgctcgggcccctcacccagaatag

SEQ ID NO: 4350 - DNA, 786 bp, Artificial Sequence
  Description of Artificial Sequence: Synthetic coding sequence
tgacgggtgatggccccccggaccctgatcctgctgctgagcggcgcgttggctctaactgaaacatgggcctgtagtcactccatgagatatttctacactgcagtttcgcgtcccggcagaggcgagccccgcttcattgccgttgggtatgttgacgatacccagttcgtgcagtttgactccgatgccgcgtctccccgcggggaaccgagagccccttgggtggagcaggagggccctgagtattgggatcgcgagacgcagaagtataaaagacaagcccagacagacagggtaaacttacggaaactgagaggctattataaccagagtgaggcaggaagccacactctccaaaggatgtatgggtgtgacttgggtcctgacggcagactgctaaggggctataatcaatttgcctacgacggtaaggattatatcgctcttaacgaggatctgcgcagctggaccgctgcggataaggcagcacagattacacaaagaaagtgggaggcagcaagagaggccgagcagcggagggcctatttagagggtacctgcgtggagtggctgcgtagatatctggagaatggaaagaagacgttgcaaagggccgaacatccgaaaacccacgtaacccatcaccctgtcagcgaccacgaggccagtcggcggtggaacctgcctgaagttggcagctgtggcggggccttttggcgccgggcagagatccacgtgccctgcgccgctagaggcgccgcccgcgcccctcacccggagtag

SEQ ID NO: 4351 - DNA, 1119 bp, Artificial Sequence
  Description of Artificial Sequence: Synthetic coding sequence
atgcgggtgatggccccccggaccctgatcctgctgctgagcggcgctctggcccttacagaaacctgggcctgcagtcactcgatgcgatatttctataccgccgtgtcacggcccggccgtggggagccgaggttcatagctgtcggctatgtggatgatacccaatttgttaggttcgacagcgacgccgccagccctcggggcgaacctcgcgcaccctgggtggagcaagaaggtcccgagtactgggatagggagacccagaagtataagagacaggcccagacggaccgtgtaagtttaaggaacctaaggggctattataaccagtcagaagccggctcccacactctgcaatggatgtatggttgcgacttaggcccagatggtagactgctgagaggttatgatcagagtgcttatgacgggaaggattacatagctcttaacgaggacctgcgaagctggacagctgccgatactgctgcacagatcactcagcgaaagtgggaagccgcacgcgccgccgagcagcaaagagcatacctggaaggcacctgcgtggagtggctgaggcgataccttgagaatgggaaagagactcttcaaagagccgaacatcccaagactcacgtgacgcatcatctggtatcggatcatgaagccacactgaggtgttgggcactgggattctatcctgctgagattacactcacatggcagagggacggcgaggatcagacccaggacacggagcttgtggaaacgcgcccggccggtgacggtaccttccagaagtgggccgccgttgtcgtgccttccggcgaagagcaaaggtacacctgccatgtccagcacgagggcctgcctgagcctctcacgcttcgctgggaaccatcatctcagccaactattcccattgtcggaatagttgctgggttagccgtgttggctgttttagctgtactaggcgcagtggtagccgtggttatgtgtaggcgaaagtcttcaggacactttctccctaccgggggtaaggggggtagctgtagtcaggccgccagtagcaattccgcccagggatctgacgagagcctcattgcatgcaaggcctag

SEQ ID NO: 4352 - DNA, 786 bp, Artificial Sequence
  Description of Artificial Sequence: Synthetic coding sequence
tgacgggtgatggccccccggaccctgatcctgctgctgagcggcgctctagctttgaccgaaacatgggcatgttcgcattccatgcgttacttcgacaccgctgtgagcagacccggtcggggcgaacctcgctttataagtgtggggtatgtagacgacacgcagttcgttaggtttgattccgacgcagctagccccagaggagagcctagggccccgtgggttgagcaggagggacctgagtactgggatagggaaacacagaagtacaagcgccaagcacaagcggacagagtgaatctgcgcaagctgcgagggtattataaccagtccgaagatgggtcccatacattacaatggatgtatgggtgtgacctggggccagacggcaggctgttgcggggttacgatcagagcgcatatgatggcaaagattatattgccctgaacgaagatttgcgatcttggacagcggccgacactgccgctcagattactcagaggaagtgggaagctgcaagagaagcagagcagtggagagcctacctagagggaacttgtgtggagtggctaagaagataccttgaaaatggtaaggagacactgcagcgggccgagcatcccaaaacccacgtcacccaccacccagtttccgatcatgaggcctctaggcgatggaatcttcccgaagttgggtcatgcggaggagccttctggcgtcgcgccgagatccatgttccctgtgccgcaagaggcgctgcccgtgctcctcaccccgaatag

SEQ ID NO: 4353 - DNA, 1107 bp, Artificial Sequence
  Description of Artificial Sequence: Synthetic coding sequence
atgcgggtgatggccccccggaccctgatcctgctgctgagcggcgcactcgctctcacggagacctgggcctgctctcatagcatgaggtactttgataccgccgtctcacggcccggtagaggcgaaccgaggttcatttctgtggggtacgtcgatgatacacagtttgtgaggtttgactctgatgctgctagcccacggggtgaacctcgcgctccctgggtggaacaggagggccccgagtattgggatcgggagacacaaaaatacaagcgccaggcccaggcagaccgagtcaacttacggaagctgcgtggatactataaccagtccgaggacgggtcacataccctccagtggatgtacggctgtgacctaggacctgatggcaggctgcttcgaggttatgatcagagcgcctatgacggcaaagactacatcgctctcaatgaggatctgcgatcctggaccgccgccgataccgcggctcagattactcagcggaagtgggaagccgctcgggaagcagagcaatggcgagcttatctagaagggacctgcgtggaatggctgcgacggtacctggagaacggcaaggaaaccttacaacgagccgagcatccgaaaactcatgtgactcatcacccggtgagtgaccacgaagccacgctcagatgctgggcactggggttttaccccgcggaaataactctgacttggcaaagggatggggaagatcagacccaggatacagaacttgttgagaccagacccgcgggggacggtacatttcagaaatgggctgctgtggtggtgccaagtggggaagagcaaaggtacacctgccatgtgcagcacgaagggctgcctgaacctcttacattacggtgggaaccttctagccaacccacaatccccatcgtcggcattgtcgctgggctcgcggtgttggccgtcttagcagtgttaggggcagtgatggccgtagtgatgtgccggcggaagtctagcgccgcgtgcgttggactaaggtgccggataagttcccacttgtcctttgttaccagccgcgcatccgggataagtttctgcaagggtatctag

SEQ ID NO: 4354 - DNA, 786 bp, Artificial Sequence
  Description of Artificial Sequence: Synthetic coding sequence
tgacgggtgatggccccccgggccctgctgctgctgctgagcggcgggctggccttaactgagacatgggcatgctctcactctatgcgatattttgacaccgcagtctcaaggcccggtcgcggagagccgagatttatttcagtcggatacgtcgacgacacccagttcgtgagattcgattctgatgctgcttccccacggggcgaacctcgcgccccgtgggtggaacaggaagggccagaatattgggatcgcgaaacccagaactacaagcgccaagcacaagccgacagagtgtccctgagaaatctaaggggctactataatcagtcagaagacggtagtcacacactgcagagaatgtatggctgtgatttggggccggacggtcgcctcctcaggggatatgatcagagcgcctacgatggaaaggattacattgcactgaacgaggatttacgctcttggactgccgcagacacggccgctcagatcacacagcgtaagctggaggctgcgcgcgcagctgagcaactgcgagcttacctcgagggcacttgcgtcgagtggctcagacgttatttggagaacgggaaggaaaccctccagcgagctgaacccccaaaaacgcatgtcactcaccatccgctctctgaccacgaagcctctagaagatggaacctgccggaggtcggctcgtgtggcggggccttttggaccagagcagagatccacgttccttacgcggccagaggagccgctcgtgcgcctcatcccgagtag

SEQ ID NO: 4355 - DNA, 1101 bp, Artificial Sequence
  Description of Artificial Sequence: Synthetic coding sequence
atgcgggtgatggccccccggaccctgatcctgctgctgagcggcgcactggctcttaccgagacttgggcaggttcacatagtatgagatatttctataccgccgtctcacggcctggccggggagagccacactttatcgcagttggatacgtggacgacacacaatttgtgcgcttcgatagcgacgctgcatctcctcggggcgagccacgcgctccctgggttgaacaagagggaccagagtattgggacagggaaacccagaaatacaagagacaagcccagacagatagggtgtcactgcggaacctgcgcggctactacaatcagagcgaagctgggtcccacattatacaaaggatgtatgggtgtgacgtgggcccagacggaagattactacgcggctacgaccagtatgcatacgacggcaaggactacattgctctcaatgaggatctgcgctcttggacagctgctgacactgcagcacaaatcactcaaagaaaatgggaggcagcccgagaagctgaacagttgcgcgcttatcttgagggtctgtgcgtggagtggttgcgccggtacctgaaaaacggaaaggagactctgcagcgtgctgagcatccaaaaacacacgtgacacaccacccagtgtccgatcatgaggccactctgcgctgctgggccctgggtttctatccagccgagattaccctcacatggcaatgggacggggaggaccagacccaggatactgaactagtagaaacacgacctgcaggcgacggaacgttccagaagtgggctgccgttgtcgtgccaagtggtgaggaacagcgatatacctgccacgtacaacacgagggactgcccgagcctctaaccctgcgatgggaaccgtcatcccagcccactatccctatcgttggtattgtcgcaggtctcgctgtgctggctgtgttagcggtacttggtgccgttgtggccgttgtaatgtgtcggcgtaagtctagcggggggaagggcggctcttgcagccaggccgccagctcgaatagtgcccaaggttccgacgagtctctgattgcctgtaaagcatag

SEQ ID NO: 4356 - DNA, 1119 bp, Artificial Sequence
  Description of Artificial Sequence: Synthetic coding sequence
atgcgggtgatggccccccggaccctgatcctgctgctgagcggcgccttagccctgacagaaacctgggcatgctcccactccatgagatactttgatactgctgtctcccgccctggtcgaggcgaaccccgatttatctccgtgggctacgttgacgacacgcaattcgtgaggttcgactcagatgccgccagccctcggggagaaccccgggccccttgggtcgaacaggagggaccggagtattgggaccgcgaaactcagaagtataagcgacaggcgcaggccgacagggtgaaccttagaaagctgcgcggctactataatcagtctgaggacggctcccacaccctccaatggatgtatgggtgtgacttagggcctgacggcaggttgctcagagggtatgatcagagcgcctacgacggtaaagactatattgccctgaacgaagacctgaggagttggacagctgctgatacagcagcacaaattacacagagaaagtgggaagcagcccgcgaagccgaacaatggcgtgcatacctggaaggaacatgcgttgaatggctgcgccgctaccttgaaaacggcaaggaaacactgcagagggccgagcatcctaagactcatgtgacccatcaccccgtgtctgaccatgaagccaccctgaggtgctgggcactcgggttctaccccgctgaaatcactttgacttggcagcgtgatggtgaagatcagacccaagacactgagctcgtggagacccgaccagccggtgatggtacctttcagaagtgggctgccgtggtagtaccttccggagaggagcaacgctatacatgccatgtacagcacgaaggattacctgaacccctgaccctgcgttgggagccaagttcccagcccactatcccaatagtcgggatagtcgccgggttggccgtccttgcggtcttggcagtgttaggagcagtaatggctgtagtgatgtgtagacgcaagtccagcgggcacttcctccctactggaggaaagggagggtcttgtagccaagctgcctcttcgaacagcgctcagggatccgacgagagcctcatcgcctgtaaagcttag

SEQ ID NO: 4357 - DNA, 1107 bp, Artificial Sequence
  Description of Artificial Sequence: Synthetic coding sequence
atgcgggtgatggccccccggaccctgatcctgctgctgagcggcgcattagctctgaccgagacatgggcttgttcccacagcatgagatatttctacaccgcagtgtctaggcctggtagaggtgagccccgatttatcgctgtggggtacgtcgatgatactcaatttgttcagtttgactcagatgctgccagccctagaggggaaccgagagccccttgggtggaacaagaaggcccggagtattgggaccgcgaaacacagaaatacaaaaggcaggctcaaaccgaccgggttaaccttagaaaacttcgtggctactacaaccaatccgaggctggcagtcataccctgcagcgcatgtacggatgcgatcttggacccgatgggagattgctgcggggctacaatcaatttgcctatgatgggaaagattacattgccctgaacgaggatctcaggtcttggactgcagcagataaagccgcacagattacccagcgaaaatgggaagccgcacgtgaggctgagcagcgacgagcttacctggagggcacctgtgttgagtggttacggagatacctcgaaaatggaaagaagaccctgcaacgcgccgagcatcccaaaacccacgtgacccaccacccggtgtctgatcacgaggcgaccctcaggtgttgggcactgggattttatccagccgagatcacacttacctggcagcgagatggcgaagatcaaacccaggacactgaactagttgaaactaggccagcaggtgacggcaccttccaaaagtgggctgccgtggtggtgccatcaggcgaagaacaaagatacacatgccacgtccaacatgaaggcctacccgagccgctcacccttcgctggggaccatcttctcaacctacaatacccattgtcggcattgtcgccggactggcagtgctggctgttctcgccgttctgggcgctgttatggcagtggtcatgtgccgacggaagtccagtgccgcttgcgtcggcctacgttgtaggatatcttcgcacctgtcgtttgtcacctctagagccagcggaatatcgttctgcaaggggatttag

SEQ ID NO: 4358 - DNA, 675 bp, Artificial Sequence
  Description of Artificial Sequence: Synthetic coding sequence
atgcgggtgatggccccccgggccctgctgctgctgctgagcggcggtctcgctctgacggaaacttgggcctgtagccactctatgcgttattttgacaccgcggtctccaggccaggtcgtggagagcctagattcatatctgtgggctacgtggacgacacacagttcgtgcgattcgactccgacgccgccagtccccgcggcgagcctcgggccccttgggtggagcaagaggggcccgagtattgggatcgcgagacacaaaagtacaaaagacaggcgcaagccgaccgggtcagccttcggaacctgagaggctactacaaccaatccgaggatggttcccacactctccagagaatgagcggctgtgatctcggcccggacggcagactgctgcgcggctatgatcagagtgcctacgatggtaaagactatattgcgctgaacgaggatctgaggagttggacagccgccgataccgccgcccagatcacgcagagaaaactcgaagccgccagagctgccgagcagctgcgcgcatacctggagggcacatgcgtggaatggttgaggagatacctcgagaacgggaaggagaccctgcagcgagccggtcaggaccagaagtctctctttctgccccagcgcctggagctgagcaacgaatag

SEQ ID NO: 4359 - DNA, 675 bp, Artificial Sequence
  Description of Artificial Sequence: Synthetic coding sequence
atgcgggtgatggccccccggaccctgatcctgctgctgagcggcgccttggcactgaccgaaacttgggcctgctcccacagtatgcggtatttctatactgccgtgagccgccccgggcggggagaacctcgattcatcgcagtgggatacgtggatgatacacagtttgtgcagttcgactcggacgctgcttctccacggggggagccccgggccccatgggtggaacaggagggacctgagtactgggatagggaaactcagaagtataaaaggcaggcacagacagacagagtgaacctgaggaagctgagaggttactacaaccagtccgaggcgggttcacacaccctgcaacgtatgtatgggtgtgacctgggccccgacgggagacttttaagagggtataatcagttcgcatatgatggaaaggactatatagccctcaacgaggacctgcggtcttggactgccgctgataaggcggctcagattacccagcgtaagtgggaggcagctcgggaagctgagcagcggcgggcctatctggagggcacctgcgtcgaatggttacgtcggtacctcgagaacggcaagaagaccctgcaaagagccggtcaggatcagaagagtctgtttctgccccagagacttgagttatcaaacgaatag

SEQ ID NO: 4360 - DNA, 675 bp, Artificial Sequence
  Description of Artificial Sequence: Synthetic coding sequence
atgcgggtgatggccccccgggccctgctgctgctgctgagcggcggcttagcactgaccgaaacatgggcttgctcccattccatgcgatactttgatacggccgtctctcgtcctggccgaggcgagccccgcttcattagtgtcgggtacgtggatgatacccaattcgtgcgcttcgactcggatgccgctagtcctagaggcgagcctagagctccatgggtcgaacaagaggggccggaatattgggatcgggaaacccagaactacaagcgccaggcccaagccgatagggtgagtttgagaaacctgcgtgggtattacaatcagtctgaagatggctcccacacgctccagaggatgtacggctgtgatcttggcccggatggtcgattgcttaggggttacgatcagagtgcttatgacggtaaagattacatcgctctgaacgaagacctcaggtcctggactgccgctgacaccgctgctcaaattacacaaaggaagctggaagctgcccgtgccgctgagcagctccgtgcttacctggaaggaacgtgcgtggagtggctccgccgctacctggagaacggcaaggagaccctccagcgggcaggccaggaccagaagtctctcttcctgccacagcgattagagttatcgaacgaatag

SEQ ID NO: 4361 - DNA, 396 bp, Artificial Sequence
  Description of Artificial Sequence: Synthetic coding sequence
atgcgggtgatggccccccggaccctgatcctgctgctgagcggcgccctggctttgacagagacctgggcctgcagtcactcaatgaggtacttttacactgcagtgtcccgtccgggacgtggggaacctcgcttcatcgcggtaggctatgtggacgacacccagttcgtgcagttcgactccgatgcagcttcgcctagaggtgagccccgcgccccttgggttgaacaggagggacccgaatactgggatcgagagacccagaagtataagcgccaggcacagaccgaccgggtcaacctgaggaagttgagggggtattacaaccagagtgaggcggaagatgtgtggctgaggcccggcgcgaggagggctcccccaccccgcgtctag

SEQ ID NO: 4362 - DNA, 396 bp, Artificial Sequence
  Description of Artificial Sequence: Synthetic coding sequence
atgcgggtgatggccccccgggccctgctgctgctgctgagcggcggccttgctctgactgaaacttgggcctgctcccattctatgaggtactttgacactgccgtgtccagaccaggccgcggcgagccccgattcatatccgtagggtacgtcgatgacacacagttcgttcgctttgattccgacgccgccagccctcggggcgagccgagggcaccatgggtggagcaagaaggcccggagtactgggatcgagaaacccagaattacaaacgacaggcacaggccgaccgcgtctccttaagaaatcttagggggtattacaatcagtcagaagatgaggatgtctggctgaggcccggggcgcggcgggcacccccgccccgagtttag

SEQ ID NO: 4363 - DNA, 396 bp, Artificial Sequence
  Description of Artificial Sequence: Synthetic coding sequence
atgcgggtgatggccccccggaccctgatcctgctgctgagcggcgccctcgcccttacagagacttgggcgtgtagtcatagtatgcgttatttcgatacagcagttagcaggccaggacgaggggaacccagatttatcagtgtcgggtacgtcgatgatacacagtttgtgagattcgattcagacgcagcatctcctcggggcgagccacgtgccccctgggtcgaacaggaaggtccagagtattgggacagagagacccagaagtataagcgtcaggcacaggctgacagggttaatttgagaaaactccgcgggtattacaatcagtcagaagacgtggatgtttggctaaggcccggcgcaaggagagcgccccccccccgggtgtag

SEQ ID NO: 4364 - DNA, 396 bp, Artificial Sequence
  Description of Artificial Sequence: Synthetic coding sequence
atgcgggtgatggccccccggaccctgatcctgctgctgagcggcgcccttgctctgaccgagacctgggcgtgttcccatagcatgagatacttttataccgctgttagccggccaggcagaggagagcctcgcttcattgcggtcggatacgtcgacgatacccagttcgtccaatttgactctgacgcagcaagtcctcgtggggagccccgcgctccttgggtcgagcaggaagggcctgaatattgggacagagaaacgcaaaaatacaagcgacaggcacagactgaccgcgttaatctaagaaagctcagaggctattataaccaaagcgaggctgaggacgtgtggcttcgaccgggagccagacgcgctcctccacctcgggtctag

SEQ ID NO: 4365 - DNA, 396 bp, Artificial Sequence
  Description of Artificial Sequence: Synthetic coding sequence
atgcgggtgatggccccccggaccctgatcctgctgctgagcggcgcacttgctctcacagaaacgtgggcatgttctcattcgatgcgttatttctataccgccgtttcacgacccggccggggcgagccacggtttattgcggtcggatacgtggacgatacccagttcgttaggtttgactcagatgccgctagccctcggggtgagccacgagccccatgggtggaacaggagggcccggagtactgggaccgcgagacccaaaagtataaaaggcaggctcagaccgatcgggttagtttacgaaatctaagaggctactacaatcagtctgaagccgtggatgtttggctgagaccgggcgcacgccgcgcccccccacctcgggtgtag

SEQ ID NO: 4366 - DNA, 396 bp, Artificial Sequence
  Description of Artificial Sequence: Synthetic coding sequence
atgcgggtgatggccccccggaccctgatcctgctgctgagcggcgcactggcactgacagagacctgggccggaagtcacagcatgcggtacttctacaccgcggtctcccggcccggtcgaggcgagccccacttcatcgctgtgggctatgtggacgacacgcagtttgtcagattcgattctgatgctgcaagtccccgaggcgaacctagggccccgtgggtcgagcaggaagggcctgaatattgggacagggagacccagaaatataagcgccaggcccagactgatcgggtcagtctgcgaaaccttcgtggatattataaccagagcgaggctgaggacgtttggctgcgaagaggcgctcggagagccccacctcctcgggtgtag

SEQ ID NO: 4367 - DNA, 1212 bp, Artificial Sequence
  Description of Artificial Sequence: Synthetic coding sequence
atgcgggtgatggccccccgggccctgctgctgctgctgagcggcggactcgctctcacagaaacttgggcatgcgagtgtggtgtaggaagagaggcagcctccgctgagaggagcgaagggccaccaggggagccacgcagagaagtgggtcgagcgggtttgagtccttcatccccgccagggagccactccatgcgctattttgataccgctgtgagtcgacctggtcgcggggagccccggtttatttcagtggggtacgtggatgatacacagtttgtgcgctttgactctgatgctgcttctcctcgtggcgagccaagagcaccatgggtggagcaggaaggcccagaatactgggatcgcgagacacagaagtacaaacgtcaggcccaggctgatcgggtgtcgcttaggaatctgaggggttactacaaccagtcagaagatgggagccataccctccagaggatgtccgggtgtgacctgggacccgatggtcggctgctcagaggctacgaccagtctgcatacgatggaaaggactacatagcgctgaatgaagatctccgctcttggacagctgctgacaccgcagcccagattactcagcggaagctagaggccgcaagggccgctgagcagttgcgggcatatctggagggaacctgcgtagagtggttgagaagatatctggagaacggtaaagagactctgcaaagggctgaacctccaaaaactcacgtgacccaccatccgctgtccgatcacgaagcgacgttacggtgttgggccctcggcttttatcccgccgagataaccctgacctggcagcgcgacggtgaggaccagacacaagacacagagctggtggaaacacggcccgcgggagacgggacatttcagaagtgggccgccgtggtggttccatctggccaggagcaacggtacacatgtcatatgcagcatgaaggcctacaggagccgctcaccctgagctgggagccctcttcccaacccaccatacccattatggggattgtcgcgggcctcgctgtgctggtggtgctggccgttctcggcgctgtggtgactgcgatgatgtgtcgcaggaagtcaagtggtgggaaggggggttcctgctcccaagctgcttgctctaacagtgctcaagggagcgacgagtctctgatcacctgcaaggcttag

SEQ ID NO: 4368 - DNA, 1212 bp, Artificial Sequence
  Description of Artificial Sequence: Synthetic coding sequence
atgcgggtgatggccccccgggccctgctgctgctgctgagcggcgggctggccctcaccgagacctgggcctgcgagtgcggcgtgggacgggaggccgcgtccgcagaacgtagcgaggggccccctggagagccgcggcgagaagtgggcagagcaggattgtcccctagttccccgccgggtagtcactctatgagatactttgatacagccgtgagccgacctggccggggggagccacggtttatttctgttggctatgtggatgatactcagtttgtgaggttcgatagcgatgcagcatctcctagaggggagccccgggccccttgggtggagcaggaaggccctgagtattgggacagagaaacccaaaattacaagagacaggctcaagccgaccgagtatccctgcgaaatctgaggggatattacaatcagtctgaagacgggtcccacacactgcagcgcatgtacggttgcgacttgggccccgatggcagattactgagaggctacgaccagtccgcctatgacggaaaagattatatcgccttaaacgaggatctgcggtcatggacggcagcggatacggctgcccaaataacccaacgaaaactggaggcagcccgggccgccgaacagctccgcgcttacctcgagggtacgtgtgtggaatggttgaggcgctatcttgaaaacggcaaggagaccctccagagagccgaaccccccaagactcacgttacccaccacccattaagcgatcacgaggccacccttagatgttgggccctgggattttaccccgcagagattactctcacctggcagcgagatggagaggatcaaacccaggataccgaactggtggaaactcgtccagccggagacggtacattccagaaatgggccgccgtggtagtcccatctggtcaagagcagagatacacgtgccatatgcagcacgaaggcctgcaagaacctctgactctgtcatgggaaccgtccagccagcctacaatacctattatgggcatcgtggccgggctggccgtcctggttgtcctggcagtcctgggcgcagtggtgacagccatgatgtgccgccgtaaatcttcagggggtaagggaggttcctgcagccaggccgcctgtagcaactcggctcaaggctctgatgaatctctgataacatgcaaagcttag

SEQ ID NO: 4369 - DNA, 981 bp, Artificial Sequence
  Description of Artificial Sequence: Synthetic coding sequence
atgcgggtgatggccccccggaccctgatcctgctgctgagcggcgccctcgccctgactgagacatgggcctgcagccatagtatgcggtatttttacacagcagtgagtcgccccggtcggggcgaaccccggtttattgccgtgggatatgtggatgatacacagttcgttcgcttcgacagcgacgccgcatccccacgcggcgagcctcgtgccccttgggttgaacaggaaggccctgaatactgggaccgcgaaacacagaaatacaagagacaggcccaaactgatcgcgtgtcattacgaaacctgcgcggttactacaatcaatctgaagccggttcccacactctgcagtggatgtatggctgtgacctcggtcccgatggtaggctcctgaggggatatgaccagtccgcctatgacggaaaggattatattgctcttaatgaggatttacgaagctggactgcagcggatacggccgctcagatcacccaacggaaatgggaggccgcacgggctgccgagcagcagcgcgcctacctcgaaggtacttgcgtggagtggctgcgaaggtatctcgagaatggaaaagaaacacttcagagagcagaacatccaaagactcatgtaacccaccacctggtgtccgatcatgaggctactttacgttgttgggctttggggttctatccggccgagatcacactcacgtggcagagagacggcgaagatcagacacaggatactgagcttgtggagacccgccccgctggggacggcaccttccagaagtgggccgctgttgtagtgccctctggcgaggagcaacgatacacctgccacgtccagcacgaaggactgccagagccccttactcttagatgggggggcaaaggagggtcttgcagccaagcagcatcaagtaatagcgctcagggcagcgatgagtctcttatcgcttgtaaagcatag

SEQ ID NO: 4370 - DNA, 1041 bp, Artificial Sequence
  Description of Artificial Sequence: Synthetic coding sequence
atggcccggccccagcggacccccgcccggagccccgacagcatcgtggaggtgaagagcaagttcgatgccgagttccgaaggttcgcccttcctcgggcatcagtgtcagggttccaagaattttctcgcctgttacgggcagtacaccagatcccaggtcttgacgtactcctgggctacaccgacgcgcacggggacctcctgccacttacgaacgatgacagtttgcatcgagccctggcgtctgggccaccccctctgagactattggtgcagaagcgcgccgaggcagattcatccggtctggctttcgccagcaactccctgcagcgccgcaagaagggactactgctgaggccagtggcccctctacgcactcgacctccactgctaattagtcttccccaggactttaggcaagtctctagtgtgatcgatgtggacctgctcccagagactcatcgtcgcgtgcgtctgcacaagcatggctcggatcggccattgggcttttatattcgtgatggcatgtctgtaagagtggcaccgcaggggctggagcgtgtgcccggcatcttcatctccaggctggtccgaggcggattggccgagtcaacagggctgctggctgtgagcgacgagatattggaagtcaacggtatagaggtggccgggaagacactggaccaggtgactgacatgatggttgctaactcccacaacctaatcgtcaccgttaaaccagctaaccagaggaataacgtcgtacgcggcgcttcaggtcgcctgacagggccgccttcagcagggcccggccccgccgagccggattctgacgacgattcctcagatctggtgatcgagaaccgccagccaccatcctccaatgggctgtcccaaggccccccttgctgggacctgcaccccgggtgtaggcaccctggcacccgcagttccctgcctagcctcgatgaccaagaacaagcttcctctggctggggctcgcggatcaggggagatggatccgggttttctctttag

SEQ ID NO: 4371 - DNA, 1824 bp, Artificial Sequence
  Description of Artificial Sequence: Synthetic coding sequence
atgatcctgctgaccttcagcaccggccggcggctggacttcgtgcaccacagtggagtattttttctgcagacactgctgtggatcttgtgcgcaactgtctgcggtaccgagcagtacttcaatgtcgaggtctggttgcagaagtacggatatctgccccccacagatccgcgcatgagcgtacttcgatccgccgagaccatgcaaagcgcccttgcagcaatgcagcagttttatgggatcaacatgactggcaaagtcgaccgtaatacaattgattggatgaagaagccgcggtgcggggtgcccgatcagacacgcggctccagcaaattccatatcaggcgaaaacggtacgcccttaccggccagaagtggcaacataaacacataacttacagcatcaagaatgtgacccctaaagtgggagatcccgaaacacgaaaagccatccgccgggcattcgacgtctggcagaatgtgaccccactcacgtttgaagaagtgccatactcagaactggaaaacggtaagcgtgatgtggacattacaatcattttcgccagtggattccacggcgatagctcaccgtttgacggcgagggtggcttcctggctcatgcttatttccccggaccaggcatcggcggtgacacgcactttgacagcgatgagccttggacactggggaacccaaatcatgatggtaatgacttattccttgttgcggtgcacgagctgggacatgcgctgggcctggaacacagtaacgatcctaccgccattatggctccattctatcagtacatggaaacggataactttaagttgccaaacgacgacctgcagggcatccaaaaaatatatggcccacccgataaaattccacccccaacacggccactcccaactgttccacctcaccgcagtattcccccggctgatcctagaaaaaatgacagaccaaagcccccacggccacctacaggcagaccctcctaccccggcgctaaaccaaacatctgcgacgggaactttaacacgttggccatactgcgaagagaaatgtttgtattcaaagatcagtggttctggcgggtgcggaataacagagtgatggatgggtacccaatgcaaatcacttacttctggcgcgggcttcccccatccatagacgcggtttacgaaaactccgacggaaactttgtcttcttcaaaggcaataagtattgggtctttaaagataccaccctccaaccaggctaccctcacgatctgatcacattagggtcagggatcccaccacatggcatagactccgctatatggtgggaggatgtggggaagacatactttttcaagggggaccgttactggcgttactcggaggaaatgaaaacaatggatcctggctatcccaaaccaattaccgtatggaagggcattccagagagtccccagggcgcatttgtgcataaagaaaatggctttacctacttttataaaggtaaagaatattggaaattcaataatcagattttgaaggtcgaaccaggatatccacggagcattctgaaggactttatgggctgcgatggacctaccgatcgcgtgaaggagggacatagtccgccagatgacgtagatatagtgattaagctcgataacactgcttcgaccgtgaaagcaatcgctatcgtgataccttgcatccttgcactctgcttgctggtgctcgtgtatactgtttttcagttcaagcgaaaggggacacccagacatattctctattgtaagagatctatgcaagaatgggtctag

SEQ ID NO: 4372 - DNA, 1812 bp, Artificial Sequence
  Description of Artificial Sequence: Synthetic coding sequence
atgcggcggcgggccgcccggggccccggcccccccccccccggccccgggctgagcagattaccactccccctcttattgcttctggccttagggactcggggagggtgtgccgcgccagctccagctccacgagctgaagacctctccctgggcgttgaatggctgtctcgctttggatatctcccccctgctgatcccacaaccggccaactccagacacaagaggaactgagcaaagctatcacagcaatgcaacagtttggtggcctggaagctacggggattttggacgaagctacacttgccttaatgaagacccccaggtgcagcctgcccgacctgccggttctgacacaggcccgtcggcggaggcaagcacctgctccaacaaaatggaataagagaaacctgagctggcgcgtgcgcacattcccccgggatagcccattgggccacgataccgtgagagccctcatgtattatgccctgaaagtgtggtctgatatagcaccattaaacttccacgaagtggctgggagcgcagcagatatccagatcgacttttccaaggcggatcataacgatggctatcccttcgatggccctggaggtacagtggcccacgccttcttccctggacaccatcataccgctggggacacccacttcgacgacgatgaggcatggacctttaggagtagcgatgcacacgggatggatctgtttgccgtagctgtgcatgaattcggccatgcaattgggctatcccacgtggcggctgcacatagtattatgagaccctattaccaggggccagtgggagatccacttcgctatgggttgccgtacgaggacaaggttcgagtgtggcagctttacggggtccgagagtcggtatctcccactgcgcagccagaagagcctccccttcttccagaacccccagataataggtcttctgcaccaccaaggaaggatgttccgcaccgctgctcaactcatttcgatgccgtcgctcaaatacgcggcgaagcctttttctttaaggggaaatacttttggcgcctgactcgagatcgacacctggtctccctgcaacctgctcagatgcataggttctggagaggactgcctcttcatcttgatagtgtggacgcagtgtacgagcgcacatcagatcataagatcgttttctttaagggggaccgatattgggtgttcaaagacaacaatgtggaagagggctatccacgacccgtgtccgattttagcctgccacccggtggtatagacgccgctttctcttgggcccacaacgatagaacatacttttttaaggatcaactttactggcgctatgatgatcacaccaggcatatggatccaggttaccctgcacagtctcctctgtggagaggagtgccatcgacactggacgacgctatgagatggtctgatggggcctcctatttctttaggggacaggagtattggaaggtccttgacggcgagctcgaagtcgctcctggatatccccaatctacagccagagactggcttgtatgtggtgattcacaggctgatggcagcgtcgctgccggagtggacgccgccgaaggtccgcgcgccccaccagggcagcacgaccagtcccgttccgaagacggatatgaggtatgttcctgtacctccggcgcttcgtcacccccaggcgccccgggacccttggtggccgcgacaatgcttctgctgctgcctccgctttccccgggagctctctggacggccgcccaggccctaaccctgtag

SEQ ID NO: 4373 - DNA, 1560 bp, Artificial Sequence
  Description of Artificial Sequence: Synthetic coding sequence
atgcagcagttcggcggcctggaggccaccggcatcctggacgaggctactttagcgcttatgaagactccaaggtgttcattacccgatctgcctgtgttgacgcaagctaggcggagaaggcaagcacccgcccctactaaatggaataaaaggaatcttagttggcgcgtcaggactttccctcgagattcccctttgggccatgatactgttcgcgccctcatgtactacgctctgaaagtttggagtgacattgctccactaaattttcatgaggtggcaggatctgctgcagatattcagatcgacttttccaaggctgaccataacgatggctaccccttcgatggtccgggaggaaccgtggcccacgcctttttcccaggccatcaccacactgccggggacactcacttcgatgacgacgaagcgtggacctttcgttcctctgacgcgcatggtatggatctgttcgcggtagccgtccatgagtttggtcacgcaattggactctcacacgtggcggcagcgcactctatcatgcgtccttattatcagggacctgtgggggatccgctacgatacggtttaccatacgaagacaaagtccgcgtctggcagctgtacggagtgcgcgagtctgtctctcccaccgctcagcccgaagagccccccctgcttccagaacctcccgataacaggagctccgcgccccctaggaaggatgtgccccatcgctgtagtacccactttgatgccgtggcccaaattagaggcgaggcttttttcttcaaagggaagtatttttggagattgactcgagaccgccacctcgtgagtctacaaccagcccagatgcataggttctggaggggtctaccattgcatctcgattccgtcgacgccgtctatgaaaggacgtctgaccacaagatagtcttttttaagggtgaccgttactgggttttcaaggataacaacgtcgaggaaggatacccccgccccgtgagtgatttttccctgccacctggcggcatcgatgctgctttcagctgggcgcataatgatcggacctacttctttaaagaccagttgtattggcgctatgatgaccatactaggcacatggatcccggataccccgcgcagagcccactgtggcggggggtgccctcaacacttgacgatgctatgagatggtcggacggtgcttcctattttttccgcggccaggaatattggaaggttctggacggagaactggaggtcgcccctggctaccctcagagcacagcacgggactggctcgtgtgtggagacagtcaagcggacggctcagtcgccgccggcgtggatgccgccgagggtccccgcgcccctcctgggcagcacgatcagagtcgttcggaagatgggtacgaagtctgttcttgcacttctggagcatcctctcctcctggagcaccaggtcctctggtggccgccactatgcttctcctcctcccacccttgagccccggggcactctggactgctgcccaggccctcacgttatag

SEQ ID NO: 4374 - DNA, 348 bp, Artificial Sequence
  Description of Artificial Sequence: Synthetic coding sequence
atgcagcagttcggcggcctggaggccaccggcatcctggacgaggcaactttggcactaatgaaaactccacggtgtagcctgccagaccttcccgtcctgacccaagcgcgtagaaggaggcaggcacctgctccgactaaatggaacaaaaggaatctttcatggcgcgtacgtactttcccccgggattcccccttaggtcacgataccgtgcgggcgctcatgtattacgccctgaaggtctggagcgatatcgctcctttgaacttccacgaagttgctggctccgccgccgatattcagatcgattttagtaaagcagatcacaatgacggatatccatag

SEQ ID NO: 4375 - DNA, 1527 bp, Artificial Sequence
  Description of Artificial Sequence: Synthetic coding sequence
atgaactgccagcagctgtggctgggcttcctgctgcccatgaccgtgtctggcagggtacttggactcgccgaggtggcacctgtcgattatctttcgcagtacgggtacctccaaaagccgctcgagggctccaataacttcaaacccgaggatatcaccgaggcccttagagcttttcaggaggcttccgagttacccgtaagtggccaactggacgatgccacacgcgctcggatgaggcagcctaggtgcggcctggaagacccttttaatcagaagacgttgaagtaccttctcctcggtcgctggagaaagaaacatttgacctttagaattctaaatctgccatcgactctgcctccccacaccgctcgcgctgccctcagacaagcttttcaggactggtcaaacgtcgcacctttaacattccaggaagtgcaagccggcgccgccgacattagactcagcttccacggtagacaatcaagctattgctctaatacgttcgacggtcccgggcgcgtcctggcccatgcagatatcccagagctaggatccgtgcacttcgacgaagatgaattctggactgaaggaacctacagaggagtgaatctgcgaatcattgcggcacacgaggtgggccatgccctcggcctgggccactccagatactctcaggcgctgatggctcccgtttatgagggctatcgaccgcacttcaagctgcacccggatgatgtggccggcatccaagcactctacggtaaaaaaagccccgtgatcagagatgaggaggaagaggaaaccgagttaccaactgtgccacccgtgccaaccgagccttcccccatgcccgatccctgtagctccgaactggatgccatgatgctaggccctcgcggcaagacatatgcttttaaaggcgattacgtgtggactgtcagtgacagcggtcctggacctctcttcagggtcagcgctctctgggaagggctcccaggcaacctggacgccgctgtctactcgccccgcacacagtggatccattttttcaagggcgacaaggtctggagatatataaactttaagatgtcaccaggctttccaaagaagctgaaccgcgttgagcccaatctagacgccgcactatattggccccttaatcaaaaggtattcttgtttaagggatcaggttattggcagtgggatgaattagctcgaacggatttttctagttacccaaaaccaatcaaggggctttttaccggggtgcctaatcagccgagcgccgcaatgagttggcaagacggacgcgtctacttcttcaagggtaaggtgtactggagattaaaccagcagttgcgagtagaaaaagggtacccaaggaatatcagtcataattggatgcattgtcgaccaagaaccatcgacaccaccccaagcggaggcaacaccactccctccggcacaggaattacactagacaccacactctcggctactgagaccacattcgaatattag

SEQ ID NO: 4376 - DNA, 669 bp, Artificial Sequence
  Description of Artificial Sequence: Synthetic coding sequence
atgggcgtgacctgggacttcagcatgagcaacggcggcccccggggtaagacatacgccttcaagggggattacgtctggaccgtgagtgattctggcccaggccccctcttccgagtttccgccctgtgggagggactgcctggcaatttagacgccgccgtttatagtcctcgtacacagtggatccacttcttcaaaggcgataaagtctggaggtacataaatttcaaaatgagtcctggtttcccaaaaaagctgaatagggttgaacccaatcttgatgcagccctgtactggcctcttaaccaaaaagtatttctcttcaaaggtagcgggtactggcagtgggatgagttagccaggactgatttttcctcctatccaaagccaatcaaaggactattcactggggtgccaaatcaaccctcggctgcaatgtcgtggcaggacgggagggtatacttcttcaaaggaaaggtatattggcgcctcaaccagcagctgagagtcgaaaagggctatccaagaaacataagccacaattggatgcattgcaggcctcgtacaattgatacaaccccctctggagggaacaccacgccatcgggcaccggtattacgcttgataccaccctgagcgcaacagaaaccaccttcgagtactag

SEQ ID NO: 4377 - DNA, 918 bp, Artificial Sequence
  Description of Artificial Sequence: Synthetic coding sequence
atgaactgccagcagctgtggctgggcttcctgctgcccatgaccgtctcagggagagtcttggggctggctgaagtggctcctgtcgactatctgtcccagtacggctatctgcagaagcccctggagggctccaacaacttcaagcctgaagacattacagaagccctacgtgccttccaggaggcctctgaactgcccgtgtctggccaactggacgatgctaccagagcacgaatgagacagccacgatgtgggctcgaagatccgtttaatcagaagacgttgaagtatttgctcttgggccgttggagaaaaaaacatctcaccttccgcatacttaatctcccctccacgctgcctccccacaccgccagagccgccctgaggcaggcatttcaggattggtccaatgttgcccccttgacattccaggaagttcaggccggagccgccgatattaggctttccttccacggtaggcagagttcttattgctctaataccttcgacgggcctggcaagaaatctcccgttatccgcgacgaggaagaagaggaaactgaattaccaaccgttcccccagtcccaaccgaaccctcacctatgccagacccttgttcctcggaactggatgcaatgatgctgggcgaggctccgcctttgcaggccgtgggacgaaggtggggacagccagcagatcccgaagcttggaccaatggttccgacatgggactccagcacgagcagtggagggcgccctgggaggacttatgcttccagggcggattgtgtgtcgactgtattcgcttccgtactggcccactggtgccctccgtctgcccactcgggggggctccccgcaagcccgggtgctgctgcctgctggcctccaatactatggactctctgctgtag

SEQ ID NO: 4378 - DNA, 1452 bp, Artificial Sequence
  Description of Artificial Sequence: Synthetic coding sequence
atgaaggtgctgcccgccagcggcctggccgtgttcctgatcatggcactcaagttctctactgctgctccatcactggtcgcggcctctccacgcacttggcgcaataactatcgcctggcacaagcttatcttgataagtattatactaacaaagagggacatcaaatcggggagatggtggcaagggggtcaaattctatgatacgaaagattaaagagctacaagccttctttggcctgcaggtcacaggaaagctcgaccagacaacaatgaacgtgataaaaaaaccaagatgtggagtacctgatgtcgctaattaccgactcttcccaggtgaaccaaaatggaagaagaacaccctgacttacaggatcagcaaatacacaccctctatgagttccgttgaggttgacaaagctgtggagatggctctgcaggcctggtcatctgcagtgccccttagcttcgttcggatcaattccggcgaggccgacataatgatcagttttgaaaacggggatcacggggattcctatccttttgatggacctcgtggcacattggcccatgccttcgcacctggtgaggggcttgggggggacactcacttcgacaacgcggagaaatggaccatgggcactaacggatttaatttatttacggtcgctgcacacgaattcgggcatgcactggggctcgctcattccacagacccctctgcactaatgtatcctacgtataagtacaagaacccctacggatttcacttaccgaaggacgacgtcaagggaattcaggctttgtatggccctagaaaagttttcctagggaagcccacacttccccatgcaccgcaccacaagcctagcatacctgacctgtgtgattcaagttcatccttcgacgcggtcaccatgcttggcaaggaactgctgctcttcaaagataggattttctggcggcgacaggtccacctgcgcacaggaattcggccatctaccataacctcctccttcccacagttgatgtctaatgtggacgcagcctatgaagtagccgagcgcgggaccgcgtattttttcaaggggccgcactactggatcactagggggttccagatgcagggcccccctagaaccatttatgactttgggttccccagacacgtgcagcagattgacgcagccgtatacctgcgggagcctcaaaagaccctgttttttgtcggcgatgagtactattcgtacgacgaacgaaagaggaagatggagaaagactatccaaaaaatacggaagaagaattctccggagtcaacggtcagatcgatgctgccgtggagctgaatggctatatctactttttctctggtcccaagacatataagtatgacaccgaaaaggaggacgtagtgagcgtggtgaaaagctcatcatggatcgggtgctag

SEQ ID NO: 4379 - DNA, 1710 bp, Artificial Sequence
  Description of Artificial Sequence: Synthetic coding sequence
atgctggccgccagcatcttccggcccaccctgctgctgtgctggctggcggccccctggcctactcagcccgagtctctgtttcacagtagagatcgttccgatctggagccatctcccttgcgccaagctaaaccgatagctgacctgcacgccgcccagaggtttttgagcagatacggctggtccggtgtgtgggccgcatggggtcctagcccagagggccctccagagacacccaagggcgcagcccttgctgaggcggtaaggaggttccagcgcgctaacgctctgcctgctagtggtgaactggatgccgccacactggctgctatgaatcggccacgctgtggcgtcccagacatgaggcctccaccaccatctgctccaccctcacctccaggcccgcctccgcgtgctcgctcccggcgctccccaagagcccccctgagtctgtctcggcgggggtggcaaccccgcggatatcctgatggtggtgcggcacaagcattcagcaagcgaaccctctcatggcgtctgctgggggaggccctctctagccagcttagtgttgctgatcagagaagaatcgttgcgctggctttccgtatgtggtcagaagtgactcccctggatttcagggaggatctggctgcaccaggcgccgccgtcgacattaaattgggatttgggagagggcggcacttgggttgcccgagggcgttcgatggatcgggacaggagttcgcgcatgcctggagactgggggacattcactttgacgacgacgagcacttcacaccccccacctcagacactggcattagtcttcttaaagtggcagtgcacgaaatcggccatgtcctgggcctacctcatacctaccgcaccggaagcattatgcagcctaactatattcctcaggagcctgccttcgagctggattggtctgaccgaaaggccatccagaaattgtacggcagttgcgagggatcttttgacacggcattcgactggattaggaaagaacgcaaccagtatggggaggtaatggttcgcttcagcacttacttttttagaaacagctggtattggctgtacgaaaataggaacaaccgcacgagatatggtgatcccattcagatcctcaccggttggccaggtattcctacacacaatattgacgcttttgtgcatatttggacctggaagcgggacgagaggtattttttccaaggcaatcagtattggcgttatgactccgataaggaccaagcgctcacagaggacgagcagggcaaatcatacccaaagttgatctctgaggggtttcccggaatcccttctccactcgacactgccttttacgatagaaggcagaaactcatatacttttttaaggagtctctggtattcgcattcgacgtgaataggaaccgggtactcaactcctatcctaagaggataactgaggtatttcccgccgtgatccctcaaaatcaccctttcaggaatatcgattcagcctactactcttacgcgtacaacagcatttttttttttaaaggcaacgcctactggaaagtggtcaatgacaaggataaacaacaaaatagttggctgccggccaatggcctcttcccaaagaagtttattagtgaaaaatggtttgatgtgtgtgatgtccacatttccacccttaacatgtag

SEQ ID NO: 4380 - DNA, 1173 bp, Artificial Sequence
  Description of Artificial Sequence: Synthetic coding sequence
atgggccggggcgcccgggtgcccagcgaggcccccggcgccggcgtcgaaaggcgctggttaggagcagcactagttgcgctgtgtctgttacctgcattggttctgttggctcgactgggcgcacccgcggtccccgcctggtcagccgcccaaggagatgtcgccgccctcggcctctctgcagtgcctcccacccgagttcccgggccactcgctcccaggagaaggagatatacccttacccccgctcgactccggtgggatcattttaatctgacttaccgtattctcagcttccctcggaacctcctatccccccgcgaaacacgacgggctctggctgcagcatttaggatgtggtccgatgtgtctcccttctcgtttcgggaagtagctcccgaacagccgagcgacttacgaataggcttctatcccatcaaccatactgattgtctggtcagtgccctacaccactgttttgatgggccaaccggcgagctggcacatgcattcttccctcctcatggcgggattcactttgacgatagcgagtattgggttctggggcccacacgatactcttggaagaaaggcgtatggctcactgacctagtccatgtcgccgcccacgagattggccacgctctgggacttatgcacagccagcacggacgggctctaatgcatctgaacgcaacactgcgcggttggaaggccctgagccaggacgaactctggggcctgcacaggctctatggatgtctcgataggttgtttgtttgcgctagctgggcccggcggggattttgtgacgcccggagacggttgatgaaacgcttgtgtccatccagttgtgacttctgctacgaattccccttccctaccgtggctacaactcctcctccacccaggacaaagacacggctggtccccgagggacgcaatgtgacattccgatgcggacagaaaatcctccacaaaaaaggtaaagtgtattggtacaaggatcaagagccgctcgagttcagctacccaggctatttagccctgggggaagcccatctgtccatcatagcaaacgccgtgaatgagggcacttatacttgcgtcgtgcggcggcagcaaagggtccttaccacatattcgtggcgggtccgagtgcgaggttag

SEQ ID NO: 4381 - DNA, 1161 bp, Artificial Sequence
  Description of Artificial Sequence: Synthetic coding sequence
atgggccggggcgcccgggtgcccagcgaggcccccggcgccggcgtggagaggcgatggctgggcgccgctctggtggcattgtgcctccttcctgcacttgtactgcttgcacgtctgggcgcaccggcagtacccgcatggtccgccgcacagggtgatgttgctgccctgggacttagtgctgtgccaccaacacgcgtgcccggtccgcttgccccccgtcgtcgcagatacactctgacccctgccaggttgagatgggatcacttcaatctgacatatcggatactctcattcccccggaatttacttagcccacgtgagacccggcgagcactggctgcagctttcagaatgtggagcgatgttagcccattctctttccgggaggtggccccggagcagccttctgatttaagaattggaggaagaccccctccaccgagacctggccctgcccggcccgcaagccagcctagggcccctccaagactgctgccagatcaaccccacggcttaccgggtctgcgcgcggcccctctcttaaggcgcccacacgggggtgcagggcccagactccttcctccagcacgtagacaccccttaagacggcagagagtcctcggaccagggccacatgctcttcagctcgaggaaagacgggtggcccatggtccaggggcaaggggggggcctcgtgatcgacccagagctggaccagacgctctcaccacccggccaggtgcacatgctccagaacggcatgccgcaaggttggaaggggtggtgcccggccgagccgtcggagcagcacccgccctgagaatgcctcggcaggctgtgcgagtgcgcgtccttggggctgagggcctgctccggcgatcccccgccgcacacgaggaagctctcccccagcagttacggctacttctccgcatccccctaccccatggtggccaccacccaacagccccacaggatcagaatcaggctggcgctcggggccaggaaagagatctcccattgaggccagaggaccctccgcaggaaagggaaagtgttcttgtgcaggggcctggagcccctggggtgcttttgccccgcctgcccggccctggacgcggcgcccctgagcaccatagacagcgccggcaatag

SEQ ID NO: 4382 - DNA, 1293 bp, Artificial Sequence
  Description of Artificial Sequence: Synthetic coding sequence
atgggccggggcgcccgggtgcccagcgaggcccccggcgccggcgtcgaaagacgttggttaggggcagcactagtcgccctttgcctcctgcccgccttagttctgctggcacgcctcggagctcctgcggtgcccgcttggagcgctgcccagggcgacgtggccgccctcgggctctctgccgttccacccacccgagtgcctgggccgctggcacctagaagacgacgctacacccttacacccgcccggttacgctgggaccacttcaatctgacgtatagaatcctatctttccctagaaatttgttgtctccccgcgagaccagaagggccctggcggccgcattcaggatgtggagtgacgtctcgcccttctcatttcgcgaggtggctcctgaacaaccgtccgacctcagaatcggtttctatcctattaaccacactgattgtctcgttagcgctctccaccattgcttcgatggtcccacaggtgagctggctcatgcattctttcccccacacggcggtatccacttcgacgattccgagtattgggtcctcggtcccactaggtatagttggaaaaagggggaccgacccggttcctggagaccattactttgctcgactgttgggtgtagagggagagccctgggccagaccgccgggggaacatttaggggaggcggatgtcattggtctctggccggcgtgtggctgaccgacctggtccacgttgccgcccacgagattggccatgctctgggactcatgcattcccagcacgggcgagcactcatgcacctgaacgccacactcagggggtggaaagccctgagccaagatgagctctgggggctacatcggctgtacgggtgtctggacagattgtttgtttgtgcttcatgggcgagacggggattctgcgatgccagaagaaggctgatgaagcgcttgtgcccctccagctgcgacttttgctacgagttcccattccccaccgttgctacgactcctcccccacctagaacgaagaccaggctcgtgcctgaggggcgaaatgtgacgtttcggtgcggtcaaaaaattctgcacaagaagggtaaggtctactggtacaaggaccaggagccattggagttttcttatccaggctatctcgctctgggcgaagcacacctttcaataattgctaacgccgtaaatgagggcacatacacctgtgttgttagacggcagcagcgcgtgctgactacttactcttggcgcgtaagggtgcggggatag

SEQ ID NO: 4383 - DNA, 717 bp, Artificial Sequence
  Description of Artificial Sequence: Synthetic coding sequence
atgggccggggcgcccgggtgcccagcgaggcccccggcgccggcgttgagcgaaggtggctcggtgccgcactggtcgccttgtgtctacttcccgccttggttttgctggcccgtctcggagcaccagcagtacccgcgtggtcagctgcacagggggacgtagccgccctcggtctcagtgcggtaccccccacacgcgttcctggacccctcgcgcctcgcagacgacgttatacccttaccccggctcgcttgcgctgggatcatttcaacttgacctataggattctatcttttccgagaaacctccttagtccaagagaaacgcggcgagcgcttgctgctgcctttcggatgtggagcgacgtttccccattctcattccgtgaggtggcccccgaacagcctagtgatctgcgaatcggtttctatccaataaaccacacagactgcctggtgagtgctctgcatcactgctttgacgggcccactggcgagttagcccacgcgttcttccccccccacggaggcatccactttgacgacagcgaatactgggtactcggtccaactagatatagttggaaaaagggagataggcctgggtggccgccaggaggtttaagcagtgctgcgcagtgggccgctgctgtaggcttgtggggacggcgacaggaaggcccaagtggcgtggtggcagctacgggtgtgtag

SEQ ID NO: 4384 - DNA, 1938 bp, Artificial Sequence
  Description of Artificial Sequence: Synthetic coding sequence
atgccccggagccggggcggccgggccgcccccggccccccccccccccccccaccccccgggcaggctccgcgttggagtcggtggagggtgcctggccgtctgctcctgctgttactgcccgccctttgttgtctgcccggggctgcacgagcggctgctgcagccgctggtgctggcaaccgggctgccgtcgccgtcgctgtagcgcgggcagatgaggcggaggctccttttgccgggcaaaattggttaaaatcctatgggtatcttctgccctacgacagccgagcctcagcactgcactccgctaaggctctgcaaagcgccgtgagcacaatgcaacagttttatggcattcccgtgaccggggtactcgaccaaactaccattgaatggatgaagaaacctcgttgcggcgttcctgatcacccacatttatccagacgtcgaagaaacaagaggtatgccctaactggacaaaaatggcgccaaaaacacatcacctattccatacataattacacccccaaggtgggtgaactggatacccgaaaggccattcgacaggctttcgatgtgtggcagaaggttacgcctctcactttcgaggaggtgccatatcacgagatcaagtccgaccgcaaagaggctgatatcatgattttctttgcttccggtttccatggagactcgtccccgtttgatggagagggtggcttcctggctcacgcttactttccaggccctgggatcggcggtgacacacattttgatagtgacgaaccatggacacttgggaacgctaaccacgacggcaacgacctctttctggtcgcggtacacgaactggggcacgccctcggcctcgagcacagcagtgatcctagcgctattatggcccctttttaccagtacatggagactcacaacttcaagctcccccaggacgatcttcaaggaattcagaaaatatacggtccacctgccgagcctctggaacctacgagacccttgccgactttgccagtgcggcggatccactcccctagtgaaagaaaacacgagcggcagccccggcccccgaggccaccactcggtgatcgcccatccactcctggtacaaaacccaacatttgcgatggtaacttcaatacggtcgccctttttcgaggcgaaatgttcgtatttaaggaccgttggttctggcgtttgcggaataatcgggtgcaggagggatatcccatgcagatcgaacagttctggaaaggactgccagcaagaatcgacgcagcctacgaacgggccgatggtaggttcgtgtttttcaaaggggataagtattgggtgttcaaggaagtgacagtcgaaccaggttatccacattccctaggtgagctgggttcatgtctgcccagagaggggattgatacagcgctgcgctgggagcctgtgggaaagacatacttcttcaagggagagcgttactggcggtatagcgaggaaaggcgcgctactgatcccgggtatccgaagcccatcactgtttggaagggcattcctcaggcgcctcaaggggcatttatatccaaagagggatactacacttatttttacaaagggagggattactggaagttcgacaatcagaagctctccgtcgaacctggatatcctcggaacatcctgcgtgactggatgggatgtaaccagaaagaggtggagcggcgcaaagaaagaaggctaccccaggatgatgtggacatcatggtgaccattaacgacgttccaggttctgttaacgctgttgccgtggtgattccctgcattctgagcctgtgcattttggtgctcgtatacaccatatttcaatttaagaataaaacaggtccgcagccagtgacctactacaagcgccctgtgcaggagtgggtctag

SEQ ID NO: 4385 - DNA, 1782 bp, Artificial Sequence
  Description of Artificial Sequence: Synthetic coding sequence
atgccccggagccggggcggccgggccgcccccggcccccccctggccgtagccagggcagatgaggccgaggctcctttcgcaggacagaactggcttaaatcttacgggtatctccttccctacgactcgagggcttccgcactgcattcagccaaagcactgcaatccgcagtttctacaatgcagcagttttatggtattcctgtgaccggggtgctggaccagaccaccatagagtggatgaagaaacctcgatgtggagtgcctgatcacccgcacctgtccagacgacgcaggaacaaaagatacgcactgactggacagaagtggagacagaaacatattacttattctattcacaattacacccctaaggtgggagagctggatactaggaaggccatccgacaggcattcgatgtctggcaaaaagtcactccccttacatttgaggaggtcccgtaccatgagatcaagtccgatagaaaagaagccgacatcatgatcttttttgcatctgggtttcacggcgactctagcccttttgacggtgagggcggcttcttggcccatgcatattttccgggccccggaatcggaggcgatactcatttcgatagcgacgaaccctggacacttggaaacgccaaccacgacggcaacgacctgtttctggtagccgtacacgagcttggacacgcacttggactggagcatagtagtgatccatcagccattatggcaccattttaccagtatatggagactcacaacttcaagctcccacaggacgatctgcagggtatacaaaagatttacggtccccccgcagagcctctggaacctaccaggcccctaccaaccctgcccgtgagacgcattcactctccatctgagaggaagcatgagcgccagcctcgaccgccccgaccccctttgggcgacaggccgagtacacccgggacaaaaccgaatatttgcgacgggaattttaacacagtggccctgttccggggcgaaatgttcgttttcaaggacagatggttttggcgactgcggaacaacagggtacaggagggctaccccatgcagattgagcaattttggaaaggtctacccgcgagaattgatgcagcctacgagcgggctgacggtcgcttcgtattcttcaaaggagacaagtactgggtattcaaagaagtcacggtcgagcctggttatccccatagtctcggcgagctgggctcctgtctgcccagggagggtattgataccgccctgagatgggaaccggtagggaaaacttacttctttaagggtgagcgctactggcgctactctgaggaacgtcgcgcaactgaccccggctatcctaagcctattacagtctggaaggggatccctcaggccccacaaggggctttcatcagcaaggaagggtattacacgtacttctataaaggcagggactattggaaattcgacaatcaaaagttgtccgtggagccaggctatccacgcaatattctgagagactggatggggtgtaaccagaaggaagtcgaaagaaggaaggagagacgtctaccccaggacgacgtggacattatggtgacgataaacgacgtgcccggctctgtcaatgctgtggctgtggtgatcccctgcattttgagcctttgtatactcgtcctcgtgtacacaatatttcaattcaaaaacaaaaccggcccacaaccagtgacatactataagcgacctgtccaggagtgggtttag

SEQ ID NO: 4386 - DNA, 561 bp, Artificial Sequence
  Description of Artificial Sequence: Synthetic coding sequence
atgagccccgccgaccccggcaccgtggccaccatgcggaagccccggtgctccttgcccgacgtgctaggcgtggccgggctggtgcgacgcaggagacgctacgcactatccggaagcgtgtggaagaagcgcactctcacttggagagtcagatccttccctcagtcatcacaactcagccaggaaactgtgcgtgtgttaatgagctacgccttaatggcctgggggatggagtccgggctgacatttcacgaagtcgattccccccagggccaagaaccggacattttgattgacttcgccagggcgtttcaccaggactcctacccttttgacggtctcggtggaacccttgctcacgctttttttcccggcgagcatccgatttctggggacacacatttcgatgacgaggagacatggacatttggctccaaagcctcccagcagctggaacaggagctcgctggcggttctccggttgacgaggaattgggcttctctcgcgggtggcgggtcaacccattaggtcccggcagtcctgagaggctttcatag

SEQ ID NO: 4387 - DNA, 1689 bp, Artificial Sequence
  Description of Artificial Sequence: Synthetic coding sequence
atgcggctgcggctgcggctgctggccctgctgctgctgctgctggctcctcccgcccgcgccccaaagcctagcgctcaggacgtctcgctgggggtagactggctcacaaggtacgggtacttaccaccccctcaccccgcgcaggcacagttacagtcccctgagaagctccgagacgccataaaggtcatgcagagattcgctggtctgccagagacgggccgaatggaccccggcacagttgctactatgcggaaacccaggtgctccctgcccgacgttctgggcgtggctggacttgtgcggaggcgcaggcggtatgccttgtctggatcagtctggaagaaacggacactgacctggagagtgaggagctttccccagagcagtcaactcagccaggagactgtgcgagtgctgatgtcgtacgcactgatggcttgggggatggagagtggtttaacattccacgaggtggactccccccaaggacaggaaccggatatccttatcgatttcgccagggcttttcatcaagacagttaccccttcgacggtctcggaggcaccttggcccacgccttttttcctggagaacacccaatttccggcgacacacacttcgacgacgaagaaacatggaccttcggctccaaagatggcgaggggacggacctgttcgccgtcgcagtccatgagtttggccacgcattgggcctaggacactcaagcgcaccaaactcaatcatgaggcctttctaccagggccctgtgggggaccccgacaagtaccgcctgtcccaggacgaccgggacgggttgcagcagctctacggtaaagccccccagactccttacgacaaacccaccagaaagcccttggcaccaccacctcaaccaccggcgagccctactcacagcccaagctttcccatccccgatcgatgcgaaggtaacttcgatgcaatcgcgaatatacggggcgagacctttttcttcaaggggccatggttctggcggctacagccttccgggcaactagttagtcctaggcctgccagacttcaccgattctgggagggccttcctgcccaagtaagagtggtgcaggctgcgtacgctcgacatagagacgggagaatactgctgttttcggggcctcagttttgggtgttccaggatcggcagctggaaggcggcgcacggcccctgactgagctggggctgccccccggggaagaagtcgacgccgtgttttcttggccccagaacggtaagacctacctcgtaagggggcgtcagtactggaggtacgacgaggcggccgcccggccagaccctggatatcctcgggacctttctctgtgggaaggggctccccctagccccgacgacgttacagtgagcaacgcaggagatacgtatttctttaaaggggcacactattggcggtttcctaagaattccataaaaactgagcctgacgccccacagccgatggggccgaattggctggactgtccagccccctctagcggcccacgggctccaaggccccccaaagccactccagtgagtgaaacctgtgactgccagtgcgagttaaaccaagccgcagggaggtggcccgcccccatccccctcctcctcctgcctctccttgttggcggagtggccagtaggtag

SEQ ID NO: 4388 - DNA, 786 bp, Artificial Sequence
  Description of Artificial Sequence: Synthetic coding sequence
atgcagctggtgatcctgcgggtgaccatcttcctgccctggtgctttgcggtgcctgtaccacccgcagccgaccataagggctgggactttgtcgaaggatatttccatcagttttttttgactaagaaagagagtcccttactgacacaagaaacccagactcagctgcttcagcagtttcacaggaacggtaccgaccttttggatatgcagatgcacgccctgttacatcagccacattgcggcgttcctgacggaagcgacactagtatctctccaggaaggtgcaaatggaacaagcataccctgacataccgaattattaactatccccatgacatgaaaccaagtgccgtcaaagatagcatctacaacgcagtgagcatctggtctaatgtgacaccgcttatcttccagcaggttcagaacggcgatgccgatattaaggtttccttctggcagtgggcccatgaagacggctggccttttgatgggcctggcggaatcctgggccacgcttttttacccaattccgggaacccaggcgtcgtacacttcgataagaatgaacattggagcgcctccgacactggctataatctgtttctggtcgcaactcacgaaattgggcatagcttgggtcttcaacactccggcaatcagtctagcatcatgtatccaacctactggtaccacgatccccgcactttccaattatcagctgacgatatacagcggattcagcacctttacggggagaagtgcagctcagacattccgtag

SEQ ID NO: 4389 - DNA, 786 bp, Artificial Sequence
  Description of Artificial Sequence: Synthetic coding sequence
atgcagctggtgatcctgcgggtgaccatcttcctgccctggtgctttgccgtgccagtcccgcctgcagcggaccacaagggttgggactttgtcgaagggtattttcatcagttcttcctgaccaagaaggagtcaccactgctcacccaggagacacagactcagttgctgcagcagttccaccgaaatggcacagatctcctggacatgcagatgcacgctctcctgcaccagccccattgcggagtcccagatggtagtgacacatctataagccccggtagatgtaaatggaacaaacatactctgacttacaggataataaattacccacacgatatgaaacccagcgccgttaaggactcgatctataacgcagtgagcatctggtcaaacgtaactcccttgattttccagcaagtccaaaacggcgatgcagacatcaaggtatccttttggcagtgggctcatgaagatggttggcccttcgatggccccgggggcattctcggacacgcgttcctgccgaacagcggcaatccaggcgtggtccattttgataaaaacgaacactggagcgcctcagataccggctacaatcttttcctggtggccacccacgagatcggacactctctagggttgcagcactcaggcaaccagtccagcataatgtatccaacatattggtaccatgatccacgcacctttcaactgtctgcagacgacattcagcggatccaacatctgtatggggagaagtgctctagtgatatcccttag

SEQ ID NO: 4390 - DNA, 1542 bp, Artificial Sequence
  Description of Artificial Sequence: Synthetic coding sequence
atgaagcggctgctgctgctgttcctgttcttcatcaccttcagctccgccttccctctggtacgtatgactgaaaatgaggagaatatgcagctggctcaggcttatctgaatcagttctatagtctggagattgagggcaaccatttggttcaatccaaaaacaggtctctcatcgatgacaagatccgcgagatgcaggctttcttcggactcactgtcactggaaagctggactccaatacacttgagattatgaagacacctagatgtggcgtcccggatgtaggacagtacggctacaccctgccaggatggcggaaatacaatttgacgtacaggattattaactataccccggacatggctcgggctgctgtggacgaagctatccaggagggcctggaggtttggtcgaaagtaaccccccttaagtttaccaagataagtaaaggtattgccgacatcatgattgcctttcgcactcgagtccacgggcgttgccctcgctatttcgatggtcccctgggtgtgcttggacacgcatttcccccaggacccgggcttggcggggacacacatttcgatgaagacgagaactggaccaaggacggagctggctttaacctgtttctagtcgccgctcacgagttcggacatgctctggggttgtcacacagtaatgatcagactgctttaatgtttcctaattacgtgtctttggacccccggaagtatcccttaagtcaggatgatatcaacggtattcagtcaatttacggcggtctccctaaggagcccgctaagccaaaggagcctactatcccccacgcctgcgatcccgacctaacatttgacgccataactacctttcgaagggaggtgatgttcttcaaagggcgtcatctctggaggatctattacgacataaccgacgtggagtttgagttgattgcatctttctggccaagcctccccgcagacttgcaggcagcctatgagaatcccagggataagatcttggtgttcaaggacgaaaacttctggatgattcgggggtacgctgtgttgcctgactatccaaaatctattcacacactgggattccccggtcgagtcaagaagattgatgcagcagtctgtgacaaaaccaccagaaagacttatttcttcgttggcatttggtgttggcggttcgacgaaatgacccaaaccatggataagggattcccccagcgggtggtgaaacattttcctggaattagtatcagggtcgatgcagctttccagtacaagggattcttcttttttagtcggggctcaaagcagttcgaatatgatatcaagaccaaaaacattacgcgcatcatgaggacgaatacgtggttccagtgcaaggaacccaaaaacagcagcttcggcttcgacataaacaaagaaaaagcacactctggagggatcaagattctgtaccacaagtcactgtctctcttcatttttgggattgtgcacctgctgaaaaacacttctatctaccaatag

SEQ ID NO: 4391 - DNA, 393 bp, Artificial Sequence
  Description of Artificial Sequence: Synthetic coding sequence
atggtggcccgggtgggcctgctgctgcgggccctgcagctgctgctctggggccatttggacgcacaacctgccgagagagggggacaggagttgaggaaggaagccgaggcttttttggaaaagtatgggtacctgaacgagcaagtgcctaaggcccccacttccacacggtttagtgacgccatccgtgccttccagtgggtgtcacagctgccagtttccggcgttcttgatagggcaactttaaggcaaatgacccgccctcgctgcggcgtaaccgacacaaacagctatgctgcatgggctgagagaatctcagatctcttcgcccggcacaggactaagatgcgaagaaagaagaggttcgccaagcaaggagaacactgctag

SEQ ID NO: 4392 - DNA, 1560 bp, Artificial Sequence
  Description of Artificial Sequence: Synthetic coding sequence
atggtggcccgggtgggcctgctgctgcgggccctgcagctgctgctctgggggcatctagatgctcagccagcggagagaggaggccaagaacttcgtaaagaggccgaagccttcctcgagaagtatgggtatctgaacgaacaggttcccaaggcacctacaagcacacgattttctgatgccattagagcgttccaatgggtctcccagctgcccgtgtctggcgtcctagatcgtgcgacactgagacagatgacacgtccaagatgcggagtgactgataccaacagctacgctgcctgggccgagaggatctctgacctttttgcaagacaccgaacaaagatgcgaaggaagaaaaggtttgcaaagcagggcaataagtggtacaaacagcacctgagttatcgtctcgtgaactggcctgagcaccccgagccagccgttaggggcgccgtcagagctgcctttcaactttggtccaacgttagtgctctggaattttgggaggcacccgccaccggcccagctgatatccgactgacgttctttcagggtgaccacaatgatggactaggcaacgcttttgatgggcctggaggcgccctggcccacgcatttctaccccggcggggcgaagcccatttcgatcaagacgagaggtggtctctttctcgcaggagagggaggaatttattcgtcgtactggcacacgaaattggacatacacttggcctgactcactcgcctgctcctagagctttaatggcaccttactacaagaggttaggcagggacgcactgctgtcctgggacgatgtgttggccgtacagagcttgtacggaaaaccacttggcggatccgttgctgttcagcttccagggaaattgtttacggactttgagacgtgggattcttatagtcctcaggggcggcgcccagagacccagggtccaaaatattgtcactcgtcttttgacgccattaccgtggaccggcagcaacagttatacattttcaagggaagccacttctgggaggtcgccgcagacggaaatgtctcagaaccacggccgctgcaggagagatgggtgggcctaccccccaatattgaagccgccgctgtctcgttaaatgacggggatttctactttttcaagggcggccgttgttggagattccggggccctaaacctgtatgggggttgccacagctgtgccgggccgggggactgcccaggcacccagatgccgccctcttttttcctcccctgagacgcctgatcctgttcaaaggggcgcgatactatgttctggccagggggggactgcaggttgaaccttactaccccagaagcctccaggactggggcggcataccagaggaagtgtctggggccttacctaggcctgatgggtctatcatcttcttcagagatgacagatactggagactggaccaggcaaaacttcaagccacaaccagtggcagatgggctacagagctgccgtggatggggtgctggcatgcaaactctggctcggccctgttctag

SEQ ID NO: 4393 - DNA, 1179 bp, Artificial Sequence
  Description of Artificial Sequence: Synthetic coding sequence
atggtggcccgggtgggcctgctgctgcgggccctgcagctgctgttatgggggcacctggatgcccaacccgctgaaagggggggccaagagctgagaaaggaggccgaagcatttctggaaaagtacggctacctgaatgagcaggtccccaaggctccgacttctactcgctttagcgacgcgatacgcgccttccagtgggtatctcagcttccagtgtccggtgtactggatcgggccacactgcggcaaatgacccgaccccggtgcggagtaacggacacaaacagttacgctgcctgggctgagcggatttccgacctgtttgctagacatagaaccaagatgcggcggaaaaagcgctttgccaagcagggcaacaagtggtacaaacagcatctctcctatcgtttggttaattggcctgagcatccagagcccgccgtgcggggggccgttcgcgctgcatttcagctctggagcaacgtgtcggcactggaattctgggaggccccagccactggccccgccgacatcaggcttactttcttccagggtgatcataatgacggtctcggcaacgccttcgacggaccgggcggagcgcttgcacatgcctttctgccaagacgcggggaggcccactttgatcaagatgaacgttggagcctgtcaaggcgaagggggcgaaaccttttcgtggtgcttgcccacgaaatcggccatactctgggcctcacccatagccccgcaccgagggccctgatggcgccgtactataagcggctaggccgcgacgctctgctgtcctgggatgatgtgctcgccgtgcagagcctgtacggaaaacccctcggagggtctgtggctgtgcagcttccgggcaaactgtttactgattttgagacatgggacagctacagcccacagggccgcagacctgaaacacaaggacccaagtactgccattcatcatttgatgctataacagtggacaggcagcagcaactctacatttttaaggggagccatttttgggaggttgctgccgatggcaacgtatcagagccgagacccctgcaggaaaggtgggtcggactgccgccgaatatcgaagcagcagccgtatctttgaacgacggtgacttctatttttttaaagtccagagcgtctag

SEQ ID NO: 4394 - DNA, 678 bp, Artificial Sequence
  Description of Artificial Sequence: Synthetic coding sequence
atggtggcccgggtgggcctgctgctgcgggccctgcagctgctgctctggggccatctggacgcccagccagcagagcggggcggccaggaactgcgcaaggaggccgaagcattcctggagaaatacggatatttgaacgagcaggtgccaaaagccccgacttcaactaggttttcagatgcaattagggcctttcagtgggtgagccagcttccggtttcgggtgtgctggatcgtgctaccctgcggcagatgactcgaccgcggtgcggcgtgacggatacaaacagctatgctgcctgggctgaaagaatcagcgatctgttcgctaggcaccggactaagatgcgtcggaagaaacggttcgccaaacaagggaacaagtggtacaaacagcacctgagctataggctggtgaactggccagagcacctgcggtctcgccagttcggggcgccatgtgcccccccgagcagttgtggcgccaccagtcaaagatggtcctccggccgaccacagccccaagccccgctcacttctggatcgccttcctccaaggggaccacaacaatgggatgggcgatgcctctgatggcgcagggagccccctggagaacaccctcgtgccccgccgcggccaagaggacatccacaaaaatgagtgccggaccgtag

SEQ ID NO: 4395 - DNA, 1404 bp, Artificial Sequence
  Description of Artificial Sequence: Synthetic coding sequence
atgttcagcctgaagaccctgcccttcctgctgctgctgcacgtgcagatatccaaggcttttcctgtgagctcaaaggagaaaaacacaaaaacggtgcaagactacctggagaagttctaccagctcccaagcaaccagtaccagagcacacggaagaatgggacgaacgtgattgttgaaaagctcaaagaaatgcagagattttttggactcaacgtgactggaaaacccaatgaagaaacattggacatgatgaagaagcctagatgcggcgttcccgacagcgggggatttatgttgacccctggcaatcctaaatgggagagaacaaatctgacctatagaattcgaaattatactcctcagttgtcagaggctgaggtcgagcgtgctatcaaagacgcattcgaactctggtcggtggcctctcccctgatatttactcggatatctcaaggggaagccgacataaatattgccttttaccagagagatcacggagacaacagcccattcgatgggccaaatggtatcctggcccatgccttccagcctgggcagggaatcggtggggatgcccacttcgacgccgaggagacttggactaacacctctgccaattacaatctgtttctagtggccgctcatgagttcggccactcattaggcctggcccactccagtgacccaggtgctttgatgtatcccaattatgcctttcgcgagacctcaaattacagccttccacaggacgacatagacggaattcaagccatatatggcctctcctccaatcccattcagccgactggcccctcaactccaaagccatgcgatccctccttaaccttcgacgcgataaccacccttcggggtgaaattctgttctttaaagataggtatttctggcggcgacacccccagctccaacgcgtggagatgaacttcatatctcttttctggccaagcttgccgactggaattcaggctgcgtacgaagatttcgacagagacttaattttcctttttaaggggaaccaatattgggccctgagcggatatgatatactgcagggctacccaaaggatatttctaactacggctttccaagtagtgtgcaggctatagatgccgccgtgttttatcgttctaagacatactttttcgttaacgaccagttttggcggtacgacaatcagagacagttcatggagcccggatatccaaagtccataagcggagccttccctggcatcgagtctaaggttgatgccgtgtttcaacaggaacactttttccatgttttcagcggaccgcggtactatgcttttgatctaattgcccaaagagtgacacgagtggccagggggaacaaatggttaaactgtagatatggctag

SEQ ID NO: 4396 - DNA, 918 bp, Artificial Sequence
  Description of Artificial Sequence: Synthetic coding sequence
atgcagcggttcttcggcctgaacgtgaccggcaagcccaacgaggagactttggatatgatgaaaaagcctagatgcggtgtgcctgattctggggggtttatgctgacgcccggcaatccaaagtgggagcggacaaacctgacataccgaatcagaaactacactccgcaattaagcgaagctgaagtagaaagagctattaaagatgcctttgagttgtggagtgttgctagtcccttaatctttacaaggattagccaaggagaggcagacattaatatcgcattctaccagcgagaccacggagataacagtccattcgacggaccaaatgggatcctcgcacacgcgtttcaacctgggcaagggattggtggggacgctcatttcgacgctgaagagacatggacgaacactagtgcaaattacaacctttttttagttgcagcacacgagtttggccacagcttggggctcgctcactcctcagacccaggcgcgcttatgtaccccaactacgcatttcgggagacgtcgaattactctttgccacaggacgatatcgacgggatccaggctatatacggccttagttccaatcccatccagccaactggaccctctacacctaaaccttgcgaccccagcctcacctttgacgccattactacactcagaggggaaatccttttctttaaggatcgttacttctggaggcgacacccccagctgcagagagtagagatgaactttatctctctgttttggccgtctctcccgacaggcatccaagcagcttacgaagactttgacagagatctcatctttctttttaaagatatgatcaccaaagacaacagttggtctcaggttatcccgaaggcttatcaggtcccctttcgcaacagagagtag

SEQ ID NO: 4397 - DNA, 1284 bp, Artificial Sequence
  Description of Artificial Sequence: Synthetic coding sequence
atgcagcagatcccccaggagaagagcatcaacgactacctggagaagttttatcagcttcctagcaaccagtaccaaagcaccagaaaaaacggcaccaatgtgattgttgagaaacttaaagagatgcagcgattcttcgggctgaacgtgaccgggaaacccaacgaagagacgctcgacatgatgaagaagccacgctgtggcgtgcccgattcaggaggttttatgctcactcccggtaatcccaaatgggaacgtaccaaccttacgtatcgaatccgtaattacaccccacaactttcagaggcagaggtggagcgggccattaaggatgcctttgaactctggtccgtggctagccctctgatctttactcgcattagccagggagaggctgacatcaacatcgccttttaccagcgcgaccatggcgacaactccccctttgacggccccaacggcatactcgcccacgcattccagcccggtcaggggattggaggtgacgctcactttgatgcggaggagacttggacaaatacgtctgcgaactacaacctgttcttggtagctgcccacgagttcggtcacagcctgggattggcccacagcagcgatcccggtgcactaatgtatccgaactacgccttcagggaaacatccaactacagtttaccccaggacgatatcgacggaatccaggccatctacggcctcagttcgaaccctattcaacccactgggccctcaacgcctaagccgtgcgacccatccctcacatttgacgctattaccactcttagaggtgaaattctgttttttaaggacagatacttctggaggagacatcctcagctgcagcgtgttgaaatgaactttatcagcttgttttggccatctctcccaactggtattcaggccgcctatgaggatttcgaccgcgacctcatctttctgtttaagggcaatcagtactgggccctgtccggatatgacatcctgcagggttacccaaaggatattagtaattacggctttccaagctcagttcaggctatcgacgcagcagtcttttacagatctaagacctacttcttcgtgaatgatcagttttggagatatgacaaccaacgacagtttatggagccagggtatcctaaatccatttctggggcttttcctggcattgaatctaaggtggatgctgtgtttcagcaggagcactttttccacgtgttcagtggccctcgctattatgccttcgacctgatcgcccaatag

SEQ ID NO: 4398 - DNA, 954 bp, Artificial Sequence
  Description of Artificial Sequence: Synthetic coding sequence
atggccgtgcagggcagccagcggcggctgctgggcagcctgaactctacaccaactgccatcccacagcttggattggctgcgaatcaaacaggggcccggtgcctggaggtttctatctccgatggattattcttatcacttggactggtgtcgctggtggagaacgcactggtggtcgcgacaattgctaagaatcgcaatttgcattcccccatgtactgtttcatctgttgcctggccctgagtgacttgcttgtcagtgggtcgaatgttttggagacagccgtcatcctactcctggaagccggagcactggtcgctagagccgccgtgcttcagcaactggacaacgttatcgatgtgatcacttgctcgtctatgttgtcaagtctgtgcttcctaggagccatcgccgttgataggtatatttcaatcttctacgcgctgagataccactccatcgttaccctgcctcgcgcccggcgtgccgttgctgccatttgggtggccagcgtggttttttcaaccctcttcatcgcttactatgatcatgtggccgtcctgttgtgcttagttgtgttctttttagccatgctggtcctgatggccgtcctttacgtccacatgttggccagagcctgtcagcatgctcaaggtatcgcccgccttcataaacgacagcggcccgtgcaccaaggcttcggccttaaaggagccgtgacactgaccatattacttggtatcttttttctatgttgggggccattcttcctgcacctgaccctgattgttctgtgccccgaacaccccacttgcggctgtatcttcaagaatttcaacctctttctggcactgattatttgtaacgctatcatcgatcctcttatctacgctttccactcacaagaactccggaggactctgaaagaggtcctcacctgctcttggtag

SEQ ID NO: 4399 - DNA, 894 bp, Artificial Sequence
  Description of Artificial Sequence: Synthetic coding sequence
atgaagcacatcatcaacagctacgagaacatcaacaacaccgccaggaataacagtgactgccctagagtagtattgccagaggagatctttttcaccatatccatcgtcggtgttcttgagaacctgattgtcctcttggctgtgttcaagaataagaacctgcaggctcctatgtacttttttatttgttcacttgcgatttccgacatgttgggaagcctatacaagatcctagaaaacattcttatcatactccgtaatatggggtatcttaagccaagaggaagttttgagaccaccgccgacgacataattgattctcttttcgtcctgagtctgttggggtccatcttcagtctcagcgtgattgcagctgacaggtacatcacgatttttcacgctctgcgataccattcaatcgtcacgatgaggagaaccgtggtggtgctgaccgtcatttggacattttgcaccgggacaggcataaccatggtgatcttttcccatcacgtgccaactgtgatcacctttaccagcttatttcccctaatgctggtgttcatcctatgcttatacgtgcacatgtttctccttgctcgttcccacaccaggaagataagcacattgcccagggctaatatgaaaggcgctattaccttaacgatcctgctgggcgtattcatcttttgttgggcgccattcgtgttacatgtgttgctgatgaccttctgccctagcaatccttattgcgcctgctacatgagtctgttccaggtgaatggaatgttgattatgtgcaacgcggtaatagaccctttcatatacgcgttcagatcaccggaattgagagatgctttcaagaagatgattttttgcagccgctactggtag

SEQ ID NO: 4400 - DNA, 894 bp, Artificial Sequence
  Description of Artificial Sequence: Synthetic coding sequence
atgaagcacatcatcaacagctacgagaacatcaacaacaccgcccgcaacaacagcgattgtccccgcgttgtgcttcctgaggagatcttctttaccatctctatcgttggcgttttagagaatcttatcgtcctgctcgccgtgtttaaaaacaaaaatctgcaagccccaatgtatttttttatttgttctcttgctatctcagacatgctgggaagcctttacaagatcttagagaatattcttatcatccttcgaaatatggggtacctgaaaccacgggggtcctttgagacaaccgccgatgacataatcgactcactgttcgttctgtcactgctgggtagcattttctctctatcggtcattgcagctgaccgctacataactatctttcacgcattacgctatcatagcattgtcactatgagacggactgtggtggtcttgacagtcatctggaccttctgcaccgggacaggcatcaccatggtgatcttctcccaccacgtgcctacagtgatcactttcacaagcctctttcccctgatgctcgtcttcatcttgtgcctatatgtccacatgtttctgctcgccagatcacacacaaggaaaatctctactctccctagggctaatatgaagggagcgataaccctgaccatccttctgggggtgttcatcttttgctgggcaccttttgtgctgcatgtgctgctgatgactttttgcccttccaatccttactgcgcatgctatatgtcactttttcaggtgaacggcatgctgattatgtgcaacgcagtgattgaccctttcatctacgcctttaggtctcctgagctgcgcgatgcctttaagaagatgatattttgttcacggtactggtag

SEQ ID NO: 4401 - DNA, 972 bp, Artificial Sequence
  Description of Artificial Sequence: Synthetic coding sequence
atgaacgccagctgctgcctgcccagcgtgcagcccaccctgcccaatgggagcgaacacctgcaggccccctttttctcaaatcagagtagcagtgctttctgcgagcaggtattcatcaaaccagaggtgtttctatcactgggcattgtgagcctgcttgaaaacatcctggtaatcctcgccgtcgttaggaacggaaacctccattccccaatgtacttctttctgtgctctcttgctgtcgccgacatgctagtgtccgtttcgaacgcattagaaactatcatgatcgcaattgtccatagtgattacttaacttttgaggaccagtttattcaacacatggataacatctttgacagcatgatctgcattagcttggtggcgtccatatgtaacctcctggctatcgctgtggaccgatacgtgaccatattctacgccctgcgatatcatagcatcatgactgtgcgaaaagcactgacactgattgtggctatttgggtctgttgcggagtatgtggggtcgtcttcatagtatatagtgagagtaagatggtcattgtctgtctgatcactatgttcttcgccatgatgctgcttatgggtaccctctatgtgcacatgtttctgttcgcccgacttcatgtcaaacggattgcggcactgccacccgccgacggggtcgcccctcaacagcacagctgcatgaagggcgccgtcactattactatcctgctcggggtatttattttctgttgggctcctttcttcctccatctagttctgattatcacctgtcccactaatccctattgtatctgttatacagcacacttcaacacgtacctcgtgctgatcatgtgtaactcagtgattgatccgctgatctacgccttcaggagcctggaactgcgaaatactttccgagagatcctgtgtggctgcaacgggatgaatctcggctag

SEQ ID NO: 4402 - DNA, 999 bp, Artificial Sequence
  Description of Artificial Sequence: Synthetic coding sequence
atggtgaacagcacccaccggggcatgcacaccagcctgcacctgtggaatagatcatcctatagactccatagtaatgcaagtgagtctctcggcaagggatattctgatggaggatgttacgagcagctctttgtttcgcccgaagtatttgtgactctgggcgttatttcactgcttgaaaacattcttgtcatcgtggccatagctaaaaataagaacctacacagccctatgtatttctttatctgttctctagcagtcgctgatatgcttgtcagtgtgtccaatggctccgaaaccatcgtcataacactgcttaactcgacagacacagacgcccaatcatttacagtcaatatagataatgtaatcgactcagtgatctgttcttccctgctggcaagcatctgctcacttttatctatagcagtggacaggtacttcactatattttacgcgttacagtaccataatatcatgacagtgaaaagggttggaatcatcatttcttgtatatgggccgcctgcacagttagtggcattctgtttataatatactcagattccagcgccgtgatcatctgcctaataactatgttcttcacgatgcttgcacttatggcctcactctatgtgcatatgtttttaatggcacgcctgcatattaaaaggatcgcagtcctgccggggacaggggccatcagacagggcgctaatatgaaaggagcaatcaccctgacgatactcattggggttttcgtggtgtgctgggccccttttttcctgcacctgatcttctatatttcctgcccacagaatccatattgcgtgtgcttcatgagtcactttaatttatatctcatcctcattatgtgtaatagtattatcgacccccttatttatgctctccgctcccaggaacttaggaagactttcaaggaaatcatatgctgctaccctttggggggcctctgtgacttgtcctcgcgttattag

SEQ ID NO: 4403 - DNA, 978 bp, Artificial Sequence
  Description of Artificial Sequence: Synthetic coding sequence
atgaacagcagcttccacctgcacttcctggacctgaacctgaacgctaccgagggaaatctgagcggccccaacgtaaagaacaagtcttctccttgtgaggatatggggatagctgtggaggtgtttctgaccctgggagtcatttccttactcgagaacatccttgttattggggccatcgtgaagaacaagaacctccactcccctatgtactttttcgtgtgcagccttgcggtcgctgatatgttggtgagcatgtcaagtgcatgggaaacgattactatttacctcctgaacaataagcatctggtgatcgcggatgcttttgtcaggcacatcgataatgtgtttgactctatgatctgcatttcagtagtggcgtccatgtgcagcctgctggccattgcagtggacagatacgtcacaattttttacgctctgcgatatcatcatattatgactgcgcggaggagtggcgccatcatcgccgggatttgggccttttgcaccggctgtggtatcgtcttcatcctgtacagcgagagcacctatgtcattctctgtctgatttccatgttctttgcgatgctcttcctgctcgtatctttgtatatacatatgttcctgctggcccgcacacacgtaaaaagaatcgccgcgttgcctggcgcaagctcagctagacagcgcacatccatgcagggtgcagttaccgtgacgatgctgctcggcgtgttcacagtttgctgggcccctttttttctccatttaacactgatgctgagctgcccccagaacctgtactgcagcaggtttatgagtcacttcaacatgtacctgattctgatcatgtgtaattcagtgatggatccactgatctacgccttcagaagccaggaaatgcgcaagacatttaaggaaattatttgctgtcgcggattcagaatagcttgtagctttcctaggagagactag

SEQ ID NO: 4404 - DNA, 1242 bp, Artificial Sequence
  Description of Artificial Sequence: Synthetic coding sequence
atgctggagatgctggagtacaaccactaccaggtgcagacccacttggagaatccaacaaagtatcacattcagcaggcccagcgccaacaagtgaagcagtacctgagtactactctagcaaataaacatgccaatcaggtcctaagcttgccctgtccaaatcagcccggtgaccacgtcatgcctcccgtgccagggagtagtgcacctaatagtccaatggccatgctgacgctcaactccaattgtgaaaaggaggggttctacaaatttgaggaacagaatcgagctgaaagcgagtgcccaggaatgaatacccactccagggcgagttgtatgcagatggatgacgtgatagacgacattatatcactggagtcctcctacaacgaagaaatacttggcttgatggatccggcactgcagatggctaacacattgcccgtctctgggaatctaattgacctatatggaaatcagggcctgccaccaccaggcctgaccatatccaattcctgcccggcaaatctgccaaatatcaaaagagagcttacagaatccgaggctcgagcgctggccaaggaacgccagaagaaagataaccataaccttatcgagagacgccgacgctttaatatcaacgacagaataaaggagctgggcacgctgatccccaagtctaacgacccagacatgaggtggaacaagggtaccatactgaaagcgtccgtagattatatcagaaagttgcagcgggaacagcaaagggcaaaagagttggagaatcggcagaagaagctagaacatgctaaccgccatctgctacttcgtatccaggagttagaaatgcaggcaagggctcacggcctctccttgattccttctacaggattatgctctcctgatctggttaaccggattattaagcaggagcccgttctggaaaattgcagccaagacttactgcagcaccacgccgacttgacatgcacaacaacccttgacttgactgatgggactattactttcaataacaacctgggcaccggaactgaggcgaaccaagcgtactcggtgccaactaagatgggatccaaactggaggatattttgatggacgacacacttagcccagtcggggtaacagaccccctgctgtcaagtgtgtctccaggagcaagcaaaacctctagcagacgctcctcaatgtcgatggaagaaactgagcatacatgttag

SEQ ID NO: 4405 - DNA, 1515 bp, Artificial Sequence
  Description of Artificial Sequence: Synthetic coding sequence
atggaggccctgcgggtgcagatgttcatgccctgcagcttcgagtctctctacctatcgtctgcagaacatccaggcgcctccaagcccccaatcagtagctcttcgatgacatctaggatcttactcagacagcagcttatgcgcgaacagatgcaggagcaagaacggcgcgagcagcagcagaaattgcaggctgcccaatttatgcaacagagagtgccggtgtcccagacacccgctattaatgtgtctgtgcccaccactctgcctagtgccacacaggtccctatggaggttctaaaagtgcagacccacttggaaaaccctactaaatatcacatccagcaggcacagcgacagcaggtgaagcagtacttgtcgactacattagccaacaagcatgccaaccaggtgctgtccttgccctgtcccaaccagccgggagatcacgttatgccaccggtcccagggtcctcagcccccaactctccaatggccatgctgaccctgaactctaattgcgagaaagagggcttttataagttcgaagagcaaaatcgagctgaatccgaatgtccaggaatgaacacccattcgcgtgcttcttgcatgcagatggatgatgtgatcgacgatatcattagtctggaaagttcctacaacgaggagatcctgggcctaatggatccagccctgcagatggcaaacactctccccgtctcaggaaacctcatagacttgtacggcaaccagggcctcccccctcccggtctgaccatctctaattcttgccccgccaacctgcccaacattaagagggaacttaccgagtccgaggctagggcgctggcgaaggaacgccagaaaaaggacaaccataatctgattgaaaggagaagacggttcaacattaatgacagaatcaaagagctgggcactctcattcctaaaagcaacgaccccgacatgagatggaacaagggcaccatcctcaaggccagcgtcgactatatccggaagctgcagcgcgaacagcagagggccaaggaactggagaatcgccagaagaagctcgagcacgcaaaccgacatctgctgctcagaatccaagaactggaaatgcaggcccgggcgcacggattgtcactaatcccttccaccggcttgtgttcccctgacctggtcaataggatcatcaaacaagagcccgtcctcgagaattgcagccaggatctgctgcagcaccacgctgacttaacctgcaccaccactctcgacttaaccgacggtacaattaccttcaacaataacttgggcaccggtactgaggccaatcaagcgtacagtgtgcccacgaagatgggctccaaactggaggacattctcatggacgatacccttagtccggttggggttaccgatccactcctatcctcggtgtcccccggggcttccaagaccagttctagaagatcgtcaatgtccatggaggaaacagagcatacctgttag

SEQ ID NO: 4406 - DNA, 1560 bp, Artificial Sequence
  Description of Artificial Sequence: Synthetic coding sequence
atgggccacctggagaacaccagcgtggtgttcccccgggccatcttctctctgtgcgagaaagagactcggaagttgacgctgtgtctgttcagcaggtcatcttctgctgaacatcccggcgctagtaaacctcctatttcaagtagtagtatgaccagccggatattactgcggcagcagcttatgcgagaacagatgcaggagcaggagaggcgcgaacagcaacaaaaattacaagccgctcagttcatgcagcagagagtgcccgtctcacagaccccagcgatcaacgtaagtgtgcctacaactttgcccagcgcaacccaggttcccatggaagtcctgaaggtacaaactcacctggagaaccctactaagtatcacatacagcaggctcagcgccagcaggtcaaacagtatctgtcaaccacgctcgctaataaacacgctaatcaggtcctgagcctgccatgtccaaaccagcctggagaccacgttatgccccctgtgcccggttcttcagctccaaacagcccgatggctatgctcaccctgaattcgaattgcgaaaaagaagggttctacaaatttgaagagcaaaaccgcgctgagagcgaatgccctggcatgaatacccacagtcgcgcgagttgcatgcagatggacgatgtaattgacgacatcatatctttggagtcaagctataatgaggagattctgggtctcatggaccctgcgctccagatggccaataccctacctgtctccgggaacttgatagatctctatgggaaccagggcttgccgccaccagggctgaccatctccaactcctgccctgctaatcttcctaacatcaagagggaacttaccgaatccgaagcccgagctctggctaaagagcgtcagaaaaaagataaccacaatctgatagaacgccgacgtaggtttaacatcaacgatcggatcaaagagctggggaccctcattcctaagtcaaacgacccagatatgcgctggaataaggggaccattctgaaggcctctgtggactatatccgcaaactgcagagggagcagcagcgcgctaaggagctggaaaacaggcagaagaagctcgagcacgccaatcggcaccttcttctgcggattcaagagcttgagatgcaagcaagggcccacggtctgtccctcattcctagcacaggactgtgcagcccagatctggtcaacagaatcataaagcaggagcccgtgctggagaattgctcacaggacctgctgcagcaccatgcagatttgacctgcacaacaacgctggatctcaccgatggaaccattacctttaacaacaatctgggcacaggaaccgaagcgaatcaggcttactctgtgcctactaaaatgggaagtaaactcgaggatatcctgatggacgatactcttagccctgtgggcgttacagacccgctgttgagcagtgtttcgcccggtgctagcaaaacttccagccgtcggtcgagcatgtccatggaagagaccgagcacacctgttag

SEQ ID NO: 4407 - DNA, 1563 bp, Artificial Sequence
  Description of Artificial Sequence: Synthetic coding sequence
atgcagagcgagagcggcatcgtgcccgacttcgaggtgggcgaggagtttcatgaggagcctaagacctattatgagctgaaatcacagcccctgaagtcttcgtcctcagcagaacatcctggtgccagcaagcccccgatttccagtagctccatgaccagtaggattctgttgagacaacaactgatgagggagcaaatgcaggaacaagagcggcgggaacagcaacagaaactgcaggccgcacaatttatgcagcagcgggtccccgtgagccaaacacccgctatcaatgttagcgtgcccacaactcttccttccgctacacaggtccctatggaagtgctaaaggtccagacacatctggaaaatccaaccaaatatcacatccagcaggcacagaggcagcaagtaaagcagtacctgtcaaccaccctggctaataaacacgcaaatcaggtactgtcgctgccatgcccaaatcagcccggcgaccatgtgatgcccccagtgcccggctcttccgcccccaactctcccatggcgatgctcaccttaaattcaaattgtgagaaagagggcttttataaatttgaggagcaaaacagggcggagagcgaatgtccgggtatgaatacccactccagggcttcatgcatgcaaatggacgatgtaattgacgacattatcagcctggaaagcagctacaacgaagagatcctaggcctcatggaccctgctctgcagatggccaatacgctgcccgtgtccggcaacctgattgacctgtatgggaaccagggcctgccacctcccggcctcactattagcaattcatgtccagctaaccttcctaacatcaaaagagaactgaccgagtcagaagcccgggcactggctaaggaaagacaaaagaaggataatcataatctgatcgagagaagacgtcggttcaacattaatgataggatcaaagagctggggacattaatccctaagtccaatgacccggacatgaggtggaataaaggaacaatcctcaaagcatccgtggactatatccgcaagctgcaaagagaacagcagagagctaaagaactggaaaaccggcagaaaaagctggagcatgcaaacagacacctgttattgagaatacaggaacttgaaatgcaggctagagcccacggcctgtccttaataccatctaccgggctgtgttccccagacctggtgaacagaatcatcaaacaggagccagtgttggaaaactgcagccaagacttactgcagcaccatgccgacctgacttgtacaaccacgctggatctgacagatggcacaattacatttaacaataacctgggaaccggcactgaagccaaccaggcatactcagtgcctacaaaaatgggttccaagttggaagatatattgatggatgacactctgtccccagtgggagttaccgacccgttgctgagttctgtgtcaccgggtgcttccaagacaagcagcaggaggagctcaatgtccatggaagaaaccgagcacacatgttag

SEQ ID NO: 4408 - DNA, 1260 bp, Artificial Sequence
  Description of Artificial Sequence: Synthetic coding sequence
atgctggagatgctggagtacaaccactaccaggtgcagacccacctggaaaacccaaccaagtaccatatacaacaagcccagcgccagcaggttaaacagtacctttctactaccctcgcaaataaacacgctaaccaagtgctgagtctcccctgtcctaaccagcctggggaccatgtgatgccacctgtgccaggctcatccgcacccaattcccctatggcaatgcttactctgaatagcaattgcgagaaggagggattctacaagtttgaggagcagaatcgtgccgaaagcgagtgtcctggtatgaacacccatagtagggcatcatgcatgcaaatggacgatgttatcgacgacatcatatcactggaatcctcttataacgaagaaatcctaggccttatggatcctgcattgcagatggcaaatacactgcccgtgtcaggcaatctaatcgacctgtacggtaatcaggggctgccacccccaggactgacaatttcgaacagttgccccgctaatttgccaaacataaagcgggagctaacagcatgcatttttccaacggagtccgaggctcgtgcgttagccaaagagcggcagaagaaggacaatcacaatctgatcgagagaaggcggcgtttcaacatcaatgatcggatcaaggagcttgggacgttgattccaaaaagcaatgaccccgatatgcgctggaataaaggcacaattctgaaggcaagtgtagactatatccgcaagttgcaacgcgaacagcaacgcgctaaagagctggagaacaggcagaagaagctggaacacgctaaccgccatttgctgcttagaatccaggagttagaaatgcaagcccgagcacatggattgtcactgattccgtccaccggactttgcagccccgatctagttaatcggatcataaagcaggagcccgtgttagaaaattgctcccaggatctgctgcaacatcacgctgatttgacatgcacaacgactctggacctgaccgacgggactatcacttttaacaacaatctgggaacagggaccgaggctaatcaggcttatagcgtacccacaaaaatgggtagcaaactagaagatattcttatggacgataccctgagcccagtcggcgtcactgacccactgctatccagtgtcagcccaggagcctctaagacctcctcgcgacgcagttccatgagcatggaagaaacagaacacacctgctag

SEQ ID NO: 4409 - DNA, 1488 bp, Artificial Sequence
  Description of Artificial Sequence: Synthetic coding sequence
atgctgtacgccttctggttcagccacagcagcagcgccgagcaccctggcgcatccaagcctccaattagcagtagttcaatgacaagcagaatactgttgagacaacaactgatgcgggagcaaatgcaggagcaagaacggcgagagcagcaacagaagctgcaggccgctcagttcatgcagcagcgcgtgcctgtttcgcagaccccagcaattaacgtgtctgtgcccactacactccccagcgcgactcaggtgcccatggaagtgctgaaagtgcagacacacctggagaacccgaccaaataccatattcagcaggctcaacgtcagcaggtcaagcagtatctaagcacaaccctagctaataaacatgcaaaccaagtgctcagcctgccatgcccaaaccagcccggagaccacgtcatgccacccgtgcccggaagttctgcccccaactcacctatggcgatgttgacactcaattcgaactgtgaaaaggaggggttttacaaatttgaagaacagaacagggccgaatctgagtgccctggtatgaacactcacagcagggctagctgtatgcagatggatgatgtgattgacgatattattagcctggagtccagctacaatgaagagattcttggcttgatggaccctgccctgcagatggccaacactttgccagtgtccgggaacctgatagatctctacggaaatcaagggcttcccccgcccgggctgaccatcagtaactcttgccccgccaatctgccaaacattaaacgggaattgacagaatccgaggccagagcactcgcaaaggagcgtcaaaagaaagataatcacaacctaatagaaaggcgacggcgatttaatatcaatgatcgcatcaaagaattgggtactctcattcctaagtcaaatgatcctgacatgagatggaataaggggacaatactgaaggcaagcgtggattacatacgcaagctgcagcgggagcaacaaagggcaaaagaacttgagaacaggcagaaaaagctggagcatgcaaaccggcacctgttgctgcgcatacaagaattagagatgcaggcaagagcccatggcctttctttaattccttcaaccggcctttgcagtcccgatcttgtgaaccgtatcatcaagcaggagccagtgttggaaaactgctcccaagatctgctccagcatcatgctgacctcacatgcactaccaccctggacctgaccgacgggaccattacttttaataataatttaggcactgggacggaagcaaatcaggcctatagcgtaccaaccaagatggggtcaaagttagaggacattctcatggacgacactctctccccagtgggggtgacggaccctttactgtcttccgtatccccaggagccagtaagaccagcagtaggcgcagcagcatgagcatggaggaaaccgagcacacctgttag

SEQ ID NO: 4410 - DNA, 1581 bp, Artificial Sequence
  Description of Artificial Sequence: Synthetic coding sequence
atgcagagcgagagcggcatcgtgcccgacttcgaggtgggcgaggaattccatgaagagcctaagacttattacgagctgaagagccaacctctgaagtcttcttcatccgcagaacacccgggagcgtctaaaccaccaatttcctctagcagcatgacctcaaggattctgctaaggcaacagctcatgagagagcagatgcaggaacaggagcgtcgcgaacagcagcagaagcttcaggctgctcaatttatgcagcagcgcgtgcccgtgagtcaaactcctgcaattaatgttagcgtacctactactttgccaagcgctacacaagtgccgatggaggtcctaaaagtgcagacccatctggagaatccgacaaagtatcacatacaacaagcccagaggcaacaggtcaaacagtatctctctacgacactagcaaataaacacgccaaccaggttctgtccctcccttgtccaaaccagcccggggatcacgtgatgccacctgtgcccggctcaagtgcccccaattcccctatggctatgctgaccctgaatagtaactgcgagaaggaaggtttttataagttcgaagagcagaaccgagccgagagcgaatgccctggcatgaatacgcattcccgggccagttgcatgcagatggacgatgtcatcgacgatatcataagcctggaatcatcttacaatgaggagattctgggactgatggacccagccttgcaaatggcaaacacactgccagtctcagggaaccttatcgatctttatggtaaccagggactgcctccaccaggtttgactatctccaacagctgtccagccaacctgcccaatatcaaaagggagctgacagcttgtatctttcccacggagagtgaggctcgcgctctggctaaggagcggcagaagaaagataatcacaacctgattgagagacgcagacgtttcaatataaacgaccgcattaaggaactggggactctgatacctaaaagtaacgatccggacatgcgatggaataaaggtaccatactgaaggccagcgtggattacatccgcaagctgcagcgtgagcagcagagagctaaggaactggagaaccgtcagaagaagctggaacatgctaaccgccacttgttgctgcggatccaagaactggagatgcaagcccgcgcccatgggctctcattgatccccagcacaggcctttgcagcccagaccttgtgaatagaatcataaagcaggagccagttctggaaaattgttctcaggacctgctgcaacatcacgccgacctaacatgtaccactaccttggatctgacggatggtacaattaccttcaataacaacctagggactggcacggaagccaaccaggcctactctgtgcccacgaaaatggggagtaagctggaggatattcttatggatgataccctgagtccagtgggggttacggaccccctccttagctccgtgagtcctggggcctctaaaacatcttcgcgccggagctcgatgtcgatggaggagacagagcatacgtgctag

SEQ ID NO: 4411 - DNA, 1086 bp, Artificial Sequence
  Description of Artificial Sequence: Synthetic coding sequence
atggaggccctgcgggtgcagatgttcatgccctgcagcttcgagagcttgtacctgtccagcgcggagcaccccggagcctcaaaacctccaatttcttccagcagcatgactagtcgcatactgctgcgccagcagctgatgcgtgagcagatgcaagagcaggaacggagggagcaacagcagaagcttcaagctgctcaatttatgcaacagagggtacccgtatcccaaactcctgccattaatgttagcgtgcccaccactctgccttcagcaacacaagtacccatggaggttctgaaagtgcagactcacttagagaacccaaccaagtatcatatacaacaggcccaacgacaacaggtgaaacagtacctgagcactacactggccaacaaacacgcaaatcaagtgctgagccttccatgtcctaaccagccgggggaccatgttatgccacctgttccaggaagctctgccccgaactcaccaatggccatgttgacactaaactcaaattgcgaaaaagagggtttttataaatttgaggagcaaaatcgagctgagtccgagtgcccaggtatgaacactcacagcagagcctcctgtatgcagatggacgacgtcattgatgatatcatctctctggagtctagctacaatgaagaaatactcggcctcatggacccagctttgcaaatggcgaacacactgcctgttagcggcaacctgattgatctctacgggaatcagggactgccgccccctgggctgactatcagtaactcctgtcccgcaaacctgccgaacattaagcgagagctcaccgcttgtattttcccaaccgagagcgaagcacgcgcgttggctaaagagcgacagaagaaggacaaccataacttaattgagcgtcgtcggcgcttcaatatcaatgaccgaatcaaggaactcgggacgctgatcccaaaatcgaatgaccccgacatgcggtggaacaaaggcaccatcctgaaggctagtgtagactatatccggaaattacagagggaacaacaacgggcaaaggagctcgagaacaggtag

SEQ ID NO: 4412 - DNA, 354 bp, Artificial Sequence
  Description of Artificial Sequence: Synthetic coding sequence
atgggccacctggagaacaccagcgtggtgttcccccgggccatcttcagcctgtgcgagaaggaaacaaggaagttgaccctctgtctgttctctaggtcgtcaagcgccgagcacccaggtgcttcaaagccccccatatctagcagttccatgacctcaaggatactgctgcggcagcagctgatgagagagcagatgcaagagcaggaacggcgggagcagcagcagaaactccaagcagcacagtttatgcagcaacgggtacccgtgtctcagacccccgctataaacgtatccgtgccaaccaccttaccaagcgcaacacaggttccgatggaggtgctgaaatag

SEQ ID NO: 4413 - DNA, 1074 bp, Artificial Sequence
  Description of Artificial Sequence: Synthetic coding sequence
atgctggagatgctggagtacaaccactaccaggtgcagacccacctggaaaaccctacaaaataccatatccagcaggctcagcgccagcaaggtttctacaaatttgaagaacagaacagggccgaatcggagtgcccgggaatgaacacccattccagagcgtcctgtatgcagatggatgacgtaatcgacgacatcatatctctggaatcttcctacaatgaagagatccttggactgatggatccagccttgcagatggctaatactcttccagtgtccggaaatttgatcgacctgtatggaaaccaggggttgccacctcctgggctgacgatcagcaactcctgtcctgcgaacctgcccaacatcaaacgcgagctgactgaatcggaagcccgcgctctggccaaggaaagacagaagaaggacaatcataacctgatcgaaagaaggagacggttcaacatcaacgaccggattaaggaacttggaaccctgattccaaagagcaacgatcctgacatgcggtggaacaagggcaccatcttaaaagccagtgttgactatattcgtaagcttcaacgggagcaacagcgtgcaaaggaactggagaaccgccagaaaaaactcgaacacgctaatcgccacctgctactgaggatccaagagcttgagatgcaagctcgagcccatggtttatccttaattccctccacggggctatgctcgcctgacctggtgaaccggatcatcaaacaggagcccgttctagaaaattgctcccaggacctgctgcagcaccatgccgaccttacatgtactaccacacttgatctgaccgatggaaccatcaccttcaataacaacctgggaacagggacggaggctaaccaggcttattcggttcccaccaaaatgggttccaagctggaggacatccttatggatgataccctgtcccccgtgggagtgacagaccccttgttgagttccgtttcgccgggggccagcaagacaagcagtcgccggtcctctatgagcatggaagaaactgaacatacttgctag

SEQ ID NO: 4414 - DNA, 1407 bp, Artificial Sequence
  Description of Artificial Sequence: Synthetic coding sequence
atgaccagccggatcctgctgcggcagcagctgatgcgggagcagatgcaggaacaggaacgtagggaacagcagcagaagctgcaggcggctcagttcatgcagcagcgagtgccagtgagtcagaccccagctatcaacgtcagtgtacccaccacactgccttccgccacccaggtaccaatggaagtgcttaaagtgcagacacacctggaaaacccgacaaagtaccacattcagcaagcccagcgtcagcaggtgaaacaatacctgagcacgactctggctaacaagcatgcaaaccaggtgctgagtctcccctgtcccaatcagcctggcgaccacgtaatgccaccagtgcccggatcaagtgcacccaactcgcccatggccatgctgactttaaacagtaactgtgagaaagagggtttctacaagttcgaagagcagaacagagccgagtctgaatgcccgggtatgaatacacattcacgcgccagctgcatgcaaatggatgatgttatagacgatatcatctctctggagtccagctacaatgaagagatcttaggtctgatggaccctgcactccagatggcaaatacactgcccgtgtccggcaatctcatcgacctgtacggcaatcagggacttccccccccgggtttgactatctcgaattcatgtcctgcgaacctccctaatatcaagcgcgagctgactgagagcgaagcacgcgccctggccaaggaacgccagaaaaaggataatcacaacctgatagagcgaagacggcggttcaacatcaacgaccggatcaaagagctgggcacgttaattccaaaaagcaacgaccccgacatgcgctggaataagggcaccattttaaaagccagcgtagactacatccggaaattacaacgggagcaacagcgagctaaagagctcgaaaacagacagaagaaactggagcacgccaacaggcaccttctactgcggatacaggagctggaaatgcaggccagagcccacgggctgtctctgataccttctaccggcttgtgcagtccagatttggttaataggattatcaaacaagaaccggtgctcgagaattgcagccaggatctactgcagcaccacgcagacctgacatgcacgacgactcttgacttgactgatgggaccattaccttcaataataacctggggacagggaccgaagctaatcaggcttactcagtgcctaccaaaatgggttccaaactggaagatatactcatggacgacactctgtcaccagttggcgtgaccgacccactgctctcatccgttagcccgggtgcctccaagacctccagcagaagaagctcgatgagcatggaagagacggagcatacatgttag

SEQ ID NO: 4415 - DNA, 4422 bp, Artificial Sequence
  Description of Artificial Sequence: Synthetic coding sequence
atggccggcggcgcctggggccggctggcctgctacctggagttcctcaagaaagaagagctgaaggaattccaattactgctcgcaaataaagctcattcaagaagctcgtcaggtgaaactcctgcgcagccagagaagacatcaggcatggaagtggcatcttatctcgttgcacagtacggggagcagagagcctgggatttagctctgcacacctgggaacagatgggcctgagaagtctctgcgcccaagctcaggagggcgcagggcacagtccatcgttcccttattccccatccgagccacacttaggatcaccttcccaaccaacctccacggccgttctgatgccttggattcacgagctcccagcaggatgcactcagggttctgagaggagagtcctgaggcagctccctgacacgtccggcagacggtggcgcgagatcagcgcctccttattatatcaagccttgccctctagccctgatcatgaatctccctcacaagaatccccaaatgcgccgacctcgacggcagttttgggcagctgggggagcccacctcagccctcattagcaccacgcgagcaagaggctccaggaactcaatggcccctggacgagacgtcaggcatttactacacagagatcagggagagagagcgggagaagagcgaaaaaggccggccaccttgggccgctgtggtgggtacccccccacaagcgcacacctcattgcagccccaccaccatccctgggagcccagcgtgcgcgagtctctttgtagcacctggccatggaagaacgaagatttcaaccagaagtttacccagctcttgctgctgcagaggcctcatccacgaagtcaggacccgctggtgaagcgttcctggccagactacgtggaagaaaaccggggccatctgattgagatccgggatctattcgggcctggcctagatacgcaggaacccaggattgtcatcctgcagggcgctgcagggatcggaaaaagtacgctcgcacggcaggtaaaagaagcctggggtagaggccagctgtatggcgatcgcttccagcacgtattctactttagctgtcgggagcttgcccagtccaaagtggtatctttggcggagctgatcgggaaagacgggacagcgacacccgcccccatcaggcagattctgtccagacctgagcgactgttgttcatcctcgacggcgtcgacgagccgggttgggtgcttcaagagccctctagcgagctctgcctccactggagtcagcctcagccggccgatgctctgctggggtccctcctgggaaagacaatcttacctgaagcgtcctttcttataaccgccagaactaccgcactgcagaatctgatcccctccctagagcaggcaagatgggttgaggtgctgggattctcggagtcaagccgaaaggaatacttctatagatacttcaccgacgagagacaggcaattcgcgcgtttcgtctggtcaaatccaacaaagagctttgggccctgtgcttagtcccttgggtgtcttggctggcatgtacctgcctcatgcagcagatgaagagaaaggagaaactgaccttgacctcaaagactacaaccaccctatgcctccattacttagcgcaggccctacaagcccagccactgggcccacaattgcgcgacttgtgcagcttagcggcggaaggaatttggcaaaaaaagaccctattttccccggacgacctgcggaagcacggcctggatggggctatcatatccacattcttgaagatgggcatccttcaagagcatcctattcccctgtcctattcattcatacatctttgcttccaggaatttttcgcagccatgagctacgtacttgaagacgaaaaaggcaggggcaaacacagcaattgtattattgacctggagaaaacgctggaggcttacgggatccacgggctgtttggtgctagtaccacacgcttccttcttggactgttgtctgatgaaggtgagagggagatggagaatattttccactgccgcctgtcccagggacgcaacttgatgcagtgggtgccgagcttgcagcttttgcttcagcctcacagtcttgaatcactgcattgtttatacgagactagaaacaagaccttcctaacacaggtcatggcccattttgaagaaatgggcatgtgcgtcgagaccgacatggaactgctcgtatgcacattctgtatcaagttctctcgtcatgttaaaaagctccagctgatcgaaggcaggcaacacaggtctacatggtctccaacaatggtggtactatttcgctgggttccggtaactgacgcatattggcagattctgttcagcgtgctgaaggtgacacgaaatttgaaggagttggatctctccgggaactctctttcccactccgcagttaagtccctatgcaagacactgagacggcctaggtgtttattggagacactgcggctggcgggatgcgggcttacagcagaggactgtaaggatctggccttcgggctccgcgctaaccagaccctaactgagctagacctgagtttcaatgtgcttactgatgccggtgcgaagcatttatgtcagcggctcagacaaccgtcatgcaagctgcaacggctccagttagtatcctgtgggttgacaagtgattgttgccaggatctggcctcagtcctcagcgccagcccctctctgaaggaactggaccttcagcagaacaacctcgatgatgttggggtgcggcttctgtgtgagggtctccgacatcctgcctgtaagttgattaggctgggcctggaccagaccaccctgagcgacgaaatgcgccaggagctacgcgccctggaacaggagaagcctcagttgctcattttttcaaggcgtaaaccgtccgtaatgaccccaaccgagggcctcgacacaggtgaaatgtcaaacagcacgtcctcactgaagagacagagacttgggtctgaaagggctgcttcccacgtcgcccaggcaaacctgaagctcctggatgtaagtaaaatttttcctattgccgagatagccgaggagagcagcccagaagtggtccccgtggagctcctgtgcgtgccgtccccggccagccagggagatcttcatacaaagccccttggcacagatgacgacttctggggtccaaccgggccggtagcaacggaggtcgtggataaggaaaagaacctatacagagtgcactttcctgtcgcaggaagctaccggtggccaaacaccggactctgttttgtgatgcgtgaggccgtgacggtggagattgagttttgcgtgtgggatcagtttctgggggaaatcaaccctcagcatagctggatggtcgcgggacctctcctggatatcaaggccgagcccggggccgtggaagccgtgcacctgcctcacttcgtagcattacagggcggacatgtcgatacatctctgtttcagatggcacacttcaaggaggagggaatgctcctggagaagccagccagggtggaattgcaccacatcgtgctggaaaatccttcttttagtccactcggagtgcttctgaaaatgattcataatgccctgcgctttatacctgtaacaagcgtggtactgttgtaccatagggtccatcccgaggaggttacctttcacctgtatctcatcccaagcgattgttctattcggaaagccatcgatgacttagaaatgaagttccagtttgtccgaatacataagcccccccccctgacacccctgtacatgggttgccgctataccgtttctgggtctggctcgggtatgctggaaatacttccgaaggagctagagctgtgttaccggagtccaggcgaagaccagctgttttccgagttttacgtgggacatcttggaagcggcatccgcctccaggtgaaggacaagaaagatgaaaccctggtatgggaggctctggttaagccaggtgatctcatgccagctacaaccctgattcctcccgcccggatcgcggttccctcacctctggatgccccacagctcctccacttcgttgaccagtaccgcgagcaactgatcgccagggtgaccagcgtcgaggtagtgcttgataaactgcacggccaggtgttgtcccaggagcagtacgagcgcgtactggcagagaacacccggccttcccagatgcggaaactgttctctctgagccagtcttgggacagaaaatgtaaggacggactgtatcaggcactaaaggaaacacatccgcatctgataatggagctttgggaaaaggggagtaaaaaaggccttctacctctcagctcatag

SEQ ID NO: 4416 - DNA, 4200 bp, Artificial Sequence
  Description of Artificial Sequence: Synthetic coding sequence
atggccggcggcgcctggggccggctggcctgctacctggagttccttaagaaggaggaactgaaggagttccaactgctcctggctaataaagctcacagtagatctagcagtggagaaactcctgcacagcccgaaaaaaccagcggaatggaggtggctagctatctagttgcccagtatggtgagcaacgggcgtgggatttggcgctccatacctgggaacagatgggtctgcgatctctgtgcgcccaggcccaggagggtgcgggccattcaccttcctttccttatagcccttctgaaccccacttgggcagcccaagtcaaccaacgtccacggccgtattgatgccgtggatccacgaattgcctgcaggttgcacccagggatccgagagaagagtcctgaggcagctgcccgataccagcggccggcggtggcgcgaaatctcagcgagccttctgtatcaggccctgccctcaagccccgaccatgagtctccgtcacaagaatcacctaacgcccctacgtcaaccgccgtcctcggcagctggggtagcccccctcaaccaagcctggccccgcgagaacaagaggcccccggaacccaatggcctttagatgagacgagcggcatctactataccgagatccgggagagggaacgcgagaagagtgagaaaggcagaccaccctgggcagccgtcgtcgggactccacctcaagcccacacgtccttgcagccccaccaccacccttgggagccgagcgtgagagagagcctgtgttctacatggccctggaagaatgaggacttcaatcagaaatttacccagctcttactgcttcagaggccccatccccggtcccaagatccattggtgaaaagatcttggccagactacgtggaggaaaaccgcggccatctgattgaaattagagacctgttcggaccgggtttggatacacaggagccacggattgtgatactgcagggggccgctggaataggcaaaagcacccttgcgagacaggttaaggaggcctgggggaggggacagttgtatggagacagatttcaacacgtattctacttctcttgtagggagctggcccagtcaaaggtggtttcacttgccgagctcatcggcaaagacggcacagctactcccgctcccataagacagattctgagcagaccagaacgcctgttgtttatcctcgatggcgtggatgaacccggctgggtgctgcaggagccaagctccgagctctgtcttcactggtcacagccccagccagccgatgcactgcttggatctctgttgggcaagaccatccttcctgaggcctcttttctgatcaccgccaggactactgccctccagaatctcattccatctctcgagcaggctcgctgggtggaggtcctcggattttccgaatccagtcgaaaggagtatttttatcggtatttcacggatgaacgtcaagcaatcagagctttccgactcgtgaagtccaacaaggaactatgggctctgtgtctggtgccatgggtgtcctggctggcttgcacgtgcctgatgcaacaaatgaaaagaaaagaaaagctcacactgacgagcaagaccactacaactctgtgcctccattacctggcccaggccctacaagcccagcctttggggccgcaactcagggatttgtgttctctggcggctgagggaatctggcaaaagaagactctcttcagcccggatgatctaaggaaacacggactggacggcgcgatcattagcacattcctcaaaatgggcatactgcaggagcaccctatacccctctcctatagcttcattcacctctgcttccaggaatttttcgcagctatgagctatgttctggaggacgaaaaaggtagaggaaagcactcaaattgtatcatcgaccttgaaaagacgttggaggcatacgggattcatggtctgttcggtgcaagcacaacccgatttctgctcggtcttctatctgacgaaggcgagcgtgaaatggagaacattttccattgccggctgtctcaggggcgaaacctgatgcagtgggtgccaagccttcagctgttgctgcagccgcactctctggagtcgctccactgtctctatgaaactagaaacaagacctttttgactcaggtcatggcccactttgaggagatgggaatgtgtgtcgaaacagatatggagctgcttgtgtgtaccttctgtatcaagtttagcagacacgttaagaagcttcagctcatcgagggtagacagcatagaagtacttggtccccaacaatggtcgtgctgtttcgttgggtgcctgtcacagacgcttactggcagattctttttagtgtcttaaaagtgaccaggaacctcaaagaacttgacctgtcaggtaacagccttagccattctgcagtcaaatcactgtgtaaaactctgcgccggccccgatgtctccttgagaccttaaggttggctggatgtggcttgacagcagaggactgcaaggatctggcgtttggactgagggccaaccagaccctcactgaactggatctatcttttaacgtcttaacagacgcgggcgccaaacatctgtgccagcgactcaggcagccaagctgtaaactgcagcggctacaattggtaagttgtggcttaacctctgattgttgccaagacctggcttcggtcctctctgcatctcctagtctgaaagaactggacttgcagcaaaacaacctggacgacgtaggtgtccggctgttgtgcgagggactgaggcatccggcatgtaagctcattcgactaggcaaaccaagtgtcatgacccctactgagggcctggataccggagagatgagcaacagcactagttctttgaagagacaacgtttgggatctgagagggccgcgtctcacgtggcccaggcaaacttaaaacttctcgatgtcagcaaaattttcccaatcgctgaaattgcagaagaatcatccccagaggttgtaccagtcgagttgttgtgtgttccatcccctgcctctcagggggatctgcacaccaaacccctcgggaccgacgatgacttctgggggcccacaggccccgtggctactgaggtggttgacaaagagaaaaacctgtaccgggtgcacttcccagtcgctggttcctataggtggcctaacacaggtctgtgctttgtcatgagagaggctgtcactgtggagatcgagttctgtgtgtgggatcagttcttgggggaaatcaacccacagcacagttggatggtggccggccccttgctggatattaaggctgagccgggagccgtagaagccgtgcacttacctcatttcgtcgcgctccaggggggccacgtggatacaagtttgtttcagatggcacatttcaaagaggaaggaatgctgttggaaaagcccgctcgcgtggaacttcaccatatcgtgctggagaacccatcctttagccccctgggcgtcctcttgaaaatgatccataatgcactgcgatttattcccgtgacctctgtcgtcctgctttatcatcgtgttcatccggaagaagtaaccttccacctgtacctgattccctccgattgcagtataagaaaggagttagaactctgctatagaagcccaggggaagaccaactattttccgaattctatgtggggcatctcgggagcgggatcagactgcaagttaaggacaagaaggacgagactctggtgtgggaagctctggttaaaccaggcgatctcatgcccgcaaccacacttatccccccggccagaatcgctgttccaagccccctggatgccccccagttactacactttgtagaccaatatcgtgagcagctcatcgctcgagtgacgtcggtggaggtggtgcttgacaaacttcacggccaggtattatctcaggagcagtatgagagggtcctggccgagaatacgcgaccctctcaaatgagaaaactcttttcactgagccagtcctgggataggaagtgcaaagatggcctataccaagccctgaaggagacccacccccatcttatcatggaactgtgggagaaagggagcaagaaggggctactcccactctctagttag

SEQ ID NO: 4417 - DNA, 4128 bp, Artificial Sequence
  Description of Artificial Sequence: Synthetic coding sequence
atggccggcggcgcctggggccggctggcctgctacctggagttccttaaaaaagaggagctgaaggagttccagctgctgctcgctaacaaggcccacagtaggtcttcctccggagagactcctgctcaacctgagaaaactagtgggatggaagtggcaagctacctggtggcccaatatggcgaacagagagcttgggacctcgcactccacacatgggagcagatgggcttgcgctccctgtgtgctcaggctcaggagggagccggccattctccatccttcccttactctccgagcgagcctcacctaggcagcccttctcaaccaactagcaccgcggtactcatgccttggattcacgagctgccagctggctgcacacaaggaagtgaacgcagggtgctcagacagctccccgatacatcaggacgacgctggagggaaatctctgcatctttactttatcaagccttaccatcgtctcccgaccatgagagccctagccaagagtcacctaacgcgccgacaagtaccgcggttcttggcagctggggatcaccaccacagccttcccttgcccctagagaacaggaagctccggggacccagtggccattggacgagacgagcggaatctactacactgagattcgtgagagggaaagagagaaatccgagaaagggcggcccccttgggctgccgtggtcggtacgccaccacaagcccatacctccctgcagccccatcaccatccttgggagccttcagtacgggagagtctgtgctccacttggccatggaagaatgaggattttaatcagaagttcacacagctcttacttctgcagcgcccgcaccccagatcacaagacccactggtgaagcgctcctggccggattatgtcgaggaaaacaggggccatctgattgaaattcgagatctctttggccctggccttgatacccaggaacctaggatagtgattttacagggtgcagccgggataggcaagtcaactctggctcgccaggtcaaggaggcgtggggaagagggcaattatacggagataggtttcagcatgtgttctacttttcttgtagagagctggcccaatcgaaggtagtttcccttgcagagttaattggcaaagacgggacagcgacgcctgcacctataagacagatcttgtctagacccgagagattactattcatactggatggtgtagatgagccaggctgggtgttgcaggaaccatcctctgagttgtgtctgcactggtcccagcctcagcccgccgacgcactgctgggctctcttttagggaagactatactccctgaggcaagcttcttgatcaccgcacggactacggccctgcaaaacctgattccaagtctggagcaggccagatgggtcgaggtgttgggcttttccgagtctagtcgaaaggagtatttctatcggtattttactgatgagaggcaggctattagggcttttcgactcgtgaagtccaacaaagagctctgggcactgtgtctcgttccttgggtaagttggctggcctgcacatgcttaatgcagcaaatgaagcggaaagagaaactaactctcactagcaagaccaccacaactctgtgcttacactatctggctcaggccctgcaggcccagccgttgggaccccagctgagagacttatgttcccttgcagccgaagggatttggcagaagaaaaccctattctccccagacgacctaaggaagcacggtttggatggcgctattatttctaccttcctcaagatggggatccttcaggagcaccccatccccctttcctattcctttattcacctgtgcttccaagagtttttcgctgcaatgtcatacgttcttgaagacgagaaagggcgcgggaaacactccaattgtatcattgatctagagaaaactctcgaggcctacggaattcatggcctctttggtgcctctacaacgaggtttctgctgggcctcctgagtgatgagggcgagcgggaaatggaaaatatttttcattgccgtctgtcccagggcaggaacctgatgcagtgggttccatccctgcaactcctcctgcagccccattcactcgaaagtctgcactgcctgtacgagacacgcaacaagaccttcctgacgcaggttatggcccatttcgaggaaatgggtatgtgtgttgagaccgacatggaactactggtgtgtacattctgtatcaagttctcccggcacgtcaagaagctgcagctaatcgaggggagacagcacagatctacctggtctccgaccatggtggtgttattccggtgggttcccgtcaccgatgcatactggcaaatcctgttttcggtgttgaaggtaacacgaaatctgaaagagctggacctctccggtaattctctgtcacattctgcagtgaaaagtctttgcaagactctgcggcgaccaaggtgtctgttggagaccttacgtttagcaggttgtggactcactgccgaggactgcaaagacctcgcattcgggctgcgggctaaccagacattgaccgagcttgacctttccttcaacgtccttacagacgcgggggcaaaacacttgtgtcaacgccttcggcaaccatcatgtaaacttcaaaggctgcaacttgtaagctgcggtctgacttccgactgctgtcaggatctcgcgtcagtgctttcagcaagtcccagcctgaaggaactggacttacagcaaaacaacctggacgacgtaggggtaaggttactgtgcgagggccttcgtcaccccgcctgtaaattaataagacttggtttagaccagaccactctgagcgatgaaatgcgacaagagctgagagcattggagcaggaaaagcctcaattgctaattttttcacgccgaaagcctagcgtgatgacgccaactgaggggcttgatactggagaaatgtccaatagtacttcttccctaaagcgccagcgccttggatctgagcgcgccgcttcacacgtagcacaggctaacttaaagctgctggatgtctccaaaattttccccatcgccgaaattgccgggaagtcacacgaggagtcgtcccctgaggtggtgccagtcgagctcctttgcgtaccaagtcccgcgtctcagggtgacctgcatactaagcccttgggcactgacgacgatttttgggggcccaccggccctgtggctactgaagtggtagacaaggagaaaaacctgtatcgagttcactttcctgttgccggtagctatagatggcccaacacagggctctgttttgtgatgagagaggccgtgacagtcgaaattgagttttgcgtgtgggaccagttcttgggcgagatcaatccacagcactcgtggatggtagctggccctctcctcgacataaaagctgaaccgggagccgtggaagccgtgcaccttccgcattttgtggcgttgcagggagggcatgttgacaccagcctgtttcaaatggcgcactttaaggaggagggtatgctgctggagaaacccgctcgggtggagctccatcatatagtactggagaatccatctttttctccactgggcgtcctgctcaagatgattcataacgccctcaggttcattcctgtgacatctgtggtactcctctaccacagagttcaccccgaggaagtgacgttccatctatacctcatcccgtccgattgttctatccgcaaggccattgacgacttggaaatgaagttccagttcgtgagaattcataaacctcctccattgacccccttatacatgggctgtcgctataccgtaagtggctccggttcaggtatgctggaaatcctgccaaaggagctcgaactgtgttatcgctctcctggcgaagatcagctgttctccgaattttatgtggggcacctgggctcggggattcggctgcaggttaaggacaagaaagatgagacactggtctgggaagctttggtgaaacctggtcgtaacacatcacaaccttggaatctgaggtgcaaccgcgatgcgaggagatactag

SEQ ID NO: 4418 - DNA, 4422 bp, Artificial Sequence
  Description of Artificial Sequence: Synthetic coding sequence
atggccggcggcgcctggggccggctggcctgctacctggagttcctgaaaaaggaggaattaaaggagtttcagctcttgctagccaataaggcccacagtcgtagcagctccggcgagactcccgcacagcctgagaaaacgagcggcatggaggtcgcttcttacctcgttgcgcagtacggcgaacagcgggcttgggatctcgctctccatacttgggagcagatgggcttgcggtcattgtgtgcgcaagctcaagagggggctggccactcaccctcttttccctactctccatccgaaccgcacttgggatctcctagccagccaacttcaaccgcagtgctgatgccttggatccacgaattacccgccgggtgtacacaagggagcgaacgccgagtcttacggcagctgccagatacatcgggcaggcggtggcgcgagatctcggcatccctgctgtaccaggcccttccttcgagccccgatcacgaaagtcccagtcaggagagcccaaacgcaccaacctcgactgcagtcctcgggtcttggggctctccaccccagccaagcctagcccccagggagcaggaagcgccaggcacacagtggcctctagacgagacgagtggaatctactacaccgagatccgcgagcgggaaagagagaaaagcgagaaagggcggcctccatgggccgccgttgttggcactcccccccaggctcacacctccttacaaccacatcatcatccctgggagcccagcgttagggaatccttgtgtagtacctggccttggaaaaacgaagattttaaccagaaattcacacaactgctcctgctccagcggcctcatccacgttcacaggatcccctcgtgaagagaagctggcccgattatgtggaggaaaaccgcggacacttgattgagatccgcgatcttttcggaccggggcttgacacacaggagccccggatagtgatcctgcagggagctgccgggatcggcaaatctacgctggcacggcaagtcaaggaggcctggggtagaggtcaactgtacggggatcgctttcagcacgtattctacttttcttgcagagaactcgcccagagcaaagtggtgtctttagctgagctcatcgggaaggacggcaccgctaccccagcaccaatacgtcagattctgtctaggcccgaacggctgttgtttattcttgatggtgtggatgaaccagggtgggttctgcaggaaccctcctcggaactgtgtttgcattggagccagccgcagcccgccgatgccctcctgggctccttgcttgggaaaaccatcctgccggaggcttccttcttgattacagcccgcacgaccgcgcttcagaatctcatcccttcactcgagcaggccaggtgggtcgaggtgctcggattctccgagagttctagaaaagagtacttttatagatattttactgacgaaagacaggccatcagagccttcagattggtaaaatccaacaaagagctttgggcactatgtcttgttccatgggtgtcttggctggcctgtacttgtctgatgcagcaaatgaaacgtaaagagaagctgacactaaccagtaagaccacaaccactctgtgtctgcattaccttgcccaggcactgcaggctcagcctctcggcccccagctcagagacctgtgttccctcgccgccgaaggtatatggcagaaaaaaacgttgtttagccccgatgacctaagaaaacacggattggatggcgctatcatctcgacgtttttaaaaatgggcattcttcaggaacaccccatacctctgtcatacagcttcattcacctgtgctttcaggaattttttgccgcaatgtcctacgtgctggaagacgagaaaggtcggggcaaacacagcaactgcataatagatctagaaaaaactctggaggcctacggaatacatgggctctttggagcatcgacaactcgatttctgctcggcctgctgagtgatgaaggggaacgggagatggaaaatatctttcattgtcgacttagtcaaggccgcaaccttatgcagtgggtgccctccctccagcttctcttgcagccccactcgctcgaaagtctgcattgcttgtatgaaactagaaacaaaacatttttgacccaggttatggctcacttcgaggagatggggatgtgtgtggagacagacatggaattacttgtgtgcactttttgtattaagttcagccgtcacgtgaaaaaactgcagctcatcgaaggcagacaacacagatccacctggagcccgactatggttgtgctttttcgatgggtgccagttaccgatgcctactggcagatcctgttcagtgtcctgaaggttacccgcaatctcaaggagttggatctgtccggaaatagcctctcacatagcgctgttaagtctttatgtaagaccctgcggcgccccaggtgcctgctagagacgctgaggcttgccggttgtggtcttactgccgaggattgcaaagacttggcattcgggttacgtgccaaccagacgctcactgaactggatctcagcttcaacgtgctcacagacgcaggcgctaagcacttgtgccagcggttaaggcaaccctcctgcaagctccaacgcctgcagctcgtcagctgcggcctgaccagcgactgctgccaggatcttgccagcgttctgtccgcttcccctagcctgaaggagctcgatttacaacagaataatctggacgatgtcggggtgcgtcttctgtgcgaagggcttaggcaccccgcctgcaagctgatccgactgggactagatcagaccactctgtctgatgagatgcgacaggaactccgagccctagaacaggagaaaccgcaactcctgatttttagcagacggaagccgtccgtaatgacccccactgaggggctggatactggtgaaatgagtaatagtaccagtagcctgaagcgccagcggttgggaagtgaacgagcagcaagccatgtcgcccaggccaacctgaaactcctggatgtgtccaagatctttcctatagctgagattgcggaagagtcatcacctgaggtggtcccagtcgaactcctctgcgttccttcgcctgcatcccaaggagatctccacacaaagcccctcgggacagacgatgacttctggggacctaccggaccggtggccaccgaagttgttgataaagagaagaatctgtacagagtgcattttcccgtggccggctcttacaggtggcccaacaccgggctttgttttgtgatgcgagaggcggttactgtggaaattgagttttgtgtctgggaccagtttctgggcgaaatcaaccctcagcattcatggatggtggcggggccattgcttgatattaaagctgagccaggagctgtcgaagccgtgcacctgccgcatttcgttgctctgcagggagggcacgttgacacttctttatttcagatggctcattttaaagaggagggaatgctgctggaaaagccagcgagggttgaacttcaccacatcgtgttggagaatccatcctttagccccctgggcgtcctcctcaagatgatacacaatgctctgcgctttattccggttacttcagtggtactgctgtaccacagagtgcatccggaagaggtgactttccacctctatctgatccccagtgactgttccatacggaaggcaatcgacgacctggaaatgaaatttcaatttgtacgcatccacaagcctccgccgttaacccccctgtacatggggtgtcggtatactgtaagtggatcagggagtgggatgctcgagatcttgcccaaggagctcgagctgtgttataggtcccctggagaagatcagttgttctccgaattctatgtgggccatcttggatccggcattcggttacaggtaaaggacaaaaaggatgagactttagtttgggaggcgctcgtgaagcccggcgacctgatgcctgcaacaacactgattccgcccgctaggatagctgtgccctctcccttggacgctcctcagctattgcatttcgttgaccagtaccgtgagcagttgatcgcacgggtgacgagtgtcgaggtagtgttagataaattacatggtcaggttttgagtcaggaacaatacgagcgtgtccttgctgagaacactcggccgtcccaaatgagaaaactgtttagcctaagccagtcgtgggaccggaaatgcaaggacggactgtatcaggccttgaaggaaactcacccacacttgataatggaactgtgggaaaagggctctaaaaaagggttgctacctctgagttcttag

SEQ ID NO: 4419 - DNA, 4290 bp, Artificial Sequence
  Description of Artificial Sequence: Synthetic coding sequence
atggccggcggcgcctggggccggctggcctgctacctggagttcttgaagaaggaggagttgaaggaatttcagctcctcctggcgaacaaggcacactccagatcctcatctggcgagaccccggcacaacccgaaaagacttctggtatggaagtagccagttaccttgtggcacagtacggggagcagcgagcttgggaccttgccctccatacatgggagcagatgggactcaggtctttgtgcgcgcaggctcaggaaggagctgggcactcacccagcttcccttatagcccatctgagcctcatctgggaagtcccagccagcccacctcgacggctgtgctgatgccctggatccacgagctgccggcaggctgtacccagggatcagagcgacgcgttctgcgtcaattgccagataccagcggaaggcggtggagagaaatctctgcctccctgctgtaccaagccctgccatcgtcccccgatcatgagtcgccgagtcaagaatcacccaacgcccccaccagcacagctgtgctcgggtcttgggggtcaccaccccagccttcactggcacctcgggagcaggaagcacctggcacacagtggcccctcgatgaaacttccggtatttactacactgagatacgggaaagagagagggaaaaaagtgagaagggccggccaccttgggccgcagttgtcggcactcccccgcaggctcacacatccctgcagccccaccaccatccctgggagccttccgtaagagaaagtctgtgcagcacctggccatggaagaatgaggatttcaatcagaaatttacccagctgttactgctacagagaccccaccctagatcacaggatcctctggtgaagagatcctggcccgactacgtggaggagaatcgtggacacctcattgaaattcgagatctttttggccctggattagacacccaagaacctcgcattgtaattctccaaggagctgccgggattgggaagtcaaccctggcccgtcaggtgaaggaggcctggggtcgtgggcagctgtatggcgatcgatttcaacacgttttctacttctcctgccgggagctcgctcagtccaaggtggtgtcgttggccgaactcataggtaaagatggcacagctacacccgctccgatccgccagattctgtcccgacctgaacgcttgcttttcatactagacggggttgatgaacccggatgggtcctccaggaacccagttcggagctctgtctgcattggtcccaaccacagccagctgacgctctcttgggcagcctcttggggaaaacaattctaccagaagctagtttccttatcactgcacgaaccacagcgctgcagaatctgattcccagtctcgaacaggccagatgggttgaggtgttgggtttctctgagagcagcaggaaggaatatttctatcgttactttacagacgaaaggcaggctattcgggcttttagacttgttaagtccaacaaggagctctgggctctctgccttgtgccgtgggtgtcctggctggcctgcacctgcctcatgcaacagatgaagcgcaaggaaaaattgacactgactagtaaaacaactactaccctgtgcttacactacctcgctcaagccctgcaggcccagccactgggacctcagctgagggacctctgtagtctggcagcagagggtatatggcaaaagaagaccctcttcagcccagacgaccttaggaagcacgggcttgatggcgcaattatttcaacattcttgaaaatgggaattctgcaggagcaccccatccctttgtcctattcatttatacatctctgttttcaggaattttttgccgcaatgtcttatgttctcgaagatgagaagggtcgaggcaaacattcgaattgcataattgacctcgagaagacattggaggcctatggaattcatggcctgtttggcgctagtactaccagatttctcctgggcctgttgtctgatgagggagaacgagaaatggaaaacatcttccactgcaggctgtcccaggggagaaacctgatgcagtgggtcccgagcctacaactgctgctacagccgcactcactcgagagtctccactgcctgtatgagacccgcaataagaccttcctgactcaagttatggcccactttgaggagatgggaatgtgcgtcgagaccgacatggagttactagtatgtactttttgcattaagttcagtagacacgtgaagaagctccagctgatcgaggggcggcagcacagatctacttggtcgcccactatggtggtcttgttccgctgggtgccggtaacagacgcgtactggcaaatcttgtttagtgtgcttaaggtgacccggaacttaaaagaattggacctgtcaggcaacagtctgagccattccgctgttaaatccctctgcaaaaccctgcgcaggcctagatgcttgttggagaccctcaggcttgcaggatgcggccttactgctgaggactgcaaagacctcgcatttgggctgagggcaaatcagacactgactgaactcgatctctcctttaacgtgctaacagatgcgggggcaaaacatttatgccaacgcttacgacagccttcctgcaagcttcagcggcttcagttggtttcatgtgggctcaccagcgattgctgtcaggacctggctagtgtcctcagtgcttcaccttctctcaaggagctggacctacagcagaataacttagatgacgtaggggtcaggctgctctgcgagggcctgaggcatcccgcttgtaagttgattcgcctggggctggaccagacaactttaagcgatgagatgcgccaggaactgagagccttggaacaggagaagccccagctgctgatcttttcaagacgcaagccatctgttatgacgccaaccgagggactggacacgggggagatgtccaattcaacctcaagccttaagagacagcggcttgggtccgaaagggctgccagccatgtagcacaggccaatctgaagttactggacgtttctaaaatattccccatcgcggagattgcagaggaaagctcgcctgaagttgtccccgtggagctattgtgcgtcccaagccccgccagccagggggatctgcacacaaaacccttagggacagatgatgacttctggggaccaacaggaccagtggccaccgaggtcgttgacaaggagaagaacctttacagggttcacttcccagtcgctggctcgtataggtggcccaatacaggtctgtgcttcgttatgcgggaggccgttacagtggagattgaattctgtgtgtgggaccagttcttgggggaaatcaatccgcaacactcctggatggttgccggccccctccttgatatcaaagcagagcccggtgctgtggaggctgtccatcttccacattttgtggccttgcaaggtggacacgtggacacttcgctgttccagatggcccacttcaaggaggaagggatgctgcttgaaaaacccgcgcgggtcgagcttcatcatatcgtgctagaaaacccaagcttctctcctctgggagttctgctcaagatgattcataacgctctcaggtttatccctgtcacctctgtcgtgctgctctaccatcgcgtacatcccgaggaggttaccttccatttgtacctgataccctccgactgcagcatccgcaaggagttagagctgtgttaccgaagtccaggtgaagatcagctgttctcggaattttatgtgggccacttgggctcaggaatccgcctgcaagtcaaggacaagaaggatgaaacattggtttgggaagctctggtaaaacccggtgaccttatgcctgcaacgactctaattcctcctgccagaatcgccgttccctcgccgctcgatgcaccacagctgttacattttgtcgaccagtatcgggaacaactgatagcacgcgtgacttcagtcgaggtggtactggacaaacttcacggacaagtgctgtcccaggaacaatatgagagggtgctcgccgagaataccagaccaagtcagatgagaaaactgttcagcctgtctcagagctgggataggaaatgcaaagatggcctttaccaggcccttaaggagacgcatccccaccttatcatggaactgtgggagaaagggtcaaaaaagggcttgttaccattgtcgtcatag

SEQ ID NO: 4420 - DNA, 4332 bp, Artificial Sequence
  Description of Artificial Sequence: Synthetic coding sequence
atggccggcggcgcctggggccggctggcctgctacctggagttcttaaagaaagaggagctgaaagaattccagttgctgctggccaacaaagctcacagtagaagttcttctggggaaacccccgcccagccggagaagacctctggtatggaagtggcatcgtatcttgtggcgcaatacggcgagcagagggcgtgggatctggccctgcatacgtgggaacagatggggttgcgctccctttgtgctcaggctcaggaaggagccggacacagtccgtcctttccatattcaccaagtgagccccatctgggctcgccttcccaaccgacttccacagctgtgcttatgccctggatacatgaattacccgctggctgtactcagggttctgaacgaagagtgctacgtcagctccccgacaccagcgggagacgttggcgggaaatctccgcatcgctgctctatcaggccctcccatcttctcctgatcacgagagtccttctcaggaatcaccgaacgcccccacctccacagccgtcctcgggtcctggggatcccccccgcagcccagcctcgcaccgcgggagcaggaagcacccgggacccaatggcctctggatgagaccagtggcatttattacaccgaaatccgagagcgcgagcgtgagaagagtgaaaagggaagacctccttgggctgccgtcgtcggaaccccaccccaggcacacacatcactacagccccatcatcacccttgggagcctagcgtgagggaatccctgtgctccacctggccctggaaaaacgaggacttcaatcagaaattcactcaattgcttttgctccagcgtccccaccctcgatctcaggatcccctagtcaagcggtcttggcccgattacgttgaggaaaaccgcgggcatctcattgaaatccgcgatctttttggtcctggtttggatacccaggaacctcgaatcgtgattctccagggagcagcagggatcggcaagagtaccctagctagacaagtcaaggaagcgtggggcagaggccagctttatggcgataggttccagcacgtcttctacttctcttgtcgggagctcgcccagagcaaagtggtgtcactggcagaactcatcggcaaggacgggacggctactcctgcccccatccgccaaatcctctccagacccgaacggctgctgttcatcctagacggcgttgatgagcccggctgggttctgcaggagcctagcagtgagctgtgccttcactggagtcagccacagccagctgacgcacttttgggctctttattggggaaaaccattctccctgaagcatcgttcttaataactgcccggacgaccgccttacagaacctgattccctccttggaacaggcccggtgggtggaggttttgggattctctgagtcttcaaggaaggagtatttttatcgatattttaccgatgaaagacaggccataagagcctttcgcttagtcaaatcaaataaagagctgtgggccctgtgtttagttccctgggtcagctggctggcctgcacatgtctaatgcaacagatgaagagaaaggagaaactaactctgacttctaaaaccaccactacgctttgtctccactacctggcacaggccttgcaagcgcaacctctcggcccgcagcttagggacttatgcagcttggccgctgagggtatctggcaaaaaaagaccctgttctcccctgatgacttgcggaagcacggactggatggggccatcatttccacattcctgaaaatgggcattcttcaagagcaccccatacctctgtcttatagcttcattcatctgtgttttcaggagttctttgctgccatgagctatgtcctggaggacgagaaggggagagggaaacacagcaactgtatcattgacctcgagaagacccttgaggcttatgggattcacgggctttttggcgcctcgacgaccagattcctgctgggtctgctgagtgacgaaggtgagcgtgagatggagaacattttccactgtcgtttgagtcagggacgaaacttaatgcagtgggtgccttccctgcagctactgctgcaaccacacagcctggaaagcctacattgcttgtatgagacccgaaacaagaccttccttacccaggttatggcgcatttcgaagagatgggcatgtgcgtcgagaccgatatggaactcttggtatgcactttctgtattaagttctcaaggcatgtgaagaaacttcagcttattgaaggtaggcagcacaggagcacatggagccctactatggtagtactctttcggtgggtgcctgtgactgatgcatactggcaaattttgttctcagttctgaaggtaaccaggaacttaaaagagctagatttgtcagggaactctcttagccattctgcagtgaagtccctttgcaaaaccttgagacgccctaggtgtctcctggaaacactgagactcgccggttgcggactaacagcagaggattgtaaggacctggcttttggtctcagagccaaccagaccctgacggagctagatcttagctttaacgtgttgaccgacgccggcgccaaacacttgtgtcagcgtctgaggcagccatcctgcaagctacaacggttacagttagtgagctgcgggctcaccagcgattgttgtcaggatcttgccagcgtgctgagtgctagcccgtccctgaaagagctcgatctccaacagaacaatctggacgatgtgggagtccggctgctctgcgagggcttgaggcaccctgcctgtaaactgatcagacttggaaaaccaagtgtgatgactcccacagaaggattagacaccggggaaatgagtaattcgacgtcaagtctgaagcggcagaggctcggcagtgaacgagcggcctcacatgtggctcaggcaaatctgaaactgcttgacgtgtcgaaaatctttccgattgctgagatcgcagaggagtcatccccggaggtggtgcccgtcgaactgctgtgtgtgcccagcccagcgtctcaaggcgatttgcacaccaagcccctggggactgatgacgatttttggggccctacgggccctgtggcaaccgaggtcgtcgacaaagaaaagaacttatacagagtgcacttccctgtggcaggatcgtatagatggcccaacacaggcctttgcttcgtgatgcgcgaagctgtgactgttgagatcgagttctgtgtgtgggatcagtttctgggcgaaataaacccccagcattcttggatggttgccgggccactcctcgacatcaaagccgagcccggtgcagtagaagcggtgcatctgccgcacttcgtcgcccttcagggaggccatgtggatacatctctgtttcagatggcacacttcaaagaagagggcatgctcttagaaaaaccagcccgggttgagctccatcatatcgtactcgaaaatcccagcttttctccgctgggggtattactcaagatgatacataacgccctcaggttcattcccgtgacttccgtcgtcctattgtaccaccgggtgcaccccgaggaggtgacttttcacctgtatctgatcccatccgattgttctatccgaaaggctattgatgaccttgagatgaaatttcagttcgtgaggatccacaaaccgcctcccctgactccactgtacatggggtgtcggtacacggtgtctggctccggctcaggcatgctggaaattctaccgaaggaactggaactgtgctatcggtcccctggcgaagaccagctctttagtgagttttatgtggggcaccttggtagcggcataagactgcaagtcaaagataagaaggacgaaacattagtctgggaggcactggtcaagccaggcgatcttatgccagccaccaccctgattcctcctgcccgcattgctgtcccaagtcctctggacgccccgcagctgcttcactttgtcgaccagtaccgtgagcagctgatcgctagagtcacctcagtggaggtcgtgctggacaaactccatggacaagtattgtcgcaggaacagtacgaaagagtcctcgctgaaaatacaaggcctagccagatgcgcaaactcttctcactgtcccagagctgggatcgcaagtgtaaggatgggttgtatcaagctttgaaggagacccacccacatctaattatggaactgtgggagaaagggtccaagaagggtttgctgcctctgagcagttag

SEQ ID NO: 4421 - DNA, 1527 bp, Artificial Sequence
  Description of Artificial Sequence: Synthetic coding sequence
atggcccacttcgaggagatgggcatgtgcgtggagaccgacatggaacttctcgtatgcaccttctgtatcaaattcagcagacatgttaagaagctgcagctgatcgagggcaggcagcaccgctccacctggagcccaaccatggtggtgctattccgttgggttcccgttaccgacgcatattggcagatcctcttcagcgtcctcaaggtgactagaaacctgaaagagctcgatctgtcaggaaacagcctgagtcactcagccgtaaaatctctgtgtaaaaccctgaggcgaccaagatgcctcctggagactcttaggcttgctggatgtggcctcactgcggaggattgtaaggatttggctttcggcctgcgagctaatcagaccttaaccgagcttgacttgtcttttaatgtattgaccgacgcaggcgcaaaacatctgtgccagcgactgcgccagccatcttgcaagctccaaagactccagctggttagttgtgggctgacatccgattgttgccaggatctcgcaagtgtgcttagtgcgagcccgtctctgaaggaactcgacttacagcagaataacctcgacgatgtgggagtgagacttttgtgtgaggggctgcgccacccggcatgcaagctgatacggcttggcttagaccagaccaccttgtctgatgagatgcgacaggagttacgcgccctggagcaagagaagccccagttgttaatcttcagcagacgaaagccatcagttatgacacccaccgaaggccttgacaccggggagatgtctaattcaacgagtagtctgaaacggcagcgcctaggcagcgagagagccgcttcccacgttgctcaagctaatctcaagctgcttgatgtctcgaagatatttcccatcgccgaaatagccgaggaatcttccccagaggttgttcctgtggaactactctgtgtgccctctcctgccagtcagggagacctgcacacaaagccactgggaactgatgatgacttctggggccctactggtcccgtggcaacagaggtcgtcgacaaagaaaagaatttgtatcgagtgcacttcccggtcgcgggaagttacagatggcctaacaccgggctctgtttcgtgatgagagaggccgtgactgtcgaaatcgagttttgtgtgtgggaccagttcttgggcgaaatcaatccccaacacagttggatggtggcaggcccgctcctggacatcaaggctgaaccaggtgcggtggaggccgtgcacttgcctcacttcgtggcgctgcaaggagggcacgtggacacctctttgtttcagatggcccactttaaagaggagggcatgctgctggaaaaaccagctagagtggagctgcaccatatcgtcctggaaaaccccagcttctctcctctcggggtgctgttaaagatgattcacaacgccctgcgtttcattccagttaccagtgtagtgttactgtatcatagaccatcatag

SEQ ID NO: 4422 - DNA, 4128 bp, Artificial Sequence
  Description of Artificial Sequence: Synthetic coding sequence
atggccggcggcgcctggggccggctggcctgctacctggagttcttaaaaaaggaggagttgaaagaattccagttactcctcgcaaacaaggcccactctagaagctcctccggcgagacgccagcacagccggaaaagacttctgggatggaagtggcaagctacctggtggcacagtatggtgagcagcgcgcttgggaccttgcgctgcacacttgggagcagatgggactcaggtcactttgtgcccaagcacaagagggcgccggacactccccctcgtttccttattccccaagcgaaccacatctggggagccccagtcagcccacaagcaccgccgttctgatgccctggattcatgagctcccagcgggatgcacacagggctctgagaggcgagtcctaaggcagttacccgacacatccggtcgcagatggagagagattagtgccagcctcctgtaccaggcgctgccatcatcacctgaccatgagtctccctctcaggaatccccgaatgcccctacatctacggctgttcttggcagctggggatcaccccctcaaccctccctggcccccagagaacaggaggcgcccggcacacaatggcctctggatgaaacatcaggcatttactacacagaaattagggaacgagagcgcgaaaagtccgaaaaggggaggcccccttgggctgccgtggtgggcacccctcctcaggcccatacatccctgcagccacatcatcacccgtgggaaccgtctgtgcgcgagagcttatgctccacttggccctggaagaatgaggactttaatcagaagtttactcagttactgctcctacaaagacctcaccctcgatcgcaggacccgctggtcaagagaagttggccagactatgtggaagagaaccggggacatttaatcgagattagggatctgttcggtccgggtcttgacacgcaggagccaagaatcgtaatcttgcaaggagccgcagggattgggaaatccacactggcgagacaggttaaagaagcttggggccgcggacagctttatggtgaccgcttccaacatgtgttttatttcagctgccgtgagctcgcgcagtccaaggtcgtgagcttagccgagctcatcggcaaggatggtaccgctacccctgcgcccatcagacagatattgagccgccctgaacgcttgctgtttatcttggacggtgtggacgaacctggctgggtgctgcaagagccgagctctgaactatgcctacattggtctcaaccccagcccgccgatgcgctgctgggcagtctccttggcaagaccatattgccagaagcatccttccttatcaccgccagaactacggctttgcagaatttgatccccagtctggagcaagcccgttgggtcgaggtcttagggtttagcgaatcatcacggaaagagtacttctatcggtactttaccgacgaaagacaggccatccgggcctttaggctggttaaatctaacaaagagctctgggctttgtgcctagttccatgggtgtcctggttggcatgtacatgtctgatgcagcaaatgaagcgtaaagagaagttgacacttacttctaagactacgacaacgttgtgtctgcattatctggctcaggccttgcaggcacaacctctgggccctcagttaagggacctgtgtagcctggccgctgaaggaatctggcagaagaagactctcttctctccagacgacctgcggaaacatggcctggatggcgccattataagcacgttcttgaaaatgggaatactacaggaacatcccatcccgctaagctattcattcatccatctgtgctttcaagaatttttcgccgctatgtcatacgtacttgaggatgagaagggcaggggaaagcattccaattgcattattgacctagagaaaaccttagaggcctatggcatacatggactgtttggagcctcgacaaccaggttcttgcttggacttctgtctgacgagggcgaacgggaaatggaaaacatttttcattgcaggctttcacagggaaggaatctgatgcagtgggtgcctagcttgcagcttttactccagcctcactcactggagtccctgcactgcctttatgagacccgaaataagactttcctcactcaagttatggcgcactttgaagaaatgggcatgtgtgtggagaccgacatggagctcctcgtgtgcacattctgcattaaatttagcaggcacgttaagaaacttcagcttatcgagggacgacagcacagaagtacctggtcccctacaatggtggtgctgttcagatgggttccagtgacagatgcttattggcagatcctattttctgttcttaaagtaacccggaacctaaaagagctggatctgtcagggaatagcttatcccatagcgcagttaagtccctatgtaagacccttaggcggccccgctgcttacttgaaacactgaggctcgccggatgtgggctcacagcggaagactgcaaagacctggcgttcgggctgagagccaaccagacactcaccgagctcgatctgtctttcaacgtactgacggacgccggggctaagcacctgtgtcagaggttgcggcagccatcatgcaaactccagcgcctgcagctcgtctcctgtgggttaacatcagattgctgtcaggatctagcctcggtattaagcgcttcacctagcctgaaagagttggacctgcagcaaaacaatctcgatgatgtcggggtgaggctgttgtgcgagggattaagacatccagcctgtaagctgatccgcctaggcttagatcaaaccaccctgagtgatgagatgagacaggaacttcgggctctcgagcaagagaaacctcagctgctcatttttagccggcgaaagccaagtgtgatgacaccgaccgagggcttagacaccggtgagatgtctaacagcaccagctcactgaagagacaaagattgggatctgagcgcgcggcctcccacgtggctcaggctaatcttaagctgctcgacgtgagcaaaatctttcctatcgctgaaattgctggcaaaagccatgaagagtcttctcccgaggttgtgccggtcgagcttttatgcgtgcctagcccagccagccagggcgacctccatacgaaacctcttgggacggacgatgatttttggggacccacaggccctgtcgctacagaagtggtggacaaggagaagaacctgtaccgcgttcacttcccagttgcaggatcctatcgatggcccaacacaggcctatgcttcgttatgagagaggccgttactgtggagattgagttctgtgtctgggatcagttcctgggcgagatcaatccgcagcactcttggatggtagccggcccactgttggatatcaaggctgagcccggcgccgttgaagccgttcatctgccacacttcgtcgcgcttcagggcggccacgtggacacttctctctttcagatggcccactttaaagaagaggggatgcttttggaaaaaccagccagagtcgagcttcatcatatcgtgttggagaacccttcttttagtcccctgggggtgctcctcaaaatgattcataatgccctgaggtttataccagtcacctcggtggtgctgctgtatcatcgcgttcaccctgaggaggtgaccttccacctctacttgattccctcagattgttccattcgaaaggccatagacgatctggaaatgaagtttcaatttgttcgcattcataaacccccccctctaacaccgctctatatggggtgtcgatatacagtgtcgggcagcggctctgggatgctggagatcctacccaaggaacttgagctctgctaccgcagccccggggaggaccaactgttctccgagttttacgtgggccatctgggttcaggaattaggcttcaggtgaaagataagaaggatgaaactctggtgtgggaggcacttgttaagccagggcgaaacacgagtcagccttggaacctacggtgcaaccgggacgccaggagatactag

SEQ ID NO: 4423 - DNA, 2703 bp, Artificial Sequence
  Description of Artificial Sequence: Synthetic coding sequence
atggagagctgctacaaccccggcctggacggcatcatcgagtacgatgatttcaaattaaactcatccatcgttgagcctaaagagccggcgcccgaaactgcggacggaccctatctagtgatagtggagcagcccaagcagagagggttcaggttccgctacggttgcgaaggaccctcccacggaggcctccccggggcctcttcagaaaaaggccgcaagacctatccgaccgtcaagatctgtaattacgagggacccgcaaagatcgaggtcgacctcgtcactcacagcgatccacctcgagcgcacgcacacagcctggtcggcaaacaatgctcggagttaggcatctgtgccgtgagcgtgggtccgaaagacatgaccgctcagtttaacaacctgggtgtcctccatgtcaccaaaaagaatatgatgggcacaatgattcaaaaacttcaaagacaacgactgaggtctaggcctcaagggttaacagaagctgaacaacgggagctggagcaggaggctaaagagctcaaaaaggtgatggatttatcgatagtgcgactgagattcagcgcattcctcagagcctccgacggatcttttagcctgccactgaaaccagtgatcagtcagcccatacacgactccaagagtcctggcgcctcgaaccttaaaatctcacgcatggacaagactgctggcagcgttcggggaggggatgaagtttatctgctgtgtgacaaagtccagaaggacgatatcgaggtgaggttttatgaagatgacgaaaatggttggcaggccttcggggacttctcccctaccgatgtacacaagcagtatgcaattgtgttccgcacaccaccttaccataaaatgaaaattgagcgccctgtcacggtgttcctgcagctcaagagaaagcgtggtggtgatgtgtcagacagcaaacaattcacgtactaccccttggtggaggataaggaagaagtccagcgaaaacgacggaaggccctgccaacttttagccagccattcggaggcggctcacatatgggaggaggctctggaggagctgcaggggggtatggaggagcggggggcgggggttccctgggcttcttcccctctagcctggcatacagcccttatcaaagcggggccggccccatgggatgttaccctggagggggagggggcgcccagatggcagctaccgtgcccagccgcgattctggcgaggaagcggctgaaccctccgcacccagccgtactccacagtgcgaaccacaagcccccgagatgttgcaaagggcccgcgagtacaatgcacggctgttcggactggcacagcggtcagcacgtgctctgctggactacggggtgacagccgacgctcgcgcactactggccggtcagagacatctcttaactgcccaggacgagaacggggacacacctcttcatctagctatcatacacggccagacaagtgtaattgagcagatagtatacgtaattcatcacgcacaggacctaggagtggtcaaccttactaatcacctccaccagacgcccctgcatttagctgtgatcaccggtcagaccagcgtcgtctccttcctcctgagagtaggcgcagatcctgccctactggatcgacatggggatagcgctatgcacctcgccctgcgtgccggtgccggggcccccgagttgttgcgggccctgttacagtcaggtgcccccgccgtgccccaactgctgcacatgcccgactttgagggcctgtatccagtgcacctggcagttagggcccggtcgcctgagtgtcttgatctcttggtcgactctggcgcagaggtggaagcgacagagagacagggaggcaggaccgctctgcacttggcgaccgaaatggaggaacttggcctggtgacccatttggtgaccaagctgagagccaatgtcaacgcgcggacttttgccgggaatacgccgctccatttagctgccgggttgggctacccaactctgactaggctcctgctgaaagctggggccgacattcacgccgagaatgaggaaccactttgccccttaccctcccccccaaccagcgactccgactcggattctgagggacccgaaaaagataccaggagttccttccggggtcacacccccctcgacctgacctgcagcactaaagtgaagaccttgctgctgaatgccgctcaaaacaccatggagccccccctcacccccccttctcctgctgggcccggcctgagcttaggggacacagctctgcagaacctcgagcagctcctggacgggcccgaggcccaaggcagctgggctgagctcgcagagcgactaggcctgcgctcgctggtcgacacctatcgacaaaccacttcaccctctggcagtctgctacgctcctatgaattagccggaggggatctggcgggtctactcgaagccctttcagacatgggtctagaggagggcgtgagattgttaagaggaccggagactagggataagttgccaagcacggcagaggtgaaagaagattcagcatacggctcacagagtgttgaacaggaggctgaaaagctcggccctcctccagaacccccgggcggcttgtgtcatgggcaccctcagccacaggtgcattag

SEQ ID NO: 4424 - DNA, 2700 bp, Artificial Sequence
  Description of Artificial Sequence: Synthetic coding sequence
atggagagctgctacaaccccggcctggacggcatcatcgagtacgatgatttcaaattgaatagctcaatcgtggagcccaaggagcccgcacccgagaccgccgacggaccttatctggtgattgtcgaacagccgaagcagcgcgggtttcggttccgctatgggtgtgaaggccccagccatggtggcctgccaggggcgtcaagtgaaaaaggaaggaaaacctaccctactgtcaagatatgtaattatgaaggccccgccaaaatcgaggtggatcttgtgacccactcggatcctccacgcgcccatgctcactccctggtcggaaaacagtgttcggaacttggcatttgtgcggtgagtgtgggtccgaaagatatgactgcccagtttaacaacctaggggtgcttcatgtcacgaagaaaaatatgatgggtactatgattcaaaagttgcagagacagaggcttcgctcaaggcctcagggactgaccgaggctgaacagcgtgagttggagcaagaggccaaggagctgaagaaggtcatggacttatctatagtgcggctgaggttctccgccttcctacgagctagcgacgggtcttttagcctacctctgaagccagtgatcagtcagccgatccacgattccaaatctcccggggcctcaaatctaaagatctccagaatggataagaccgctggcagcgtacggggaggcgacgaagtgtacctgctgtgcgataaagtccaaaaagatgatatcgaggtcagattttacgaagacgacgaaaacggttggcaggccttcggggacttctcccctaccgacgtccataaacagtacgcgatagtgtttaggacccccccctaccacaagatgaaaattgagcggcctgttactgtattcttacagttaaaaaggaagagagggggggatgtgtccgattctaagcagttcacctactacccccttgtagaagataaggaagaggtgcagcgaaagagacgaaaagcactgccaacattctcacagcctttcggtggaggcagccacatggggggggggtctgggggagctgcgggaggatatgggggagctggcggaggcgggtctcttggcttcttccccagtagcctggcatattccccttaccagagtggtgctgggcccatggggtgctaccctggaggaggcggtggcgcacagatggccgctaccgtgccatcccgggactctggggaggaggccgccgagccaagtgcacccagcagaactccacagtgcgaacctcaagcccccgaaatgcttcaacgggcccgggaatataatgctcgattattcgggctggcccagaggagcgcgagggctttgctggactatggcgtcactgccgacgcacgagcactgttggccggccaaaggcacctgctgaccgcacaagacgagaacggcgacacccctcttcacctggccatcattcacggccaaacgtctgtgatcgagcagatcgtttatgtcatccaccacgctcaggacttgggggtggtgaacctgaccaaccaccttcaccagacaccccttcacctagcagttatcaccggtcaaacatcagtggtaagttttttactgcgcgtgggcgctgaccctgcactgctggacaggcacggagattctgctatgcacttggcacttagggctggggctggagcgccagaattattacgggccctgctccagagcggtgccccagcggtgccacagctgctccatatgccagatttcgaaggcctctatccggttcatctcgccgtacgggccagaagccctgagtgcctcgaccttctggtagattctggagctgaggtggaggccaccgagaggcaaggtggaagaaccgcactacacctggccacggaaatggaggagctcggcttggtcacccatttggtaacaaagctcagagcgaacgttaatgcgcgtacttttgccgggaacacgcccctgcaccttgctgccggcctagggtatccaacgctgactcgactcctgctgaaggccggtgctgacatccacgcagagaatgaagagcccctgtgtccgctcccctctccccctacaagtgatagtgactctgattctgagggacccgaaaaagataccagatcctcctttcgcgggcacactcccctggacctcacttgtagtacaaaggtgaaaaccttattgttaaacgctgcacaaaatactatggaacctcccctaacgcctccctctcctgcaggcccaggcctgtcgctgggcgacacagccctccagaacttagagcaacttcttgatggtccggaggcccagggcagctgggccgaactggcagagcggctggggctgcgctccctcgtcgacacctaccggcagacgaccagtccgtcaggttctcttttgcggagttatgagctagctggaggcgacttggcggggctcctggaggccttatcagacatgggtttagaggagggggtcaggctgctgcgagggccagaaacaagggacaaactcccatccaccgaggttaaagaagacagcgcctatgggtcccagagcgtagagcaggaagccgaaaagctgggcccccccccagagccaccgggtggactgtgccatggccatcctcaaccacaagttcactag

SEQ ID NO: 4425 - DNA, 2703 bp, Artificial Sequence
  Description of Artificial Sequence: Synthetic coding sequence
atggagagctgctacaaccccggcctggacggcatcatcgagtacgatgacttcaaactgaatagctctattgtagagcccaaagagcctgccccagaaactgcggacggcccctatctcgtaattgttgaacagcctaagcagaggggctttagattccgctatggatgtgaaggcccgtcccatggtggcctgcctggcgcctcctcagaaaagggcagaaaaacctatcccacagtcaaaatttgtaattatgagggccctgctaagattgaggtggaccttgtgacccacagtgacccacctcgagcccatgcccacagtttggtcggaaagcagtgctccgaactgggaatatgtgctgtctccgtcgggccgaaagatatgaccgctcaattcaacaacttgggcgtcctccatgtaactaagaagaatatgatgggcactatgattcagaagctccagcgacagcggctcaggtccagaccacagggcctgacagaggcggaacaacgggaattggagcaggaagctaaggaactgaagaaagttatggatctgtctattgtgcgcctgagatttagcgccttcctgcgagcctctgacggatcattctccctcccactgaagcctgttatatcccagccaatacacgattctaagtcacccggggctagcaatctgaagatttctagaatggacaagacagccggcagcgtgagaggcggcgacgaggtgtatctgctttgcgataaggtccagaaggacgacattgaagtacgcttctacgaagatgacgaaaacgggtggcaggcttttggggatttttctccaacagatgtgcataagcagtacgcaatagtgtttcgcacacccccgtatcacaagatgaaaatagagcgccctgtgactgtgtttcttcaacttaagcgaaaacgcggaggagatgtctcagactctaagcagttcacatattatcccctggtggaggataaggaggaggttcagcggaaaagacgcaaggcactaccaactttctcacaaccttttggagggggttctcacatgggcgggggatccgggggcgcagccggcggctatggcggggctggcggcggaggctcactcgggttttttccttcaagcctggcgtactcaccgtaccagtccggtgcggggcctatgggctgctacccaggtggcggtggaggagcacagatggccgcaacagtgccgtcaagggatagcggcgaggaggccgcagagccatcagccccttctcgcaccccacagtgtgagcctcaggcacctgaaatgcttcaacgcgccagagagtataacgcgcgcctgttcgggctggcacagaggtcagcccgggctcttcttgattacggggtaaccgctgatgcccgcgcactactggccggtcagcggcatctcctgacagcccaggatgagaatggagatactcccctccatcttgccatcattcacggtcagacctctgttattgaacagatcgtctacgtcattcatcacgctcaggacttgggagtagttaacctaaccaatcatttgcaccagactccactgcatctggccgtcattacaggacagactagcgtggtgtcctttttgctgcgagttggggcggatcctgcactgttagatcgtcacggggatagcgcgatgcacctggctctgagggccggggccggagcacctgagctcctcagggccctcttacagtccggagcgcctgcggtgccacagctgcttcatatgcctgactttgagggcttgtatcccgttcatttggccgttcgggcccgcagccccgaatgccttgatctattagtggattccggcgcagaggtggaagcaacagaacgtcaaggcggcagaacagccctgcatctagctacagagatggaggagctgggcctggtgacccacctggtgacaaaactccgtgcaaatgtgaacgcacggacatttgcaggcaacactccattgcatttagcggccggactcggctaccccactcttacgcgcttgctgctcaaggcaggagccgatatacacgcagagaacgaggaaccgctgtgtcctctcccctcacctccaaccagtgatagcgacagtgactctgagggaccggaaaaagatacccggtcctccttcagaggccacaccccgctggatctgacctgtagcacaaaagtcaaaacgctgctgcttaacgccgctcaaaatactatggaacctcctctgacccctccctctcctgcaggcccagggctatctctgggtgacactgcactccaaaacttagagcagctcttagacggacccgaagcacaggggtcctgggccgaattagcggaaagacttggcctaaggagcctagtggacacatatagacagacaactagcccaagcggatcactgttgcggagttacgagctcgccggcggcgaccttgctggccttctcgaagccctgagcgacatgggcctggaagagggggtgcggctgctgcgggggccagagacaagggacaagcttccttccaccgctgaggtcaaggaggatagcgcatatgggagccagtcagtggagcaagaggcggaaaagctcgggccaccccccgagccacccggaggcttgtgccatggacacccgcagccacaagtccactag

SEQ ID NO: 4426 - DNA, 2700 bp, Artificial Sequence
  Description of Artificial Sequence: Synthetic coding sequence
atggagagctgctacaaccccggcctggacggcatcatcgagtacgacgattttaagttgaatagcagcattgttgagccgaaagagcccgcgcctgaaaccgctgatggcccttacctagtcatagtcgaacagccaaaacagcgggggttccgatttaggtacggctgcgagggcccaagtcacggcggcctccccggggcctctagcgaaaaaggtaggaagacttatccgacggtcaaaatctgcaactacgaggggcccgctaaaattgaggtggatcttgtgacgcactccgatcccccccgcgcccatgctcatagtctcgtgggcaaacagtgcagtgagctcggcatttgtgctgtctctgtgggtcctaaagacatgaccgcccagtttaataacttaggagtgctgcacgtcaccaaaaagaacatgatgggtaccatgattcagaagctccaacggcaacgactcaggtcaagaccccaggggctcaccgaggctgagcagagagagttggagcaggaggccaaagagttaaagaaggtgatggatctgagtatcgtccgtttgagatttagcgcattcctgagagcaagcgatggaagcttctccctgccgctgaaaccggtaattagtcaaccgatccatgatagcaaatctcctggcgcttcgaacctgaagatcagcagaatggacaaaacagcaggctctgtgcgcggaggtgatgaggtttatttgctgtgcgataaggttcaaaaagatgacatcgaagtgagattttatgaggacgacgagaatggctggcaggcattcggagacttctcacctaccgatgtgcacaagcaatacgcaatcgttttccgtacccccccctatcacaaaatgaagatcgagaggcccgtcactgtgtttctgcagctgaaacgcaagaggggtggagacgtgtccgactctaaacaatttacatattatcctcttgtggaagacaaggaagaggtccagagaaaacgcaggaaggctctccccacattttcgcaaccgtttgggggcggcagtcatatgggtggcggaagtggaggagctgctgggggatatggcggggccggcggggggggctctttggggttttttccctcctctctagcctacagtccttatcaatcgggcgccgggcctatgggatgctatcccggcggaggcggcggggcacagatggcagccacagttccgagtcgggattccggcgaagaagcagcagagccctcagccccttcgaggacaccacagtgtgaaccgcaggcccctgagatgctgcagagagcccgagagtacaatgcccgcctgtttggactggcacaacgttcagctcgggccctgctcgattatggcgtgacagccgacgctcgggcccttcttgccggtcaacggcatctgctgaccgctcaggacgagaacggggacacccccttacatctggccataatccatggtcagacctctgttattgaacaaatcgtgtacgtgatacatcacgcccaggatctaggtgtcgttaacctcacaaatcacttgcaccaaactccgctgcacctggccgttatcaccgggcagacctccgtggtttctttccttctcagagttggtgctgatcccgccctcctggacagacacggggacagcgcaatgcacctggctctgcgggcaggtgcaggagctcctgaacttctgagggccctgcttcagagcggcgcgcccgcggtgccacagcttctacacatgcctgactttgagggactgtatccggtgcacttggcagttcgagcacggagtcccgaatgcctagatttgctggttgatagtggagccgaggtcgaggcgactgaacgccaggggggtaggacagccttacatctggcaacagagatggaggagctaggcttggtgacacacctggttaccaaactcagagcaaatgtcaatgcccgcacttttgcaggaaatacgcccttgcacttagccgccggcctgggatatcctactctgactaggctcctcttgaaagctggtgccgatatccatgccgagaacgaggagcccctgtgcccattaccctctcctcctactagcgatagcgactctgacagtgaggggccagagaaagacactcggagctcctttaggggccacacgccactcgatctcacgtgtagcactaaggtgaaaacacttcttttgaatgccgcccagaatacaatggaaccaccgctaactcccccaagtccagccggacccggtttgagcctcggagacactgcgctccagaacctggaacagctcttggatggccccgaggcacaggggtcctgggccgagctggccgagaggctggggttgagatctctcgtagatacatatcggcaaacgactagtccctcggggtcactcctgcggtcatacgagttggcaggcggcgatctggctggcctattggaggccctttctgacatgggcctggaggagggagtccggttgcttagaggaccggagactcgcgataaactccccagcaccgaggtgaaagaggatagtgcctacggtagtcaaagcgtcgaacaggaggccgaaaaacttggacctcctcccgagccacctggcggcttgtgccatggccaccctcagcctcaggttcactag

SEQ ID NO: 4427 - DNA, 804 bp, Artificial Sequence
  Description of Artificial Sequence: Synthetic coding sequence
atgccccgggccttcctggtgaagaagccctgcgtgagcacctgcaaacgaaactggtctgagctgcccgatgaggaacggggcgagatttatgtgcctgtcagcttaggattctgtcctccccagccatacagggagccagaacccagtgtcgcagagccaccttcgtgtcctctggccctgaatatgtctctgcgcgactccagctatagtatggctccaggaccatgtgtggtcgctcagctgccctccgaagacatgggccatctgacagatccccaaagccgagatcacggattcctccgtaccaagatgaaggtgacactaggtgatagtccgagtggcgatctctttacctgccgagtgtgtcaaaaggcttttacctatcagagaatgctgaaccgccatatgaaatgtcacaatgacgtcaagagacatctgtgtacatattgtgggaagggctttaacgacaccttcgatctcaagcgccacgttcgcacccacaccggggtgcggccttacaagtgcagcctgtgtgataaagcctttacccagcgctgcagtctggaatcccacctgaaaaagattcacggagtgcagcagaaatatgcgtataaagagaggcgcgccaagctgtatgtgtgtgaggaatgtggttgcaccagcgagtcacaagaggggcatgttctccatctgaaagagcaccaccccgattctcctctactccggaagacctctaagaaggttgcagtcgcactccagaacacagtcacatcgcttctgcaggggtcaccacacttgtag

SEQ ID NO: 4428 - DNA, 1095 bp, Artificial Sequence
  Description of Artificial Sequence: Synthetic coding sequence
atgcaccggctgatcttcgtgtacaccctgatctgcgccaacttctgtagttgtagggatacctctgctacaccgcagagcgcctccatcaaagctctgaggaacgctaatctccgacgtgacgatttataccgtagagatgagaccatacaggtgaagggcaacggttacgtgcagtccccgcggttccctaattcatatcctagaaacctattgcttacctggcgactacactcacaggaaaacacccgaatccagctcgtgtttgacaatcagttcggtttggaagaagctgagaacgacatttgcagatacgatttcgtcgaagtggaggacatcagcgaaacttctactattatccgaggtagatggtgcgggcacaaggaggtcccaccccgtatcaaaagccgtaccaatcagataaaaatcacattcaagagcgatgactactttgtcgccaaaccagggttcaaaatttactactctctgctagaggacttccaaccagccgccgctagcgaaactaactgggaatccgtgacatcttctatcagcggcgtttcctacaactctccgagtgtaactgatcccaccctgatcgccgatgctctcgacaaaaagatagcagagtttgatactgtcgaagatttacttaaatattttaaccccgaaagttggcaggaagacctggagaatatgtacctcgacacacctcggtaccggggacgcagctaccatgaccgtaagagcaaggtcgatcttgaccggttgaacgacgatgccaagcgctattcctgtaccccccgcaactactctgtgaatatcagagaggagctgaagcttgccaatgtagtgttttttccacgatgtctgttggtgcaaaggtgtggcggcaattgcggatgtggcactgtgaactggcggagctgtacttgcaattctggcaagacagtgaaaaaataccacgaggtgctccagtttgaaccaggccatatcaaaaggcggggaagggctaagacaatggcactggtagatatccagctggatcatcacgagcgctgcgactgtatttgcagtagccgccccccccgctag

SEQ ID NO: 4429 - DNA, 1113 bp, Artificial Sequence
  Description of Artificial Sequence: Synthetic coding sequence
atgcaccggctgatcttcgtgtacaccctgatctgcgccaacttctgctcttgccgtgatacctccgcgaccccccagtccgcgagcataaaggccctccgtaatgccaacctgagaagggatgagagcaaccacctgacagacttatatcgtcgtgatgaaacgatacaggtcaagggcaatggatacgtacagtcacctcggttcccaaatagttatccgcgcaatttactgctgacgtggagactccacagccaggagaacactcggatccagttggttttcgacaaccaatttggattggaagaggctgaaaatgatatttgtcgatacgattttgttgaggtcgaggacataagtgagacctccaccatcattcggggcagatggtgcgggcataaggaagtgcctccacgtattaaatctaggacgaaccagataaaaatcaccttcaagtcagatgattatttcgtcgcaaaacccggcttcaaaatttattacagcctattagaagattttcagcctgctgcagcctctgagactaattgggaatcagtgacctcgtcgatttctggagtcagttataacagcccatccgtgaccgacccaactctgatcgccgatgccctcgacaaaaaaatagcggaatttgatacggttgaggatctgctcaaatatttcaaccccgaatcgtggcaggaggacctggagaacatgtacctggacaccccgcggtaccggggccgatcataccacgacagaaaatccaaagttgacctcgatcgcctgaacgacgatgccaaaagatattcatgcacaccccgcaactattctgtaaacatccgcgaagaactcaagttggccaacgtcgtcttcttcccacggtgcttactggttcaacggtgcggggggaattgtggctgtggcacagtgaactggcgttcttgcacctgcaattctggaaaaactgttaagaagtaccatgaagtgttacagtttgagccggggcacatcaagcgccggggacgggctaagaccatggctttggtcgacatccagctagaccatcatgagagatgcgattgtatctgttcctcacggccccccaggtag

SEQ ID NO: 4430 - DNA, 726 bp, Artificial Sequence
  Description of Artificial Sequence: Synthetic coding sequence
atgaaccggtgctgggccctgttcctgagcctgtgctgctacctgcggctggtgtctgccgaaggggaccccattccagaggagctctacgagatgctttccgatcattctatccggtcgttcgatgacctgcagcgtctactgcatggagaccccggcgaggaagatggcgccgagttggatctgaatatgactcgttcacattctgggggtgaactggagagtctcgcacgcggtaggcggtccctcggcagcttaaccatcgcagagcccgccatgattgccgagtgcaaaacacggaccgaagtcttcgaaatctcacgcaggctgattgatcggactaatgccaacttcctggtctggccgccctgcgttgaggtgcaacgctgctcagggtgctgcaacaatcgcaacgtgcagtgccgccccacccaggtgcagctcaggcctgtgcaggttcgcaagatcgagatcgtgagaaagaagcccattttcaaaaaggcaaccgtgacactggaggatcacttggcctgtaagtgcgagacagttgcggctgctcggcccgtcacaaggagtccaggcggatcccaggaacagagagcaaagaccccacagactcgtgtgacgattcgaaccgtccgcgtgcgccgcccacccaagggtaaacaccggaagtttaaacatacacacgataagacagccttgaaggaaactctcggcgcgtag

SEQ ID NO: 4431 - DNA, 681 bp, Artificial Sequence
  Description of Artificial Sequence: Synthetic coding sequence
atgttcatcatgggcctgggcgaccccatccccgaggagctgtacgaaatgctgagcgaccactccatccgaagttttgacgatctccagaggttgctgcacggcgatcccggagaggaggacggagccgaactagatctgaacatgactcgttctcatagtggcggcgaactggagtctctcgcccgaggaagacgctctttaggttctctgacaatcgctgagcccgccatgattgccgaatgtaagacacgcacagaagtgttcgaaatatcaaggagactgatcgaccgaaccaacgcaaatttcctggtgtggcctccttgcgtcgaagtgcaacgatgtagcggctgttgcaacaatcgcaatgtgcagtgtcgccccactcaggtgcagctgcgtcctgtgcaggtcaggaaaatcgagatcgttagaaagaaaccgattttcaagaaggccacagtgactcttgaagatcatctcgcctgcaaatgtgagacagtcgctgccgcacgtcccgtaacccgaagcccaggaggcagccaggagcaacgggctaagactccccagacgcgagtgacaatcaggacagtaagggtgaggagaccgccaaaaggaaagcaccggaagtttaaacacacacacgataagaccgcactgaaagaaacactgggtgcatag

SEQ ID NO: 4432 - DNA, 411 bp, Artificial Sequence
  Description of Artificial Sequence: Synthetic coding sequence
atgctgagcgaccacagcatccggagcttcgacgacctgcagcggctgctgcacggggaccccggtgaggaagatggcgcggagctggacctgaacatgacgaggtcccattcggggggagagctggagtctctagcccgcggaagaagaagtttggggtctctgacaatcgcggaacccgccatgatagcagagtgcaagacacgcaccgaggtatttgagatctcccggcgcctgatcgataggaccaacgcaaacttcctggtgtggcccccatgcgtagaagtgcaaagatgctcggggtgctgcaataaccgaaacgttcagtgtaggcccactcaagtgcagctaaggcccgtccaggtacgcaagattgaaattgtgaggaaaaagccgatttttaaaaaatag

SEQ ID NO: 4433 - DNA, 435 bp, Artificial Sequence
  Description of Artificial Sequence: Synthetic coding sequence
atgctgagcgaccacagcatccggagcttcgacgacctgcagcggttgctacatggcgacccaggtgaggaagacggggcagagctggacctgaacatgacacggtcccattccggaggtgagcttgagagcctcgccagagggcgccgttctcttggttctctgacaattgcggagcctgcaatgattgcagagtgcaagacgcgtacagaagtgttcgagatttccaggcgtctgatagatcggacaaatgctaactttttggtctggccaccctgcgtggaagtgcagcgatgttcaggctgttgcaacaaccgaaatgtccaatgccggcctactcaggtgcaactcaggccagtgcaggttcgtaagattgagatcgtcaggaagaaaccaatttttaagaaggccactgtcacgctcgaagaccattag

SEQ ID NO: 4434 - DNA, 804 bp, Artificial Sequence
  Description of Artificial Sequence: Synthetic coding sequence
atgccccggagctgctgcagccggagcggcgccctgctgctggccctgcttcttcaggcctccatggaagtgagggggtggtgcctagagtcatcacagtgtcaggacttgacaaccgagagtaacctgcttgagtgtattagggcctgtaagcccgatctgtccgccgagacacccatgttccctggtaacggcgacgagcagccacttactgagaacccacgaaagtatgtcatgggacacttcagatgggaccggtttggccggcggaacagcagtagctccggttccagcggtgccggccagaagagggaggatgtgagcgcaggagaggactgcggtccgctccctgaaggagggcctgagcctcggagcgatggggctaaacccggaccacgtgaaggaaagcgctcttatagtatggagcacttccgctgggggaagccggtaggaaaaaagcggcgtcctgtgaaggtttatcccaacggtgctgaggatgagtctgctgaagccttcccactggagttcaagagggagctgactggacagcgattacgcgaaggagacggcccagacggacccgctgatgacggggctggggcccaagcagatcttgaacactccctattggtcgcggccgaaaaaaaggacgaggggccctatcggatggagcactttcggtggggcagcccccctaaagataagcggtacgggggattcatgactagcgagaaaagccagacccccctggttactctgttcaaaaatgccataatcaagaacgcctacaagaagggtgaatag

SEQ ID NO: 4435 - DNA, 804 bp, Artificial Sequence
  Description of Artificial Sequence: Synthetic coding sequence
atgccccggagctgctgcagccggagcggcgccctgctgctggccctgttactccaagcaagtatggaggttcgggggtggtgccttgagtcctctcagtgccaggatcttacaaccgagtccaaccttctggagtgcatcagagcatgcaaacccgatctttcggccgagacacctatgttccccggaaacggtgatgaacagcctctcacggaaaacccacggaaatatgtgatgggacattttagatgggacaggtttggaaggagaaattcaagttcttccggcagctcgggcgccggacagaaaagagaagacgtgtcagcaggcgaggactgtggcccgctccccgaaggcggccctgagccccgttccgatggcgccaagccagggcctcgcgaggggaaaagatcatattccatggagcattttcggtgggggaaacccgtggggaagaagcgccggccagtgaaagtataccctaatggggccgaggacgaatctgctgaagcctttccgctggagtttaagcgcgagcttaccggtcagaggctgcgcgaaggagacgggccagacgggcccgccgatgacggcgccggagcccaagccgacctggagcatagcctgctggtcgccgccgagaagaaggacgagggtccatatcggatggagcactttaggtggggatctccgccaaaagataaaaggtatggcgggttcatgacgtcggagaagagccagacacctctggttaccttattcaagaatgcaattatcaagaacgcgtataagaaaggagagtag

SEQ ID NO: 4436 - DNA, 804 bp, Artificial Sequence
  Description of Artificial Sequence: Synthetic coding sequence
atgccccggagctgctgcagccggagcggcgccctgctgctggccctcctgctgcaggcgtccatggaggttcgcggatggtgcttagagagcagtcagtgtcaagacctgactactgagtcaaacctgttggaatgcattcgggcctgcaagccggacctctcagccgagacacctatgttcccagggaatggtgatgagcagccacttacagaaaacccacggaaatacgtaatggggcatttccgctgggatcggttcggacggcgcaactcttcttccagtgggagctcaggagccggccaaaagagagaagatgtctcggccggcgaggactgcggccctctgccagaaggcggccccgaacctcgcagtgacggtgcgaagcctggtcccagggagggaaaacgctcatattcaatggagcatttcagatgggggaagcccgtcgggaagaaacggcggcccgtgaaagtttaccctaatggtgccgaggacgaatctgctgaggcctttcctctggagtttaagagggaactcacaggacaaaggctgcgcgagggcgacggccctgatggacccgctgacgatggggctggagcccaggccgacctggagcatagcctgctggtggcggccgaaaaaaaggacgaaggtccgtaccgcatggagcactttcgctgggggtctcccccaaaggataaacggtacgggggctttatgacctctgagaaatcccagacccctttagtgaccctgtttaaaaacgcgattatcaaaaatgcctacaagaagggggagtag

SEQ ID NO: 4437 - DNA, 804 bp, Artificial Sequence
  Description of Artificial Sequence: Synthetic coding sequence
atgccccggagctgctgcagccggagcggcgccctgctgctggccctactgctgcaggccagcatggaggtaagaggatggtgtttagaatcatcccagtgtcaggatcttaccacggagagcaatctgttggagtgcatccgagcttgcaagcctgatctcagcgcagaaacccctatgtttcctggcaatggtgatgagcagccccttactgagaatcctcgcaaatacgtaatggggcacttccgctgggatcgcttcgggcgccggaactccagctcgagcggctcaagcggggcggggcagaagcgagaagacgtctcagccggagaagactgtgggcctttgcctgaaggaggccccgagccaaggagcgatggcgcgaaacccgggccacgcgagggaaaaaggagctacagcatggaacacttccgctggggcaagccggttggaaagaaaagaagaccagtgaaggtgtatcccaatggcgcggaggacgaatctgctgaggccttcccattagagtttaaacgcgagcttacaggccagagactgcgcgaaggagatggcccagatgggccggcggacgacggcgctggcgcgcaggcagatcttgagcactcacttctggttgcagccgagaagaaagatgagggaccctataggatggagcactttcggtggggaagtccccctaaggataaacgatacggagggtttatgacctcagagaaatctcagaccccccttgtgactctgtttaaaaatgctattattaaaaatgcatacaaaaaaggggaatag

SEQ ID NO: 4438 - DNA, 741 bp, Artificial Sequence
  Description of Artificial Sequence: Synthetic coding sequence
atgccccggagctgctgcagccggagcggcgccctgctgctggccctgttactccaggccagtatggaagtaagagggtggtgtctggaaagctctcagtgccaggatctaacaactgagtctaacctcctggagtgcattcgagcctgtaaaccggacctgagcgccgaaaccccaatgtttccaggcaatggcgatgagcaacctctgacagaaaatccccggaagtacgtcatgggccactttagatgggatagattcgggcgcagaaattcttcctctagtggatcttccggtgcaggccagaagcgagaggacgtgtccgctggggaagactgcgggccactgcccgaagggggcccggaaccacggtctgatggcgcaaagccagggccacgggagggaaagagaagctactccatggagcacttccgttggggcaagcccgtcgggaagaagagacgccctgtcaaggtgtatcctaacggagccgaggacgagagcgctgaggcgtttcccctcgagtttaagcgggaactgacagggcagaggttgagggaaggggatggcccagacggacccgctgacgatggagccggcgcacaggctgacctcgagcactccctactggttgccgccgagaagaaggacgagggcccttacaggatggagcatttccggtgggggagccccccgaaagacaaaagatatgggggctttatgacaagcgaaaagagctag

SEQ ID NO: 4439 - DNA, 459 bp, Artificial Sequence
  Description of Artificial Sequence: Synthetic coding sequence
atgacctgcaccgaccagaagagccacagccagcgggccctgggcactcaaacccccgccttgcagggcccacagttactgaatactgatcctagttcagaagagacgaggcccccgcacgtaaatcctgacagactttgtcacatggaacctgccaatcacttctggcatgcaggagacctccaggccatgattagtaaagagttccatcttgcggcaacccaggacgattgccgtaagggaaggacccaggaggatattcttgtgccgtcttctcatcctgagttatttgcaagtgtgctgccaatggcacccgaggaagccgcacgactccaacagccacaacccttgcccccaccgtcggggatccacctatcagccagcaggacgcttgcacccaccctgctctattctagccctccaagccactctccattcggactgagttcactcatttag

SEQ ID NO: 4440 - DNA, 315 bp, Artificial Sequence
  Description of Artificial Sequence: Synthetic coding sequence
atggagcccgccaaccacttctggcacgccggcgacctgcaggccatgatctccaaagaatttcatctggcagcaacacaggatgactgtaggaaaggccgcacgcaggaagacatcctggtgcccagctcccatccagagctctttgcttctgtgctgcctatggctcccgaggaagccgcccggctgcagcagccccagccacttcctcctcccagtgggattcacctgtctgctagtcggactttggccttgactctgttgtactcatcccccccttcccatagtccattcggacttagttcgttgatctag

SEQ ID NO: 4441 - DNA, 459 bp, Artificial Sequence
  Description of Artificial Sequence: Synthetic coding sequence
atgacctgcaccgaccagaagagccacagccagcgggccctgggcactcagaccccagcactccagggaccccagctgctgaacacggaccctagctctgaggaaacccggccccctcatgtgaatccagatcggctgtgccatatggagcctgcgaaccatttttggcatgccggagacctccaggctatgatctctaaggaattccatctggccgccacgcaggatgactgcagaaaaggcaggacccaggaagatattctggtgcccagcagccacccagagctgtttgcttcagtcttgccaatggccccggaagaagccgctcgccttcaacaaccgcaaccattgcctcctccaagtgggatccacctgagtgcctctagaactttagccccaacactactgtatagcagcccgcccagccactcccccttcggcctctctagcctgatctag

SEQ ID NO: 4442 - DNA, 459 bp, Artificial Sequence
  Description of Artificial Sequence: Synthetic coding sequence
atgacctgcaccgaccagaagagccacagccagcgggccctgggcacacagactcctgccctgcagggccctcaactgctcaacacggacccaagctccaaggagactcgccctccacatgtgaatcccgacagactatgccatatggagccagcaaaccatttctggcacgccggagacctgcaagccatgatctcaaaagaattccacctcgccgcaacccaggatgactgccgaaagggccgcacacaggaagacatcctggtgccctcaagccatcccgaactgttcgcgagcgtacttcctatggctccagaagaagctgccagacttcagcaaccacagcctctgccccctccttccggcattcacttgagtgcatccagaactcttgcccctaccctcttgtattcctccccaccttctcatagcccttttggcctcagttcacttatatag

SEQ ID NO: 4443 - DNA, 459 bp, Artificial Sequence
  Description of Artificial Sequence: Synthetic coding sequence
atgacctgcaccgaccagaagagccacagccagcgggccctgggcacccagacgccagcccttcagggaccccagctactcaacactgatccgagttcagaggaaacccgacctccccacgtcaatcctgacaggctgtgccatatggaacctgctaatcatttctggcacgcaggagacttgcaggcaatgatttctaaagaattccatctagccgcaacacaggacgattgtcgcaaaggcaggacacaggaggacatcctggtgccctcatcacaccccgagctcttcgcaagcgtcctgcctatggcccctgaggaggcggcgcgactccaacagccgcaacccctgcctcctcccagtggcatccacctaagtgctagcagaactttagctcctaccctgctgtacagctcccccccttctcacagtccttttggtttgtcctccctaatttag

SEQ ID NO: 4444 - DNA, 459 bp, Artificial Sequence
  Description of Artificial Sequence: Synthetic coding sequence
atgacctgcaccgaccagaagagccacagccagcgggccctgggcacacagactcccgcactccaaggaccgcagttactgaacacagatcccagctccgaggagaccaggcctccacatgtcaaccccgatagactttgccatatggagcccgcaaaccacttttggcatgctggcgatctccaagccatgatttcaaaagagtttcacctggctgcaacacaagacgattgccgaaagggaaggacacaggaggatattctggtgccatcctcgcaccctgagctgtttgcgtcagtcctgccaatggcgcccgaggaagctgcaagactccaacagccccagccactaccaccaccctccggcatccatttaagtgcgagcaggacattggccccaactttactgtattcttccccacccagccactcaccatttgggctgtctagcttaatttag

SEQ ID NO: 4445 - DNA, 453 bp, Artificial Sequence
  Description of Artificial Sequence: Synthetic coding sequence
ccccagaccgaccagaagagccacagccagcgggccctgggcacccaaacaccggcgctgcagggaccgcagctgctgaatactgatccaagctctgaagagacccatccacacgttaacccggatcggctgtgtcatatggagcccgctaatcacttctggcatgccggtgatctgcaggccatgatatccaaagagttccacctagcagcgacacaggatgactgtagaaagggaagaacccaggaggatatccttgtaccctctagccatcccgaactgttcgcctccgtgctcccaatggcccctgaagaggccgcacgcctccaacagccacagccacttcctcccccgtcaggaatacatctgagcgcctcacgtaccctggcactcactcttctgtactcaagcccaccttcccacagcccctttggcctctcttcactgatctag

SEQ ID NO: 4446 - DNA, 411 bp, Artificial Sequence
  Description of Artificial Sequence: Synthetic coding sequence
atgatcctgaactggaagctgctgggcatcctggtgctgtgcctgcatacacggggcattagcgggagcgagggccatcccagtcacccgccagcagaagacagggaggaggccggctcgcccaccctgccccagggccccccagtcccaggagatccatggccgggtgcccccccactgttcgaggaccctccccccactcgcccctcacggccttggcgagatctgcccgagacgggtgtgtggctccctgagccaccccgcacagacccgccacagccgcccagaccggatgatccttggcccgccggacctcagcccccagaaaacccctggcctcctgccccggaagtcgacaaccgaccccaggaggagcccgatctggatccgcctcgcgaagaatatcgatag

SEQ ID NO: 4447 - DNA, 411 bp, Artificial Sequence
  Description of Artificial Sequence: Synthetic coding sequence
atgatcctgaactggaagctgctgggcatcctggtgctgtgcctgcataccagaggcatcagcggctctgaaggacacccttcccacccgccggccgaagatcgcgaggaggccggcagcccaacactgccgcaaggtccccccgtgccaggcgatccatggcctggcgccccacccctgtttgaagaccctcccccaacaagaccaagcaggccatggagggacctgccggagaccggagtttggccacccgaacctcctcggaccgatcctccccaaccaccccgcccagacgatccatggcctgccggaccacagccgccagaaaatccttggcccccagcccccgaggtagataacagaccacaggaggagcccgacctggacccccctagagaggaataccgctag

SEQ ID NO: 4448 - DNA, 411 bp, Artificial Sequence
  Description of Artificial Sequence: Synthetic coding sequence
atgatcctgaactggaagctgctgggcatcctggtgctgtgcctgcacacgcgcggtatttcaggcagcgaaggccaccccagccatcctccagctgaagaccgggaggaagccggcagccccactttacctcagggtcccccagttcctggcgacccttggcctggagcccccccgttgttcgaagatccaccccctacccggcctagcagaccatggcgggatctaccagagacaggagtctggcctcctgagccacctaggacagatccccctcagcctcctcgtcctgatgacccctggcctgccggaccccagcctcctgagaacccttggccgcctgccccagaagtggacaatcgaccacaggaggaacccgatctggaccctcctcgcgaggagtacaggtag

SEQ ID NO: 4449 - DNA, 411 bp, Artificial Sequence
  Description of Artificial Sequence: Synthetic coding sequence
atgatcctgaactggaagctgctgggcatcctggtgctgtgcctgcataccagaggaatctctggctctgaggggcatccttctcatccacctgccgaggaccgagaggaagctggttcgcctacactgccgcagggcccaccggtgcctggcgatccctggccaggggcgcctcccctgttcgaagatcccccgcccaccaggcccagccggccctggcgcgatttaccagaaacaggcgtctggcctccagagcccccccgcaccgatccaccacagccaccccgtcccgacgatccatggcctgccggcccacaacctcccgaaaacccatggccgccggccccggaagttgataacaggccacaggaggagcctgatttagatcctccgagagaagagtaccgttag

SEQ ID NO: 4450 - DNA, 411 bp, Artificial Sequence
  Description of Artificial Sequence: Synthetic coding sequence
atgatcctgaactggaagctgctgggcatcctggtgctgtgcctgcacactcgcggaatatctgggagcgagggccacccctcacatcctccagccgaggaccgagaagaggctggctcccctaccctgccgcaaggacctcccgtgccaggcgatccctggcctggcgcccctcctttgtttgaagatcccccccccacgaggccttcccgcccatggagagacctgcctgaaactggggtgtggccccccgaacctccccggaccgatcccccgcagccccctcgtcctgatgacccttggccggcaggtcctcagccgcctgagaacccctggccgccagcccccgaggtagacaatcgacctcaggaggagccagaccttgacccaccacgggaagagtaccgctag

SEQ ID NO: 4451 - DNA, 411 bp, Artificial Sequence
  Description of Artificial Sequence: Synthetic coding sequence
atgatcctgaactggaagctgctgggcatcctggtgctgtgcctgcatactcgaggaattagcggtagcgaggggcatcccagtcacccaccggcagaggaccgcgaagaggccggaagccctacactgcctcaaggcccgccggtaccaggagacccttggcccggcgctccgcctctctttgaagacccccctcctacacggccgtccaggccatggcgtgaccttcccgaaactggcgtgtggcccccagaacctcctaggacggaccccccacagccaccacgaccggatgatccatggccagccggtccccagcctcctgagaatccatggcctcccgcacctgaggtggataaccgaccccaagaagagccagatctggacccaccccgtgaggagtatcgatag

SEQ ID NO: 4452 - DNA, 753 bp, Artificial Sequence
  Description of Artificial Sequence: Synthetic coding sequence
gccctgctgctggccgtgatccagggccggcccggcgcccagcacgatgtcgaagcactgggcggtctgtgttgggccttggggttcgagaccacagtgaggacagaccccaccgcccaagctttccaagaagaactcgcccagttccgggagcagttggacacttgtagaggcccagtctcttgcgccctggttgccctgatggcgcatggcggacctcggggccagctactcggtgcggacggacaggaagttcagccagaggctcttatgcaagagctgtctcgttgccaagtgctgcagggccgtccaaagatctttctcctgcaggcatgccgcggtggcaatcgcgatgccggcgtgggccctacagcactgccttggtattggagttggctgagagctccccctagcgtgccgtcccacgccgacgtgctgcaaatctatgcagaggcccaggggagttcttgcaggggcactccccctggcagcagcgatcaagccgatattctcactgtctattccgctgccgaaggctatgtcgcttatcgggacgacaaagggagcgatttcatccagaccctcgtcgaagttcttcgggcgaatccagggagagacctgcttgaattgctgacggaggtgaatcggagggtttgtgaacaggaagtactcggacccgactgcgacgaactacgcaaggcttgcctggagatcaggtcttccttgaggcgacggctttgtctccaggcatag

SEQ ID NO: 4453 - DNA, 3165 bp, Artificial Sequence
  Description of Artificial Sequence: Synthetic coding sequence
atgaccagctaccgggagcggagcgccgacctggcccggttctacacagtgaccgaaccccaaaggcaccctcgggggtataccgtttacaaggtgacggccagaattatagtctggaaaagatattcagacttcaaaaagttacacaaggaactgtggcaaatccataagaatctctttaggcattccgaactgtttccaccatttgccaaaggcattgttttcggcagattcgacgaaacggtgatcgaggaacgacggcagtgcgcagaggacctccttcagttcagcgccaatatcccagccttgtacaattctaagcagctggaggatttttttaagggagggatcatcaacgattcttccgagctcataggacccgccgaggcccactccgactcacttatcgacaccttcccagaatgtagcaccgaagggtttagtagcgatagtgaccttgtgtcactaaccgtagatgtagattccctcgccgagctagacgacgggatggctagcaatcagaattcacctatacggacctttggcctgaacctgtcaagcgattcgagtgcgctgggggcggtggcatccgactccgaacaatctaaaacagaggaggagagagagtcccggtccctgttcccaggttccctgaaacccaagctgggaaagagggactatctcgagaaggctggtgagctgataaagctggctctgaagaaagaagaggaagacgactacgaggctgcctctgacttctacaggaagggcgttgacctgttgctagaaggcgtgcagggggaatcctcacctactcggcgggaggcagtcaagcggagaactgccgaatacctgatgcgggccgaatccataagcagcctgtacggaaaaccacaactggatgatgtttctcagccaccggggtcattatcttctagacctctttggaatctccggagccctgccgaagagttgaaagcatttcgagttctgggggtgattgataaggtgctgctcgtaatggatactaggacagaacagacattcatcctcaagggattacggaaatcaagtgagtactccagaaataggaagactataattccccgttgtgtacccaacatggtgtgtctgcacaaatacatcatcagcgaagaatccgtgtttctggtgcttcaacatgcggagggtggaaaactgtggagttatatctccaaatttctgaaccgctcacccgaggagagctttgatattaaagaggttaaaaagccaactttggcaaaggtgcatcttcagcagccgacctcatctcctcaggattcaagcagtttcgaatcccgcggctctgatggtggttctatgctgaaggctttgcccttaaaaagttcattgacgcctagttctcaggatgactcaaatcaggaggatgatggccaagattcttctcccaaatggcctgactccgggagctcttcagaggaggaatgtacgaccagctacctgaccctgtgcaatgagtatggccaggagaaaatagagcctgggagcttgaatgaagagcccttcatgaagactgagggcaacggcgtggatactaaggctattaaaagctttcctgctcatctggcagctgatagcgacagtccatccacccagctgcgtgcccacgagctgaaattcttccccaacgacgatcccgaagctgtgagttcacccagaacctctgattccctgtctaggtcaaagaacagccctatggaattctttagaatcgatagcaaggattccgcatctgagctgctggggctagatttcggagagaaattgtactccctgaaatctgagccgctgaagccatttttcacgctgcccgatggtgactccgccagccgatcttttaatacgtcagagtccaaagtcgaatttaaggcacaggacactatatctcgcggaagcgacgacagtgtgcctgtgatcagctttaaagatgcagcgtttgacgatgtgtctggtaccgacgagggccgccctgacctgctcgtaaacctcccaggcgagctggagagcacacgtgaggcagctgccatgggaccaaccaaatttactcagactaacatcggcatcattgaaaacaagttgcttgaggcacccgacgtgttatgcttgcggttatctacggagcagtgccaagcacacgaggagaaggggatcgaggagctgagcgacccctccggccccaagtcatatagcataacagaaaagcattacgcccaggaagaccctcgcatgctgtttgttgccgcggtggatcactcgtccagcggcgacatgagtctcctgccatcctcggaccccaaattccaaggattaggagtggtggaaagcgcagtaactgccaacaataccgaagaatccctcttcaggatttgtagccccctgagcggggcaaatgaatacatcgcctccacagacaccctgaagaccgaagaggtgctgctcttcacagatcagactgatgacctcgccaaggaagaacccacctcccttttccagagagactctgagacaaagggagagagcggcctggtgctggagggcgacaaagagattcatcagatcttcgaggacttggacaaaaaactcgcccttgcaagcaggttctatattcccgagggatgcattcaaagatgggctgcggagatggtggtggcactggacgcccttcatcgtgagggcatcgtttgccgtgatctgaaccctaataacatcttactaaacgatcgaggtcatattcagctgacttacttttctcggtggtccgaggtcgaggacagctgtgacagtgatgccatcgagcgcatgtactgtgcgcccgaagtcggtgccattacagaagagacagaagcttgtgactggtggtctctgggtgccgtactatttgagctgctgaccgggaaaacacttgtggagtgtcatccggcaggaataaatacacacaccaccctcaacatgcccgaatgcgtgtcagaagaggctcgttcgctgatccagcagttgctgcagttcaacccgctggagaggctgggtgcgggtgtcgctggtgttgaggacattaaaagtcatcccttttttacacccgtggattgggcagaattaatgcgttag

SEQ ID NO: 4454 - DNA, 3201 bp, Artificial Sequence
  Description of Artificial Sequence: Synthetic coding sequence
atgaccagctaccgggagcggagcgccgacctggcccggttctacaccgtcacggagcctcagagacacccccgcgggtataccgtctacaaggttacagcaagagtagtgtcacggcggaaccctgaagacgtccaggaaataatcgtatggaagaggtattccgactttaaaaagctgcataaggagctgtggcaaatacataaaaatttatttcgccactccgagctgtttccaccattcgccaaaggaattgttttcggtagattcgacgagactgtgatcgaggaaaggcggcagtgcgctgaagacctgttgcagttttccgcaaacattccagcattgtacaattctaagcagctggaggactttttcaagggaggaatcatcaacgatagtagcgagctgattggcccagctgaggctcattctgattccctgattgacaccttccccgaatgtagcaccgaggggttcagttcggacagcgacctcgtctccctgaccgtggatgtggactctctcgccgaattagatgacggcatggcctctaaccaaaattcgccgattcgcacatttggactcaatcttagcagcgactccagcgccctgggtgccgttgctagtgatagcgagcagagtaaaaccgaggaagaacgcgaaagtaggtctttattccctggctcgctgaagcccaaactgggcaaaagggactatttggaaaaggctggggagctcatcaaactggcactgaaaaaagaagaggaggatgactacgaggcggcctccgacttctaccggaagggagtcgacctgttgctggaaggggtacagggagagtccagtccaacccgaagagaagcggtgaagagaagaaccgcagagtacctgatgagagcggaaagtatatcctccctgtacggcaagcctcagctggatgatgtttcacagccccctgggagcctgtcatccagacccctttggaacctgcgaagcccagccgaggaactgaaagcgtttcgcgtgcttggcgtgattgacaaagtgctgctggtgatggatacaagaacggagcagacgtttattctgaagggcctgaggaagagttcagaatattcacgcaacagaaagaccatcattccccgatgcgtacccaatatggtttgcctccataagtacatcataagtgaagagtcggtcttcttggtgttgcagcatgctgaaggaggcaagctgtggtcctatatctcaaaatttctcaaccgctctccagaggaaagctttgatattaaagaggtgaaaaaacccacgttagccaaggttcacctgcagcagccaaccagctcgccccaagattcaagttcatttgaaagccggggttcagatggcggctccatgctaaaggcactgcctctaaagagttcgctcaccccaagctcccaggacgatagtaaccaggaggacgacggtcaggactcctctcctaagtggcctgacagtggctccagctctgaagaggaatgtacaaccagctacctgactctgtgtaatgagtatggccaggaaaagatcgagcctggtagcttgaatgaggaaccatttatgaagacagaggggaacggggtggataccaaagcaatcaaatcgtttccagcccatttagcagccgatagcgatagtcccagcacccagttacgcgctcacgagctgaaattctttccaaacgatgatcccgaagcagttagcagcccccgtacctcggacagcctgtcaagaagcaaaaattcacctatggaattctttcggatcgattctaaggactccgcaagtgaactgttgggcttggatttcggtgaaaagctctacagtctgaagtccgagccactgaagccattcttcaccctgcccgacggcgactctgcttccaggtcgttcaacacaagcgaatcgaaggtggagtttaaggcacaggataccatttccagaggctccgacgacagcgtgccagtgatctcctttaaagatgctgcatttgatgatgtgtccggaactgatgaaggaaggccggatctcctggttaaccttccaggtgagctggagtcaactagggaggctgccgctatggggcccactaaattcacacaaacaaatatcgggattattgaaaataagttgctggaggccccagatgtactgtgcttgcgcctctctacggagcagtgccaggcccatgaagaaaagggcattgaagaattatctgaccccagcggccccaagtcctatagtattactgaaaagcattatgctcaggaggatcctaggatgctgttcgttgcagctgtcgaccactcctcctccggagatatgtcacttttaccctcctccgaccccaagtttcagggcctgggggtggtggagtccgctgtaaccgcaaataataccgaagagagcctattccgcatctgtagccccttatcaggagctaacgaatacattgccagcaccgacactcttaagactgaggaagtacttctgttcacagaccagaccgatgaccttgccaaagaagaacctacaagcctgttccagcgggactccgagactaaaggagagtccggattggtcctggaaggggataaggaaatccatcagatcttcgaggatctcgataagaagctcgccctggcttctcggttttatatcccggagggctgtattcagagatgggccgctgagatggtggttgccctcgacgctctgcacagggagggcatcgtgtgccgagatctaaaccctaataacattctgctcaacgacagagggcatatccagttgacttacttcagcagatggagtgaagtcgaggactcttgtgactccgatgccatcgaacgcatgtattgcgcccctgaagtcggtgcgatcaccgaggaaacagaggcatgcgattggtggtctttgggggcagtgctgttcgaactcctgacagggaaaaccctcgtggagtgccacccagcaggtattaacacccataccacattgaacatgccagagtgcgtatcggaagaggcacggtcactcatccagcagctgctgcagttcaatcccctcgagaggttgggcgcgggggttgccggcgtggaggatataaagagccatccatttttcacccctgtagattgggcagaactgatgagatag

SEQ ID NO: 4455 - DNA, 1983 bp, Artificial Sequence
  Description of Artificial Sequence: Synthetic coding sequence
atgcgggccgagagcatcagcagcctgtacggcaagccccagctggatgacgttagccagcccccagggtctttgagtagcagaccgctgtggaacttgagatctcctgccgaggaactgaaggcctttcgggtactgggagtaatagataaggttttactggtgatggatactcggacggagcagacgtttatcctgaagggtttaagaaagtcaagcgagtattccaggaaccgaaagaccattatcccacggtgcgtcccaaatatggtttgcttacacaagtacataataagcgaagagtctgtctttttagtgctccaacacgcggaagggggaaagctttggtcatacatctccaagtttctgaaccgtagtccggaggaatcgtttgacatcaaggaagtcaaaaaacctaccctcgctaaggtccacctgcagcagccaactagcagtccacaggattcttcgtctttcgagtccagaggatctgatggaggcagcatgcttaaagccttgcccctgaagtccagtctgactccttcctcgcaggatgacagcaatcaggaagacgatgggcaggattcgtccccgaaatggccggattccggctcaagcagcgaggaggaatgcacaacctcttaccttaccctctgcaacgagtacgggcaggaaaaaatcgaacctggctcgttgaatgaggagcccttcatgaagactgagggaaatggcgtggatacaaaggcaatcaagagttttcctgctcacctcgcagcggattctgatagtccgagcacccagctgcgggcccatgagctgaagttcttccccaatgacgaccccgaagcagtgtcctccccccgaacgtctgacagtctgtcccgctctaagaactccccgatggagttctttcgcatcgacagcaaggactcagccagtgagctgctgggtctcgactttggggaaaaactttattctctcaagagtgagcccttaaaacctttttttacactgcctgatggggatagtgcgagtagatccttcaacacgtccgaatccaaggttgaatttaaggcacaggatacaatcagccgtggatctgatgatagcgtgcctgttatctcattcaaagatgctgcctttgacgacgtttcaggcacggatgaaggtaggcctgatctgttggtgaatctgcccggcgaattggaaagtacgagagaggccgcagcaatggggccaaccaaatttacacagaccaatattggtatcatagaaaataaactgctcgaagccccagacgtgctgtgccttagactctccactgaacagtgccaggcgcacgaagaaaaaggaatcgaggagctgtcagacccttccggccctaaatcatattccataaccgagaaacactatgcacaggaggatccgcgcatgctgtttgtggctgccgtcgaccatagtagctctggtgacatgtcactgctgcccagctcagacccgaaattccagggtctgggtgtggtggagagcgccgttaccgcaaataacactgaagagagtctcttccgcatctgcagccctctgtctggcgcaaacgagtatatcgcaagcacagatactctgaagactgaagaggtgctgcttttcaccgatcagactgatgatctcgcgaaggaggagcctacctctctgttccaaagggattctgaaactaagggggagtccggtctcgtgctcgagggagacaaggaaatccatcagatctttgaggacctagataagaagctcgctctagcctcccggttctatattccagaggggtgcatccagcggtgggctgccgagatggtggtggctctcgatgcgcttcaccgggaaggaatcgtgtgtagggaccttaatcccaataatattctattgaacgaccgcgggcaggagctgctccagatgcacttcttccttttcgcagtcgcttctaactag

SEQ ID NO: 4456 - DNA, 2565 bp, Artificial Sequence
  Description of Artificial Sequence: Synthetic coding sequence
atggccagcaaccagaacagccccatccggaccttcggcctgaacctgagcagtgatagttccgcactgggggcggttgcaagtgattctgagcaatccaaaaccgaggaagagagagagtcgcgttccttatttccaggttctcttaagcccaagctcggtaaaagggactatctggaaaaagcaggtgagctgatcaagctggcgctcaagaaggaagaagaggatgactacgaagcagcttccgatttttatcgcaagggagtggatttactgctggagggcgttcagggcgagtcctcacctactaggcgagaagccgtaaagcggcgcactgccgagtatctcatgagagctgaatccatcagcagtctgtacggcaagcctcagcttgacgatgtgtctcaagtacttcttgtgatggacaccagaaccgaacagacatttatcctgaagggactccgaaaaagtagcgaatactcacgcaaccggaagaccatcattccaaggtgcgtccctaatatggtgtgtctgcacaagtatatcatcagtgaggagtccgtcttcttggtcctccagcacgcagagggcggaaaactgtggtcttatataagcaaattcctgaaccggagccctgaggaatctttcgacatcaaggaagtcaagaaacctaccctcgccaaagttcatttgcagcaacctacatcctcaccccaggactcctctagttttgaatccagaggatctgacggaggctcaatgctcaaagcccttcctttgaagtcctcactgactccctcctcccaggacgactccaatcaggaagacgatggccaggactcttcacccaagtggcctgactcggggagctcatctgaggaagaatgtactacatcttatcttactctgtgtaatgagtatggtcaagaaaagatcgagcccgggtctcttaacgaggaacctttcatgaagacggagggaaatggggtggataccaaggctatcaagtccttcccagcccacctggctgcagactccgatagccccagcactcaactccgggcccacgagctcaagttttttccgaatgatgatcctgaggccgtcagctccccgagaaccagcgatagcctttcccggtccaaaaacagcccgatggagttctttcgtatagactccaaagacagcgcctcagagctcctgggcctcgacttcggagaaaaactgtactccctcaagtccgaaccactgaaacctttctttaccctgcccgacggggactcagccagccgaagctttaacaccagcgagagcaaggtggagttcaaagcacaggataccataagtcgaggcagtgacgattccgtgccggtgatcagttttaaagacgcggccttcgacgatgtatcgggaacagacgagggacgacccgacctgcttgtcaacttgcccggtgaactggagagcacccgggaagccgccgctatgggcccaaccaagttcacacaaaccaatatcggaattattgaaaacaaactgttggaggctcccgacgtcctctgccttcgtcttagtaccgagcaatgccaggcgcatgaagagaagggcattgaggagctgagcgatcccagtggacctaagtcttactctatcactgagaaacattacgcacaggaggacccacggatgctgttcgtggccgctgtcgaccactcctctagtggcgatatgtctttactgcctagtagtgatcccaagttccaagggttgggagttgtcgagagtgcagtgaccgctaataataccgaggagagcctcttccggatatgttcccctctgagcggcgccaacgaatatattgcgtccaccgatactctgaagacagaagaggtcctcttattcacagaccagaccgacgatctggcgaaggaggagcctacctcgctgttccagcgagactcggagacaaaaggtgaatctggcctagttctagaaggggacaaggagatccaccagatttttgaggacctggacaaaaagctggcgttggcctccagattttatatccccgaggggtgcatacagcggtgggccgccgaaatggtggtagctctggacgccctccaccgcgagggcatcgtgtgtcgcgacctcaacccaaacaatattttgctgaacgaccggggccatatacagttgacttactttagtcgatggtccgaagtggaagattcatgcgattccgacgccatcgaaagaatgtactgtgcacctgaagttggtgctatcaccgaagaaacagaggcatgtgattggtggagcctgggcgcagtactcttcgagctgttaacagggaaaacgttagtggaatgccatcctgccggcataaacactcacaccacactgaatatgccggaatgcgtcagtgaagaagcccgtagtctgatccaacagctgctccaatttaacccattggagagactgggtgcaggcgtagctggggtcgaggacatcaaatctcacccgttctttacaccagtggactgggcagaactgatgcgctag

SEQ ID NO: 4457 - DNA, 1449 bp, Artificial Sequence
  Description of Artificial Sequence: Synthetic coding sequence
atggccgccgtgttcgacctggacctggagaccgaggagggcagcgagggtgaaggcgaaccagagctgtctccagcagatgcttgcccgcttgcagagttacgcgcggcaggactcgaacccgttgggcattacgaggaggtggagttgacagagactagcgttaatgtaggccccgaacggatcggcccacactgttttgaactgcttcgggtgctagggaaaggggggtacggtaaggtctttcaagttcgcaaggtgcagggtactaacctgggaaaaatctacgccatgaaagttctgcgcaaagccaagatagtgcgaaacgccaaagacaccgcacatacccgggcggaacgcaacatcctggagagcgtgaaacacccgttcatcgtcgaactagcctacgccttccagactggaggcaaactttacctcattctggagtgtttgtctgggggagagctctttacccatctcgagagggaaggtatctttttggaggatacagcttgtttttatctcgctgaaatcactttggcgcttgggcacctccattcccagggtatcatatatagggatctgaaaccagagaatataatgttgagctctcagggtcacatcaagctgactgatttcgggctgtgcaaagagtctatacacgaaggggccgtcactcatactttttgtggtaccatcgaatatatggcaccagagattctcgtacggagcggacacaatcgggctgtggactggtggtcactgggggctctgatgtacgacatgctgacaggatcaccccccttcactgcagaaaatcgcaagaagaccatggacaaaatcattcggggaaagttggcactgccaccttacctaactcctgacgcaagagatctggtgaaaaaatttctcaagagaaacccaagccagaggatcggaggagggccgggagacgcagccgacgtgcaaagacatcctttctttcggcacatgaactgggacgacttactcgcgtggagagtggatcccccctttcgaccatgcctccagagtgaagaggatgtcagtcagtttgacacaagattcactcggcaaacgccggtcgacagtcctgacgacactgccttgtcggagagcgccaaccaagcgtttttaggctttacctacgtcgcccccagtgtcttggattctattaaggagggattctctttccagcctaagctccgttccccccggagactcaatagctctcccagagcacctgtttctcccctcaaattctctccttttgaagggttccgaccctccccaagcttacctgaacctacagagttgcctctgccacctctcctccctcctccaccaccctctactaccgcccccctgccaatcagaccaccatctgggacaaaaaaaagtaagcggggccgaggcaggcctggcaggtag

SEQ ID NO: 4458 - DNA, 465 bp, Artificial Sequence
  Description of Artificial Sequence: Synthetic coding sequence
atggccgccgtgttcgacctggacctggagaccgaggagggcagcgaaggagagggagagcccgaactatctcccgccgatgcctgccccctcgccgaactgcgggccgcaggcttagaacccgtgggtcactacgaagaagtagagctaacggagacatctgtaaatgtcggcccggagcgtattgggccccactgcttcgagctactgcgggtgttagggaagggggggtacggcaaggtcttccaagtgaggaaggttcaggggacaaacctaggcaagatttatgcaatgaaggtgctaagaaaagctaagattgttagaaatgcaaaagacactgctcacacaagggccgagcggaacatcctggaatcggtaaagcaccccttcatcgtggaactcgcctacgcgttccagactggcggcaaactttatttgattcttgagtgtctgtccgtggactag

SEQ ID NO: 4459 - DNA, 465 bp, Artificial Sequence
  Description of Artificial Sequence: Synthetic coding sequence
atggccgccgtgttcgacctggacctggagaccgaggagggcagcgagggagagggagaacccgagctttcacccgctgatgcctgcccactggctgaactcagggccgcaggtctggagccggtcggtcattacgaggaagtagaacttactgagacatccgttaatgttggcccagagcgaattgggccacactgttttgagctactgcgagttttggggaagggtggttacggaaaggtgttccaggtcaggaaggttcagggcacaaacctaggtaaaatttacgccatgaaggtgttgaggaaagccaagatagtaaggaatgctaaggacaccgcccatacgcgcgccgagagaaacatcctcgagtctgtgaaacaccccttcattgtggaactagcctatgcatttcaaactggcggcaagctctacctcatccttgagtgcttgtctgtcgactag

SEQ ID NO: 4460 - DNA, 2133 bp, Artificial Sequence
  Description of Artificial Sequence: Synthetic coding sequence
atgttcaagttcctgagcttccgggtgcggagcatccaggaggaggtgagcataaaggaaatagccattacacatcacgtgaaggaaggccacgaaaaggccgatccctcccagttcgaactcttgaaggtcctgggccaggggtcattcggtaaggtattcctggtgaaaaagatttcgggaagtgacgcacgtcagctgtacgccatgaaggttctgaagaaggccacgttaaaggttagagatagggttcgtaccaagatggagagagatattctggtggaagtaaatcaccccttcatcgttaagctccattacgcattccaaaccgagggaaaactgtacctgattctggatttcctcagggggggcgatctgtttacacgcctgtccaaggaagtaatgttcacagaggaagacgttaaattttatctcgcagagcttgcactagcactggatcatctgcacagcctgggcataatttatcgcgaccttaagcccgaaaacattcttctggacgaagaaggacacattaaactgaccgacttcggtttgtcaaaggagtctatcgaccacgaaaaaaaagcctattcgttctgcgggactgttgagtatatggcaccagaagttgtgaatcgccgaggacatacacaatctgccgactggtggtccttcggagtgctgatgttcgaaatgttaactggtaccctgccatttcaagggaaagacagaaaggaaactatgacaatgatcctgaaagcgaagctgggcatgccacagtttttaagccctgaagcccagtcgctccttcgcatgcttttcaagcgcaatccagccaatcgactgggcgctgggcctgatggcgtcgaggaaattaagaggcactccttcttttccacgattgactggaacaagctctatcgtagagagattcatccacccttcaagcccgccactgggcgccctgaggacaccttttactttgatcctgagtttacagcgaagacgcccaaggattccccagggatcccccctagtgcaaatgcgcaccaattgttccgaggtttttcttttgtcgcaattacaagtgatgatgagagtcaggcaatgcagacagtgggggtgcactctatcgttcaacttcacagaaacagcattcagttcaccgacggctacgaagtgaaagaggacatcggggtagggtcctattctgtgtgcaaacggtgcatccataaggccaccaacatggagtttgccgtgaagattattgataagtcaaaaagggatcctactgaagagattgagattctgttgcggtatggacaacatcctaacattatcactcttaaggacgtttacgacgacggcaaatacgtctacgtagtaaccgagcttatgaaaggaggtgaactcctcgacaagattctgaggcagaaatttttttcagaaagggaagcctccgccgtcttgttcactatcactaagaccgtggaatacctccatgctcagggcgtggtccatcgggatttgaaaccttccaacatcttgtacgtagacgagagtggcaaccccgaatctatcagaatttgtgattttggcttcgcaaaacagcttcgcgccgagaacgggttactgatgacaccttgctatactgcaaatttcgtggcccctgaggtgcttaaacgccagggttatgacgccgcctgcgatatttggtccctgggggtcctcctctacacaatgctcacaggatacacgccattcgcgaacgggcccgacgacactcctgaggagattttggcacggatcggcagcgggaaattttccctgagcgggggatattggaactcagtttctgatacggcaaaagatttggtctcaaaaatgctgcacgtagatccgcaccagaggctcacagccgcactagtgctgagacatccgtggatagtccactgggaccagctcccacaatatcagttgaaccggcaggatgctccacacctcgtaaagggagccatggcggccacctacagtgccctgaaccggaaccaatctcctgtgcttgaaccggtggggagatctacccttgcccaacgccggggtatcaagaaaatcacgtcaaccgcgctctag

SEQ ID NO: 4461 - DNA, 2223 bp, Artificial Sequence
  Description of Artificial Sequence: Synthetic coding sequence
atgcccctggcccagctggccgacccctggcagaagatggccgtggagagtcctagtgacagtgcagaaaacggccagcagatcatggatgagccaatgggcgaggaggagataaacccccagaccgaggaggttagcatcaaagagatcgccatcacacaccacgtcaaggagggacatgagaaagctgaccctagccagtttgagctgctcaaggtgctgggccaggggagctttggaaaggtgttccttgtgaagaagatatcagggtctgacgcacgccaattatacgccatgaaagtgcttaagaaggcaacactgaaggtccgtgatcgggtgaggactaagatggagagggatatcctagtggaggtcaaccacccctttatagtgaaactgcactacgcgtttcagaccgaaggcaaattgtatctgatcctggactttctgaggggcggcgatctgttcacgagactgtcaaaggaagttatgtttaccgaggaggatgtgaagttctacctggctgaactggcactggctctggaccacctgcacagcctagggataatttatcgagatctaaagccagagaatattctactggatgaagagggtcacataaagcttaccgacttcgggttatcaaaggagagcatcgatcatgaaaaaaaggcgtactctttttgcgggaccgtggagtatatggctcccgaggtggttaacagacgcggccatacacagtcagcagattggtggtctttcggagtgctgatgtttgagatgcttactggcacactgccatttcagggaaaggataggaaggaaactatgaccatgatactcaaggccaagctgggaatgcctcagtttctgagcccagaggcacagagcctcctgcgtatgctgttcaagagaaatcctgcaaataggttgggcgccgggccagacggagtagaggaaataaagcgccattcattcttcagtacaatcgattggaacaaattgtatcgtagggagatacatcctccatttaaacctgctactggtaggcccgaggacactttctatttcgacccagaattcactgcgaagacccctaaagacagcccaggcattcccccgtctgctaatgcccaccagctctttaggggcttctcattcgtggccattacgtctgacgacgaatcacaggcgatgcagaccgttggggttcacagcattgtccagcagctgcataggaactccattcaattcacggacggatacgaggtaaaagaagatatcggcgtcgggagttatagcgtgtgcaagcggtgtatccacaaggcaactaacatggagttcgcagtgaagatcattgacaaatcaaagcgagatccgactgaagagatcgaaattctgctgcgctacggccagcacccaaatattattacattgaaggacgtatacgatgacggcaagtatgtctatgtggtaactgaacttatgaaggggggagagttgctcgacaaaatactgcgccagaaattcttcagtgaaagggaggcatccgccgtactgttcacaattacaaagaccgtagagtacctacatgcccagggcgtggtgcaccgggatctcaagccctctaacatcctgtacgtggatgagtcagggaaccctgaatctatacgaatctgcgacttcggatttgccaaacagctcagagctgaaaatggactgctaatgaccccgtgttacacagctaacttcgtggcacccgaagtgttgaaacggcaaggatatgacgctgcttgcgacatctggtcactgggtgttttactgtatacgatgctgaccggatacactcctttcgccaacggtcccgacgacacccctgaggagatccttgcgagaatagggtccggtaagttcagcctttcaggaggttactggaacagcgtatcagatacagccaaggaccttgtgagtaagatgctccacgtggatccgcaccaaaggcttacagccgcactcgtgcttaggcatccatggatcgtccactgggatcagttgcctcagtatcagctgaaccgccaggatgctccgcacctcgtgaagggggccatggccgcaacatattccgccctaaaccgtaatcagtctcctgtgctggagcccgtcgggaggagcaccctcgcgcagcgtcgaggcataaaaaaaattacgtccacggcgttgtag

SEQ ID NO: 4462 - DNA, 402 bp, Artificial Sequence
  Description of Artificial Sequence: Synthetic coding sequence
atggacgagcccatgggcgaggaggagatcaacccccagaccgaggaggtctctattaaagagattgccatcacccaccatgtgaaagaggggcacgagaaagctgatccaagccaattcgagctgctgaaggtacttggacagggatcctttggtaaggtgttcctagtgaaaaaaatttctggaagcgacgccaggcagctctacgcaatgaaagtactcaagaaagccactttgaaagtgagggacagagttaggactaaaatggaaagggacatcctggttgaggttaatcatcccttcatcgtgaaattgcactatgctttccagaccgagggtaaactttatctcattctggacttcctccggggaggcgatctgtttactcgattgagtaagtag

SEQ ID NO: 4463 - DNA, 684 bp, Artificial Sequence
  Description of Artificial Sequence: Synthetic coding sequence
atgttcaagttcctgagcttccgggtgcggagcatccaggaggaggtttccatcaaggaaatcgccattacccatcacgtcaaggagggtcacgagaaggccgatccatcccagtttgagctgcttaaagtgctggggcaagggtcatttggaaaggtatttctggtgaagaaaatctccggctccgacgcccgtcaactgtacgccatgaaggtgctgaagaaagccaccctgaaagtacgtgaccgggtccggacaaagatggagcgtgacattttggtagaggtgaatcatccattcattgtgaaattacactacgcttttcagaccgaggggaagctgtatctgatcctcgactttctacgaggcggcgatctgtttactaggctcagcaaagaagtgatgttcaccgaggaggacgtgaagttttatttggccgaactagcactggccctcgatcacttgcactcactcggaatcatttaccgcgacttaaagcctgagaacatacttttagacgaagagggccacattaagctaactgatttcggactgagtaaagagagcatcgatcatgaaaaaaaggcttatagcttctgcggcaccgtcgagtacatggcccctgaagtcgtgaatagaaggggacacacgcaatccgctgactggtggagcttcggcgtgtag

SEQ ID NO: 4464 - DNA, 2136 bp, Artificial Sequence
  Description of Artificial Sequence: Synthetic coding sequence
atggacgagcccatgggcgaggaggagatcaacccccagaccgaggaggtgagcattaaggagatcgctatcacacatcacgtgaaggaaggacacgaaaaagctgatccctctcagttcgaacttctgaaagtgttagggcagggatcattcggcaaggtattcctagtcaagaagattagtggctctgacgccagacagctttacgccatgaaagtattgaagaaggccactttaaaggtgagagatcgtgtgcggacaaagatggaacgggacatccttgttgaggtgaaccaccctttcattgtgaagttgcactacgcgtttcagacagaaggcaagttatacctgatcctggactttctgcgcggcggagatctgttcaccagactcagcaaggaagtcatgtttacggaggaggacgttaagttctatctggccgagctcgccctggctctggaccatttgcattcactgggtattatttaccgagacctgaaaccggagaatatactactggacgaagaaggtcatattaagctgacggattttggactttcaaaggaatctattgaccatgaaaagaaagcttacagcttctgtggcacagtagaatatatggctccggaggtggtcaaccggaggggtcatacccaatccgccgattggtggtcattcggcgtcttgatgtttgagatgcttacagggaccttgccgtttcagggtaaggatagaaaggagaccatgaccatgatattgaaagctaagctggggatgccacagtttttaagccctgaagcacagagcctgctccgcatgctgtttaaaaggaaccccgccaacaggctgggcgccgggcccgacggagtagaggaaattaaacggcattccttcttcagcacgattgactggaataagctgtatcggcgagaaatacatccccccttcaaaccagccacgggcaggcccgaagatacattctactttgatccagagtttacggccaaaacccctaaggactcacccggtatcccaccttcagccaacgcccatcagctgttccggggcttctcatttgtcgccatcacctcagacgatgagtcacaggccatgcagacggtgggtgtccattccattgtccaattgcacaggaacagtattcagtttacggacggttacgaggtgaaagaagatatcggcgtgggttcttacagtgtgtgtaaaaggtgtatccacaaagctactaatatggaatttgcggttaaaataatagataaatcgaagagggatcctacagaggagatcgagatcctgctacgatacggccagcaccccaatataataaccctgaaagacgtgtatgacgacgggaaatacgtgtatgtagtgaccgagcttatgaaaggaggagaacttctggacaagattctgcgccagaaattcttttccgaaagggaggcctccgcggtgctctttactatcacaaaaactgtagaatacttacacgcgcagggagtcgtgcatagggacctcaagcctagcaatatcctctacgtggacgagtcaggcaacccagaatccattcgtatctgtgatttcgggttcgccaagcagctgcgtgctgaaaacggcctcctcatgactccctgctataccgcaaacttcgtggcaccagaggtgttgaaaaggcagggatacgatgccgcctgcgacatctggagcttgggcgttctgctatatacaatgctaacggggtatacgccattcgcaaatggtcctgacgacactccggaggagatccttgcccgcataggttccggcaaattcagcctctcgggtggttactggaactccgtgagtgacaccgcaaaagatttagtttctaaaatgctgcacgtggacccccaccagcggcttaccgcggccctggttcttagacatccatggattgtgcactgggatcagctgccacagtaccaactgaatcggcaggacgctcctcatcttgtgaagggcgcaatggccgcgacttactctgcactcaaccgcaatcagagccccgtcttggagcccgtcgggcgtagtaccctggcccagagacgcgggattaagaagataacctcaaccgctttatag

SEQ ID NO: 4465 - DNA, 2139 bp, Artificial Sequence
  Description of Artificial Sequence: Synthetic coding sequence
atggacgagcccatgggcgaggaggagatcaacccccagaccgaggaagttagcattaaggagatcgcgatcacgcatcatgtcaaggaagggcacgaaaaggcagacccttcccaatttgagttgctgaaggtcctgggccagggtagtttcggtaaagtttttttagtcaaaaaaataagtggctctgatgcacgacagttgtacgcgatgaaggtgttaaaaaaggccaccctgaaagtaagagacagagtccggacaaagatggagagggatatcctagtggaagtcaaccacccattcatcgtaaagttgcactatgcatttcagacggaaggcaagctctatctgattcttgacttcctgcgaggaggcgacctgttcaccagactttctaaagaagttatgtttacagaagaagacgtgaagttctacttggccgagctcgctctcgctctagatcatctgcatagtttaggcatcatttatagggaccttaagcccgaaaacattctgcttgatgaagaggggcatatcaagttgaccgacttcggcctcagcaaagaaagcatagaccatgaaaagaaagcgtactcattctgcggcaccgtcgaatatatggctcccgaagtcgtcaatcgcagaggacatacacagtccgcagactggtggagctttggagtgctaatgttcgagatgctcactgggaccttacccttccaggggaaagatagaaaagaaaccatgacaatgatactgaaagcaaagctaggtatgcctcaattccttagtccagaagcccagagtctcctgaggatgctcttcaaaagaaaccccgcaaacaggttgggggctggcccggacggcgtggaggagattaagaggcactcatttttttccacaatagactggaacaagctttatcgccgggaaatacaccccccattcaaacccgctactggtagacctgaggataccttttattttgacccagaatttactgcaaagacccccaaagactccccgggaatccccccctcagccaatgctcaccagctcttccggggtttctctttcgtggccatcacctctgacgacgaaagccaagcaatgcagacggtgggtgtccactccatagttcaacagcttcacaggaactccattcagttcacagatgggtacgaggtgaaagaagacataggggttggctcctatagtgtgtgcaaaaggtgcattcacaaggccaccaacatggagttcgccgtgaagatcatagataagtctaaacgcgaccctactgaggaaattgaaatcctgctgcgctatggccagcacccgaacattatcactcttaaggacgtctacgacgacggcaaatacgtgtacgtggtcaccgagctgatgaagggcggggagctgttggacaagatcctgcggcaaaagttttttagcgagagagaagcctcagctgtccttttcaccattactaaaacagtggagtacctacacgcccagggggtagtccatcgagacttgaagccatccaatatactatatgtggatgaatccggcaacccagaaagcatcaggatttgcgatttcggttttgccaaacagttgcgggccgaaaatgggttactgatgacaccatgctatacagccaactttgtggcacctgaggtgttaaaacgtcagggctatgatgccgcttgcgacatctggagcctcggtgtgcttctgtatactatgctgaccggttatacaccattcgctaatgggccagatgatactccagaggaaattctcgcgcgaataggcagtggtaaattctctctgagcggagggtactggaactcagttagcgacacagctaaagacttggtgtccaagatgctgcacgtggatccccaccagcgcttaactgcagccctcgtcttgcggcacccctggatcgtgcattgggaccagttgccacaatatcagctcaaccggcaggatgcaccccatctggtgaaaggagccatggccgccacctactccgccctcaaccgcaatcagagtcctgtgctggagcccgtcggaagatctaccctcgcacagagacgcggcattaagaaaatcacctcaactgccctgtag

SEQ ID NO: 4466 - DNA, 1575 bp, Artificial Sequence
  Description of Artificial Sequence: Synthetic coding sequence
atgggcgacgaggacgacgacgagagctgcgccgtggagctgcggatcacagaggcgaatctcacaggacacgaagaaaaggtgtctgttgaaaattttgagctgctaaaggtcttaggaaccggagcctacggcaaagtctttctcgtacgtaaggccggtgggcacgacgccggcaagctgtacgctatgaaggtcctgaggaaggcggctctggtgcagcgggcaaaaacgcaagaacacacccgcactgagaggtctgtcctggaacttgtccggcaggccccgttcttggtaacgcttcactatgcattccagactgacgccaagcttcacctgatcctggattatgtcagcggcggcgagatgtttacgcacctctaccagcgccagtacttcaaagaagctgaagtacgggtctacggcggcgagatcgtcctggctctggagcacctacacaaattggggatcatatatagagacttgaaattggaaaatgtgctgctggattctgaagggcatattgtgctgaccgacttcgggctctcaaaagagtttctaacagaagagaaagagcgcaccttctcattctgtggaactatagagtacatggctcctgagatcattcgctctaagaccggacacggaaaagctgtggactggtggtcactgggtatactgctttttgaactgctgaccggggcctctcctttcaccctcgagggagagcggaatacgcaggcggaagtttcgaggcgaattctcaaatgcagtcctccgttcccccccagaattggcccagtagcacaggatctcctccagcgcttactctgcaaggaccctaagaaacgcttaggagccggtcctcaaggagcccaagaggtgagaaatcaccctttcttccagggactcgactgggtagccctggcagctcggaagatccccgctccattccggccccagatccgctccgagctggacgttggtaactttgcggaagaatttactcggctcgaaccagtctacagccctcctggttcccctcccccaggggaccctcgcatctttcaaggctactcgttcgtggctccttccattctgtttgaccacaataacgccgcagaaattatgtgtaaaattcgtgaaggacgtttctcacttgatggcgaggcttggcagggcgtcagcgaggaagccaaggagcttgtgagggggctgttgactgtggaccccgccaaacgcttaaagttggaggggctaagaggctcatcatggctgcaggatggcagtgcccgatcatccccccccttgcgaacacctgacgtgctggagtcttctggccctgctgtgaggtctggcctcaatgcgacattcatggcttttaatagaggtaaaagagaaggctttttcctgaagtctgttgaaaacgctcccttggccaagcgaaggaaacaaaagctcaggtctgccacagctagccgacgcggttcccctgcacctgcaaatccaggcagagcaccagtggcctctaaaggcgctcctcggcgggccaacggcccgttgccccccagttag

SEQ ID NO: 4467 - DNA, 2319 bp, Artificial Sequence
  Description of Artificial Sequence: Synthetic coding sequence
atgggcgacgaggacgacgacgagagctgcgccgtggagctgcggatcactgaggccaacttaacaggacacgaagagaaagtttcagtggagaacttcgaacttcttaaggtgctcggcacgggtgcctatggtaaggtatttctggtgagaaaagcaggggggcacgacgctgggaaactctatgcaatgaaggtactgcgcaaggcagctctggtgcagcgggcaaagacccaggagcatacccgaacagaacgaagcgttctggaattagtacgacaggccccatttcttgtaaccctgcactatgccttccaaaccgacgctaaacttcacctcattctggactatgtgtcaggcggtgagatgttcacacatctctaccaaaggcagtacttcaaggaagcagaggtccgcgtttacggtggcgaaattgtactcgcactagaacacctgcacaaactagggatcatctacagggacctgaaacttgagaacgtactcctggattcagagggacacatagtgctgaccgattttggattgtcaaaggagttcctgaccgaggagaaggaacgtacattttccttttgcgggaccatagagtacatggcccctgagatcatccggtctaagactgggcatgggaaagctgtggattggtggagccttggcatattattattcgaattgcttactggggccagtccatttactttggaaggtgagaggaacacgcaggccgaggtgtctcgtcggatactgaagtgctccccaccgtttcctccccggattggtccagtggcccaggacctgcttcagcggcttctttgtaaggatcctaaaaaacgtctaggcgcgggcccccagggcgctcaggaagtgagaaatcatcctttctttcagggactggactgggtcgctctcgcggctcgcaaaattcccgcccccttcagaccgcagattagatcagaactggatgtgggaaatttcgccgaagaattcacaagactggaacctgtgtattcgcccccgggctccccccctcccggagatccgaggatatttcagggatactcctttgtggcacccagcatattatttgaccataacaatgcagtcatgactgacggtttggaggcgcctggagccggagaccgacctggaagagcagccgtggcccggtcagcaatgatgcaggactcacccttttttcaacagtacgaactcgatttgagagaacccgccctagggcaaggaagcttctccgtgtgcaggcgctgcagacagcgacaatccgggcaggaatttgctgtgaagattctaagtcgtcgtctcgaggccaatacccagagggaagtcgcagcgctgcggctttgtcagagccaccctaacgtggttaatctgcacgaagttcaccacgaccagctccacacatacttggtcctggagttgctcagaggaggtgagctgctagagcatattaggaaaaagagacattttagcgaatccgaggcttcccaaatactgaggagcttagtttccgctgtatccttcatgcatgaggaagcgggcgtagtgcatcgtgatctgaagccagagaatatactttatgcagacgacacacccggggcccctgtgaaaataatcgattttggatttgctcggctccgtcctcagagcccaggtgtccctatgcaaactccatgctttaccctgcaatatgccgcccccgagctgcttgcacagcagggttatgacgagtcgtgtgacctgtggagcctcggcgtgattttgtacatgatgctctcagggcaggtaccctttcagggcgcgtcagggcaaggagggcagtcccaggcggctgagattatgtgcaaaattagggagggtagattcagcctggacggagaagcctggcagggcgtgagtgaggaagctaaggaattggtgcggggcctgctcaccgttgaccccgcaaagcggctgaaattggaaggactccgcggttctagctggctgcaagatggctccgcccgcagcagccccccgctccgaactccggatgttctggagagctctggtcctgcagtgagaagtggactgaacgccacctttatggcctttaacagaggaaagcgagaaggattcttcctcaagtccgttgaaaatgccccattggccaagcgtcgcaaacagaagcttcggagtgccaccgccagcagacgaggatccccagcgccagctaaccccggccgggcccccgtggcaagtaagggcgcacctcggagagctaatggcccactacccccttcatag

SEQ ID NO: 4468 - DNA, 2298 bp, Artificial Sequence
  Description of Artificial Sequence: Synthetic coding sequence
atgggcgacgaggacgacgacgagagctgcgccgtggagctgcggattactgaggccaacttgaccggccatgaggagaaggtatcagtcgagaactttgagttactgaaggtgctgggcacaggggcctacggaaaagtgtttctcgtcaggaaggccggaggacatgacgccgggaagttatatgcaatgaaagtcctgagaaaagctgctctggtgcagcgggcgaagacccaagaacacacccggaccgaaagaagcgttctcgaacttgtcaggcaagctcccttcctcgtgacgctacactacgcattccaaaccgacgccaagctccatttgatattggattacgttagcggcggagagatgtttactcatttgtaccagagacagtatttcaaagaagccgaagtgcgcgtatacggtggagaaatcgtgcttgcacttgaacaccttcataaattggggataatctatcgtgacctgaaactcgagaatgtgctcctcgacagcgagggccatattgtgctcaccgatttcggtttatcaaaggagtttctcaccgaggagaaggagagaactttttctttttgcggaactattgaatacatggccccagaaatcatcagaagtaagaccggccacggtaaagcagtcgattggtggagccttggcatccttttattcgagctgcttactggggcctctccatttacactcgagggcgaacgtaatacccaagctgaggtgtctaggagaatcctgaagtgctccccccctttcccacccagaattggcccagttgctcaggacctgctgcagcggctcctttgcaaggaccccaagaagcgtcttggcgccggcccccagggggcccaggaagtgcgcaatcatccctttttccaggggctcgactgggtcgcgctggcggcaagaaagatacccgctccctttcgcccacagattagaagcgaattagatgtcggcaattttgcggaagagttcacacgcttggaacccgtgtacagccccccaggctcacctccgcctggtgaccctagaatcttccaggggtactcttttgttgctccatccatcctgtttgatcacaacaatgcggtgatgaccgacggcctggaggcccccggcgccggcgacaggcccgggagggccgctgtagctcgctccgcaatgatgcagtacgaactggatctgagagaacccgctctggggcagggaagcttttccgtctgtcgccggtgtaggcaacgtcagagtgggcaggaatttgccgtgaagatcctgtctagaagacttgaggctaacacacagcgtgaagtggcggcactgcgactatgccagagtcaccctaacgtggtaaatctccacgaggtccatcatgaccagctccacacctacctggtgttggagctgctgcgcggcggcgaactgctcgaacacatcagaaagaagcgccatttctccgagagtgaggcctcccagatcctcaggagcctcgtgtcggccgtgtcttttatgcatgaggaagcaggagtcgtgcatcgagaccttaagcctgagaacattttgtacgccgacgacactcccggggcccctgtgaagatcatcgatttcggtttcgcacggttgcggcctcagtctcccggcgttccaatgcaaaccccctgtttcacactccagtatgctgctcccgagctgctcgctcaacagggctacgatgagagctgtgacctctggagtctcggagttatactgtacatgatgctgagcggacaagtgcccttccaaggggctagcgggcagggcgggcagtctcaggcagccgagattatgtgcaagatccgtgaaggcaggttttccttggacggtgaggcctggcaaggggtgtccgaggaagccaaagagctcgtaagggggcttttgaccgtggatccagcgaaaagacttaagctcgaggggctgagggggtcatcatggctgcaggacgggtcggcccgctcttcccctccactgagaacgccggacgtgctcgaaagcagcggaccggccgttaggtctggactgaacgctacattcatggcatttaatcgtgggaagcgcgagggattcttccttaaatctgtagaaaacgctccgctcgcaaaaagaagaaaacaaaagttaaggtctgccaccgcatccagaagaggatcacccgcaccggccaaccctggacgggcccctgtagcttcgaagggcgcgccgaggagggcaaatggcccactgccaccatcctag

SEQ ID NO: 4469 - DNA, 2118 bp, Artificial Sequence
  Description of Artificial Sequence: Synthetic coding sequence
accgaggccaacctgaccggccacgaggagaaggtgagcgtggagaacttcgagctcctgaaggtcctcggcaccggggcatatgggaaagttttcttagtccgaaaggccgggggccatgacgcggggaagttgtacgcaatgaaggtgttaaggaaagccgctcttgtacaacgggccaaaacccaagaacacacccggacagaacgcagtgtcttggaactcgtcagacaagcaccgttcttggttactctgcattatgctttccagaccgacgccaaactgcacctgatcttggattacgtatctggcggcgagatgtttactcacctttaccagcgccagtacttcaaggaggcggaagttagagtgtatgggggagagattgtcctggcactggaacacctccacaagcttggcataatctacagggacctcaagcttgaaaatgtcttgcttgactctgaagggcatatagtgcttactgacttcggcctgtccaaagaatttctgactgaggaaaaggagagaacattctctttctgcgggaccatagagtatatggcccccgaaatcatccgtagcaagacagggcatggtaaagccgtcgattggtggtctttgggcatcctgctcttcgaactgctcaccggggccagtccgtttaccctagagggcgaaagaaacacacaagccgaggtctcccgccggatcctgaagtgctcaccgccatttcctcccagaattgggcctgtggcccaagatctcctgcagcggttactttgcaaggacccgaaaaaaagactgggggctgggccccagggagctcaggaggtgagaaatcatccattttttcaaggcttggattgggtggctcttgctgcccggaagattccagccccatttcggccacagattagatccgagctcgacgtgggcaacttcgccgaagagttcactcggttggagcctgtctacagcccccctggatctcccccaccaggtgatccgcggatttttcaggggtatagcttcgttgccccctccatcttgtttgaccacaacaatgctgtgatgactgacgggcttgaagcgccgggagcaggcgacaggccaggtagagctgccgtcgcccgttcagccatgatgcagcagtatgagcttgatctgagagaacccgctctgggacagggtagtttcagcgtctgccgtagatgtcgccagcgtcagtccgggcaggagtttgcggtgaaaatcttgagtcgtaggctcgaagctaacacccagagagaggtcgcagccctgcgcctttgccagagccatcccaacgtggtaaacctccatgaggtccatcacgaccagttgcacacttatttggtactggagcttctgagaggcggcgaacttctcgagcacatccggaaaaaacggcatttttctgagagcgaagcctcacagattcttcgcagcctggtttcagctgtctctttcatgcatgaggaggctggagtcgttcatcgagacctcaaaccggaaaatattctttacgccgacgacacccctggggcccccgttaagattatcgactttggtttcgctcgcctgcggcctcagagccccggggtgccaatgcagactccctgtttcacgctccagtatgcagctcccgagcttttagcccagcaagggtacgacgaaagttgcgacctttggagccttggcgtcattctgtacatgatgctgtccggccaggtccctttccagggtgcaagtggccaaggtggacagagccaggctgcagagattatgtgtaagattcgtgaaggtcggtttagcttagatggggaggcttggcagggcgtgtcggaggaggctaaagagttagttcgcggcctactgacagtcgatccagccaagcgattgaaactcgaagggctgcgaggaagttcttggctacaagatggaagcgctagatcaagcccccctttacgcacaccagatgtgctggagagctctgggcctgccgtacggagtggccttaatgctacttttatggcttttaatcgggggaagagagagggctttttcctgaaatctgtcgagaatgcaccgctgtag

SEQ ID NO: 4470 - DNA, 2409 bp, Artificial Sequence
  Description of Artificial Sequence: Synthetic coding sequence
atggaggaggagggcggcagcagcggcggcgccgccggcaccagcgctgacggcggagatgggggggaacagctcttgacagtgaaacacgagctgaggactgctaatctgaccggacatgcagagaaggtgggcattgagaacttcgaattgctcaaggtccttggtactggcgcgtacggcaaggtgttcttggtgcggaagatctcaggacatgacacaggaaaattgtacgctatgaaagtgcttaaaaaggccaccattgttcaaaaggccaaaaccactgagcacacacggacagagcgacaggtgctggagcatattcgccaatccccttttttggtgaccctacactacgctttccagaccgaaacgaagctgcacctgatccttgattacatcaacggaggcgagctgtttacacatctcagccaacgggagcgcttcacggagcatgaggttcagatctatgtcggagaaatagtactggccctagaacacctgcacaagcttggcattatttatcgcgatatcaaactagaaaacattctcttggatagtaacgggcatgtagtgttaacagatttcggtctcagcaaagagtttgtcgccgacgaaactgaacgcgcatactcgttctgtggcacgatcgagtacatggctcctgacatagtcagaggtggcgattctggacacgataaggccgtggactggtggtccctcggcgtgctgatgtatgagcttctgactggcgctagcccattcacggtcgacggagagaagaactcccaagccgagatcagtcgccgtattctgaagtctgagccaccctatccccaggaaatgtctgcactcgctaaggacctcattcaacgcctgttaatgaaggatccaaaaaaacggctgggttgcggccctcgggatgccgatgaaataaaagaacacctgtttttccagaagattaattgggacgacttggccgccaaaaaagtgccagccccctttaagcccgtcatcagggacgagctcgatgtgtctaacttcgccgaggagttcactgaaatggatccaacatattcaccggcagctttgccacagagctcagaaaagttgtttcagggctacagtttcgtcgctcccagtatccttttcaagcggaacgcggcggtgatagaccctcttcagtttcatatgggcgtggagaggcctggcgtgaccaatgtcgcaagaagcgctatgatgaaagactcgcctttctatcaacattacgacctagatcttaaggacaaacctctgggggagggctcgttttccatttgccgtaagtgcgtgcataagaaatcaaaccaggccttcgctgttaagattatctccaaacggatggaggcaaatacgcaaaaagagattacagcgctcaagctgtgcgaggggcaccccaatatcgtaaagctgcatgaggtattccatgaccaattgcatactttcttggttatggagctgctcaacggcggggagctctttgaaagaattaagaagaaaaagcatttcagcgagaccgaagcctcatacatcatgagaaagctggtgagcgcagtgtctcatatgcatgatgtcggagtcgtccatcgcgatttaaagccggagaatctcttgttcacagacgaaaatgataatctcgagatcaagatcatagacttcggcttcgcaagacttaaaccacctgataatcagccactcaaaactccatgcttcaccctgcactacgctgcacctgagctcctgaatcagaacggctacgacgaatcatgcgatctttggtctcttggagtgatactttacactatgctgtctgggcaagtacctttccaaagccatgatcgtagtttgacttgtacaagcgccgttgaaattatgaagaaaatcaagaaaggcgacttttcattcgagggcgaggcctggaaaaatgtctcacaggaagccaaagacttaattcagggtttgctgacagtcgacccaaataagagactaaaaatgagtggcctgcgatataatgaatggcttcaagacgggagccagttatcctccaatcctctgatgacgcctgatattctcggaagctctggagcggctgtacatacttgtgtgaaagcaaccttccatgcgtttaacaagtacaagcgcgaaggtttttgcctgcaaaatgtggacaaagcccccttggcaaaacggcgcaagatgaaaaagacatccacttcgacagagacacgttcctctagctctgaatcaagtcacagctcctcttctcactcccatgggaaaaccacacccaccaaaacccttcagccgagtaaccctgctgacagcaataaccctgagaccctgtttcagttctccgacagtgtagcctag

SEQ ID NO: 4471 - DNA, 1650 bp, Artificial Sequence
  Description of Artificial Sequence: Synthetic coding sequence
atggaggaggagggcggcagcagcggcggcgccgccggcaccagcgcagacggcggggacggcggcgaacagttgctcacagtgaaacatgaactgcggaccgcgaacctcactgggcatgcagagaaagtgggcattgagaactttgagttactgaaggtccttggcacaggagcttacggcaaggtattcttagtgagaaagatctctggtcatgataccggcaagctgtatgccatgaaggtgctgaaaaaggctactatagtgcagaaggctaagacgacagagcatacccgtaccgaacggcaggtccttgagcatattagacagagcccatttcttgtgactctccattatgcttttcagacagaaaccaagctacatctaatcttggactatattaacggtggggaactgttcacacacctgagccagagggaacgcttcactgagcatgaggtccaaatctatgtaggggagatcgtgctggccctcgagcacctgcacaagcttggaataatatatcgggacatcaagcttgagaatatcttgctcgattcaaatggccacgttgtcctgaccgactttgggctgagcaaggagttcgtggccgacgaaactgaacgcgcatattccttctgcgggacaatagagtacatggccccagacatcgtgagaggcggcgatagtgggcacgataaagctgttgattggtggagtctgggagtgctaatgtatgagctacttacaggggcttcaccttttacagtggacggagagaaaaacagtcaggctgaaatttccagacgcattctgaaatccgaacctccttacccacaggagatgtccgctcttgcgaaagacctgatccagagactcctcatgaaagacccaaaaaagagacttggctgcggcccacgggacgccgacgaaattaaggagcacctgttcttccagaaaattaattgggacgatttagccgctaaaaaagtgcctgccccctttaagccagtgatccgagacgaactcgatgtgagcaacttcgccgaggaatttacagaaatggatcccacatactcccctgcagcgctaccacagtcaagcgaaaaactgttccagggatactcgtttgtggcacctagcatcctttttaagcggaacgctgcggtcattgacccactgcaatttcacatgggggtggagagacccggagtgacgaatgtggcccgcagcgctatgatgaaagatagtcccttttatcagcactacgacctcgatcttaaggacaagccacttggtgagggttcattcagtatttgccggaaatgtgtgcataagaaaagcaaccaagcttttgctgttaagataatatcgaagagaatggaggccaatacacagaaagagataactgcactgaaactctgtgaggggcatcctaacatcgtcaaattgcacgaagtgtttcatgatcagctccatacctttttggtgatggagctactcaacggaggcgagctttttgaacggattaagaagaaaaaacattttagtgagaccgaagcaagttacatcatgaggaaactggtttccgctgtgtctcacatgcatgacgtgggcgttgttcacagggacctaaagccagaggtttag

SEQ ID NO: 4472 - DNA, 2172 bp, Artificial Sequence
  Description of Artificial Sequence: Synthetic coding sequence
atgaaggtgctgaagaaggccaccatcgtgcagaaggccaagaccacagaacacactcgaactgaacggcaggttttggagcatatcagacagtctcccttcctggttacgctccactacgctttccaaacagaaaccaagctgcacttgattctggactacataaacggtggtgagctgttcacccaccttagccaacgcgagcgttttactgagcatgaggtccagatctacgtgggagagattgtcctggcgctcgagcacttgcacaagctggggattatataccgggatatcaaacttgagaatattctcttggacagcaacggccatgttgtcctgacggactttggtctgtccaaagagttcgtggccgacgagactgagagggcttacagcttctgcggcacaatagaatacatggcaccagacatagttcgcggcggtgatagcggacacgataaggccgtcgactggtggtcgctgggcgttctgatgtatgagctgttgacgggagcgagcccattcactgtcgatggagaaaagaattcccaggccgaaattagccgtagaattttgaagagcgagccgccctaccctcaggagatgagcgcactggcaaaggatttgattcaaagattgctcatgaaagaccctaaaaagcgattaggttgcggtcctagagatgccgatgagataaaggagcatctctttttccaaaagatcaactgggacgatctggccgccaagaaggtgcccgctccatttaaacccgtgatcagagacgagcttgatgttagcaattttgccgaagagtttaccgagatggatcccacgtactctcccgcggctctgccgcagtcgagtgaaaagttgtttcagggctactcgtttgtcgccccctctatcctcttcaaacgtaatgcggccgtcattgatccacttcaattccatatgggagtggaacgacctggtgtaacgaacgtcgctagaagcgccatgatgaaagacagccctttttaccagcattacgatctggacctcaaggacaagccgttgggcgaaggctccttctcgatttgtcgcaagtgtgtccacaagaaatccaatcaggcctttgctgtgaagatcattagcaaaagaatggaagccaatactcagaaagagattaccgctctgaagctttgtgaggggcatccaaatattgtgaaactgcacgaagtgttccatgaccagctgcatacatttctcgtcatggagctcctgaatggaggggagctattcgaacggataaagaagaaaaagcacttcagcgaaacagaggcgtcttacattatgaggaagttggtctctgccgtctcccatatgcacgacgtgggcgtggtgcatagggatttgaagcccgagaacctcctatttactgacgagaacgacaatttagaaattaaaatcatcgactttgggttcgccagattaaagcccccagataaccaacctctcaagactccctgttttacactgcactatgctgccccagagctgctgaatcaaaatggatatgatgaaagctgtgatctttggagtctaggagtgattctctacacaatgctgagcggccaggttccattccagtctcacgatcgctccctgacttgtacctctgcagtggaaatcatgaagaagataaagaagggtgattttagcttcgagggtgaagcttggaagaacgtgagtcaggaagccaaagacttgatccaggggctccttactgtagatcccaataaacggcttaagatgtcgggactgaggtacaacgagtggctccaggacggcagtcagctcagtagcaacccgctgatgacacctgacatactcggaagtagtggcgcggctgtgcacacctgcgtgaaagccaccttccatgctttcaacaagtacaagagggaggggttctgcttgcaaaatgtcgacaaggcacctcttgccaagagaaggaagatgaagaaaaccagcacctctaccgagacgaggtcctcttcaagtgaatccagccactcgtcaagcagtcatagtcacggaaaaaccacccccactaagaccctgcagccaagcaatcctgccgacagtaacaaccctgagacactttttcagttctcggactccgtggcttag

SEQ ID NO: 4473 - DNA, 2238 bp, Artificial Sequence
  Description of Artificial Sequence: Synthetic coding sequence
atgctgcccttcgccccccaggacgagccctgggaccgggagatggaggtattttcggggggaggcgccagctctggcgaggtcaacgggctaaagatggtcgatgagcccatggaagaaggggaggctgattcctgtcatgatgagggagttgtgaaagagattcctatcacccaccatgttaaggagggatatgagaaagctgaccccgctcagttcgagctcctgaaagtgctggggcagggctcgttcgggaaggtgtttctggtgcggaagaagacaggacccgatgctggccaattgtacgcaatgaaggtgctaaaaaaagccagcctgaaagtgcgtgaccgggtgcgtactaaaatggagagagacatactggttgaggtgaatcaccccttcatcgtgaagctccattatgcatttcagaccgaaggtaagctctacctgatcctggatttcctaagagggggggacgtgtttacacgactatctaaagaggttctttttacagaagaagacgtgaaattctacctggcggaactggcgttggccctggaccatttgcatcagctgggtattgtttatcgggatctaaagccggaaaacattctcctcgacgagatcgggcacatcaagctgactgacttcggtctctctaaagaatctgtagaccaagaaaagaaggcttattccttttgcggcaccgtcgagtatatggcccccgaggtggtcaataggagagggcacagccagtccgcagattggtggagctatggagtcctcatgttcgaaatgctaactggaacgctgcctttccaggggaaagaccgcaacgagacgatgaacatgatcctgaaggcgaaacttggaatgcctcagtttctttctgctgaggctcaatctctgttacgcatgttgtttaaaaggaaccctgccaaccggctgggctctgaaggagtggaggagattaaacgtcacttgttctttgccaatattgattgggacaaattgtataagagagaagtgcagccaccctttaaaccggcttccgggaaacctgacgatactttttgctttgatccagagttcacagccaaaacccctaaggacagccctggactaccagcgtccgcaaacgctcaccagttgttcaagggcttctcttttgtagccacctccatagctgaggaatacaaaattacccccatcacaagcgctaatgtgctcccgattgtgcagatcaacggaaacgctgcccagttcggcgaagtctacgagctgaaggaggatatcggcgtaggttcctattccgtttgtaaaaggtgtatccacgccactaccaacatggagttcgcagtaaagatcatcgacaagtctaaaagggatccatccgaggagatcgaaatcctgatgcgatatggccaacatcccaacattatcacgctgaaggacgtattcgatgacggaaggtacgtgtacctcgtcacggacctgatgaagggaggggaactactagaccgaatcctcaagcagaagtgtttctcagaaagggaggcttccgatatcctttacgttattagtaagacagtggactaccttcactgccagggagtcgtgcaccgggatctgaaacctagtaatatcctgtatatggacgaaagcgcgagcgccgacagtattagaatctgcgattttggctttgcgaagcagttgaggggcgaaaatggcttattactcactccctgctataccgctaattttgtagcccccgaagttctgatgcaacagggatatgacgctgcttgcgatatttggtcacttggagtgctcttctataccatgctggccggctacaccccctttgccaacggtcccaatgacacaccggaggagattttgttgcgcatcggtaatgggaagttttcactctcaggcgggaattgggacaatatctccgatggcgccaaagacctcttaagccatatgctgcacatggacccacatcaacgatacacggcggaacagatactgaaacatagctggatcacacaccgagaccagcttcctaacgatcagccgaagaggaacgacgtatcacacgtcgtcaagggcgccatggtggcaacgtactcagctctgacccataaaaccttccagccagttctcgagcctgtggctgcatctagtttggctcagcggaggagcatgaaaaaaagaacctccaccggcctatag

SEQ ID NO: 4474 - DNA, 2238 bp, Artificial Sequence
  Description of Artificial Sequence: Synthetic coding sequence
atgggcctgagcaccagcgccatctggaagaacacccgggtggagatcgtcaatccctacgaggtgaaacgaaaggtcaaggtaaacggcctgaaaatggtggacgagcctatggaggaaggggaggcagactcttgccacgatgagggagtcgtgaaagaaattccgattactcaccatgttaaggaaggctatgaaaaggccgatccagcacagtttgaattacttaaggtacttggacaggggtcctttggaaaggtgttccttgtgcggaagaagaccggtccagatgccgggcaactgtatgccatgaaggtcctaaaaaaagcctcattgaaggtgcgagaccgagtccgcaccaagatggagagagacatcttggtcgaggtgaaccatcccttcatagtgaagctacactacgccttccagacagaaggaaaattgtatcttattctggatttccttcgaggcggggacgtattcactaggttatcaaaagaagtgctgtttaccgaggaggatgtgaagttctatctcgcggaactcgcccttgccttagaccatctccatcagctggggatcgtgtatcgcgatctgaaaccagaaaatatccttcttgatgagatcgggcacatcaagctgacagatttcgggcttagcaaggagtccgtggatcaggagaagaaagcgtattcattctgtggaacggtagagtatatggcccccgaagtggtgaatcgaaggggacattcccagtctgctgactggtggagctacggcgtgttaatgtttgagatgttgacagggacattgccgttccagggtaaagaccgtaatgaaactatgaacatgatcctgaaggcaaaactgggaatgccccagtttctctccgcagaggcccagtctctgctcagaatgctgttcaaaaggaaccctgcgaatcgccttgggtcagagggcgtagaggaaataaaacggcatctgttcttcgccaacattgattgggacaagctctacaaacgagaggtgcagcctccattcaagcccgcaagcggtaagcccgatgacacattttgcttcgatcctgagtttacagccaagacacctaaagattcacctggtctccccgcttctgctaacgctcatcagctgtttaagggcttttcattcgtggccacttctattgctgaagagtacaagatcacgcctatcacatcagcaaatgtcctacccattgtgcagataaatgggaacgcggcacagttcggggaggtctatgaactgaaagaagatataggcgtgggaagctacagtgtgtgcaaacggtgcatacacgcgactacaaatatggagttcgctgtcaagatcattgacaagtcaaaacgggacccatcagaggagatagagattctgatgcgttatggacaacaccccaacattatcactctgaaggacgtgtttgacgatgggcggtacgtttacctggtaacggacctgatgaagggcggtgaactccttgacagaatattgaagcagaagtgttttagtgagcgggaggcctccgatatcctatacgtgataagcaagacagtcgattatctccattgtcagggggtcgtgcacagagacctgaagccctcaaatatactctacatggatgaatctgcctccgcagattccatacgcatatgtgacttcggcttcgccaaacagctgcggggtgagaacggcctgctgctgaccccttgctatacggccaatttcgtcgctccagaggtgttaatgcaacagggctacgacgcagcttgcgacatttggtctctgggagtgctcttttatactatgctggcagggtatacgccctttgcgaacggccccaatgacacacctgaggagatcctgcttcgaatcgggaacggcaagttcagtcttagtggtggcaattgggacaatatctcagacggcgcaaaagatctgctgagccacatgttgcacatggatcctcaccagcggtatactgccgaacagatattgaaacactcatggattactcacagagaccaattgccaaatgatcagcccaagcgcaacgacgtgtcacacgtcgtaaagggggccatggtggccacatattcagccctgacccataaaacgtttcagcctgtattagaacccgtcgccgcatctagccttgcccagagaagatccatgaagaaaagaaccagcacagggctgtag

SEQ ID NO: 4475 - DNA, 1626 bp, Artificial Sequence
  Description of Artificial Sequence: Synthetic coding sequence
atgagcctggtggcctgcgagtgcctgcccagccccggcctggagcctgagccctgcagtagggcaaggtcccaagcacacgtgtacctggagcagattcggaaccgcgtggcgttaggcgtgcctgacatgaccaagcgggattacctcgtggatgccgccacacagatccggctcgcccttgagcgagatgtcagcgaggactacgaagccgccttcaaccattatcagaatggcgtcgatgttctcctccgagggatacacgtcgatccaaacaaggagagacgcgaggcggtcaagctgaaaatcacaaagtatctgagacgtgctgaagagatttttaattgccacttacaaagaccgctcagcagcggagcttctcctagcgcggtgcagctcgttcaggatccagccacaggtgggaccttcgttgtgaagagcctgcctagatgtcacatggtgtcacgggagcgactcacaatcatcccccatggcgtgccttacatgactaagttactaaggtacttcgtgtctgaggattcaattttcctccatttagaacacgtgcagggagggactttgtggtcccatttgctgagtcaagctcactccagacattccggcctgagctccggctccacacaggaaagaatgaaagcgcagctgaatcctcacctcaatctgctcacaccagctcgtctgccctcaggccatgcccccggacaagatcggattgcactggaacctccccgcacctctccgaaccttttactcgcaggcgaagcacccagtacccggccccagcgtgaagctgaaggcgagcccacggcgcgtactagtacatcggggagctccgatttgccaaaggctccaggtggccacctgcacttgcaggccagacgggctggccaaaatagtgatgctggaccaccccgggggttgacgtgggtccctgaaggagccggccctgtgttgggcgggtgcggacgcggaatggatcagtcgtgtctgtccgctgacggtgctggtagagggtgtggcagagcgacctggagcgtgcgcgaagaacaggtgaaacagtgggccgccgaaatgttggtcgccctggaggctttacacgagcagggtgtactgtgtcgggacctgcatccggggaatctgctcctggaccaagctggccatataaggctcacctactttgggcagtggtcagaggtagaaccacagtgttgtggggaagccgtggataatctttatagtgcaccagaagttgggggcataagcgagctcaccgaagcttgtgattggtggtccttcggctcactactgtatgagctgttgaccggcatggcactgagtcagagtcatcccagtggaattcaggctcacacccagctacagctgcccgagtggcttagtagacccgctgcatcattgctaaccgaactgcttcagttcgagcctacccgaagactagggatgggggagggcggtgtcagcaagctgaagtcacatccttttttttccactattcaatggtccaaactggtagggacctcgctggagacacacctgcggactcttattcattggctgtccgggcctaaacccgattgtccgggctag

SEQ ID NO: 4476 - DNA, 1650 bp, Artificial Sequence
  Description of Artificial Sequence: Synthetic coding sequence
atgagcctggtggcctgcgagtgcctgcccagccccggcctggagcctgaaccatgctctagggcccggagtcaagcacatgtgtatctggagcagattaggaatcgggtcgctctaggcgtgccggatatgaccaagcgcgactacctagtggacgccgcgactcaaataaggctggctctggagcgcgacgtcagtgaggattacgaagccgccttcaatcattaccagaacggagtggacgtgttgctgcgcggcattcacgtcgaccctaacaaagaacgtcgggaggccgtgaaactgaagattaccaaatatctgaggcgcgccgaggagatttttaactgtcacctccagcgtcctctttcttctggtgcttctccatcggcaggctttagctctcttcgtctccgaccaatcagaactctgtctagcgcagtcgaacaactacgcggttgtagggtagtcggagtgatcgaaaaggtgcagctggttcaagatccagccacaggaggcacatttgtggttaagagtcttccaaggtgtcatatggtctccagagagagactgacaattattccccacggcgtcccttacatgacaaagttgctgcgctacttcgtctccgaagattcgatctttctccacctggaacatgtacagggaggaacactgtggtcccacttactctcacaggcgcatagcaggcactcaggcctgtcatcgggatccactcaggaacgcatgaaagcgcaactcaacccacatctcaacctgctgactcccgcgcggctgccctccgggcacgccccaggccaggatagaatcgccctggaaccccccagaacatcccccaatttactcctggcgggcgaggcaccttctacgaggccgcaacgagaagcggaaggtgagcccacggccaggacaagcaccagcggcagcagcgacttacctaaagcccctggcggacatttgcatctgcaggctaggagggcaggacagaactcggatgctggacccccgcgcggcttaacctgggtcccagagggcgctggcccagtcctcggtgggtgcggacggggcatggaccagagttgcctgtcggccgacggcgccggaagaggatgcggtcgggcaacatggtccgtcagagaggaacaagtcaaacagtgggcagcggaaatgttggtggccctggaggcgctccacgaacagggtgtcttatgtagggatctgcaccccggaaatctgctcctcgaccaagccgggcacatccgtctgacgtactttggccagtggtcagaagttgaacctcagtgttgtggcgaagcggtcgataatttgtatagtgccccggaagtgggcgggatctcagaactgacagaggcttgcgattggtggagcttcgggagtttgctctacgagttacttaccgggatggctctttcacagtcccacccatccggcattcaggcccatacgcaattgcaacttccggaatggctgtctcgccctgccgcgtccctgctcaccgaactcttgcagtttgaaccaaccaggagattgggaatgggcgagggcggggtctctaaattgaagtcacatcctttcttttcaaccatccagtggagtaagctagtcggatag

SEQ ID NO: 4477 - DNA, 1650 bp, Artificial Sequence
  Description of Artificial Sequence: Synthetic coding sequence
atgagcctggtggcctgcgagtgcctgcccagccccggcctggagcctgagccttgctcaagggcccgttcccaagctcacgtgtacttagagcagattcggaaccgggtggccctgggagtgccagatatgaccaaacgggactatctcgtagacgcagctacccagattcggctcgcccttgaacgggatgtgtccgaagactacgaagccgcatttaaccattaccaaaacggcgttgatgttttgctcaggggcatccacgtggatccaaacaaggaacgtagggaggctgttaaactcaagattacaaagtacctgagaagggctgaggagatctttaattgtcacctgcagcggcccttaagcagcggagcgtccccctccgctggctttagtagcttgcgcctacgaccaatccgaaccctgtccagcgccgtggaacagttgagaggctgtagagtggtcggtgtaattgagaaggtgcagctggtgcaggacccagctaccgggggcacattcgttgtgaagtcgctgcccaggtgccacatggtgtctcgggagcggctgactatcatcccacacggcgtcccctatatgactaaactcctgcgttacttcgtcagtgaggacagtatcttcttacacctcgagcacgtacaaggtggcacactgtggtcccatttactttctcaggcccacagtagacattcgggactgagtagcggttcgacgcaggagagaatgaaagcccaactgaacccccacctgaaccttctcacccctgcccgactgccaagcgggcacgcccctgggcaggataggattgcgcttgagccccctcgcaccagtccgaacttgttgctcgcgggggaggctccgtccacccgaccgcaaagggaggccgaaggggagcctacagcgcgcaccagtacttccgggtcttccgacctgcctaaagcccccggcggtcatcttcacctgcaagctcggagggccggccaaaactctgacgccggtcccccccgtgggctgacatgggtgccagagggcgctgggcctgttctggggggatgtggacgggggatggatcagtcctgcctgtccgccgatggcgctggaagggggtgcgggagggcaacttggagtgttagggaagaacaagtgaagcagtgggctgccgagatgctggttgcgctggaggctcttcacgagcagggggtgctgtgccgcgacctccaccccgggaatctacttttagatcaggccggacacatcaggctgacatacttcggccagtggtcagaagtggaacctcagtgttgtggcgaagcagtggataacctgtatagtgctccagaggtcggcgggattagcgagttaacggaggcctgtgattggtggtccttcggctcgctgctttatgagttactgacagggatggctctgagccagtctcatccctcaggcatccaggcccacactcagctccaactacctgagtggctctcgcgccccgcagcctcactgcttactgagctgctccagttcgagccgacacggaggctgggaatgggcgagggtggtgtaagcaagcttaagtctcatccattttttagtacaattcagtggagcaaactggttggatag

SEQ ID NO: 4478 - DNA, 30 bp, Artificial Sequence; identical to SEQ ID NO: 2303
  Description of Artificial Sequence: Synthetic coding sequence

SEQ ID NO: 4479 - DNA, 1650 bp, Artificial Sequence
  Description of Artificial Sequence: Synthetic coding sequence
atgagcctggtggcctgcgagtgcctgcccagccccggcctggagccagaaccttgctctcgggccagaagccaggctcatgtatacctggaacaaattagaaacagggtggcccttggcgtgcctgatatgacaaagcgcgattaccttgtggatgccgccacccaaattagactggccctcgagcgcgacgttagcgaggattacgaagccgccttcaatcattatcagaacggggtggacgtacttctcaggggcatacatgttgaccccaataaggagaggcgggaggcggtgaagctcaagattactaaataccttagacgcgctgaggagatctttaattgtcatcttcaacgtcccctcagcagtggggcctctccctccgcgggcttcagcagtttacgactccggcctatacgtactctgtctagcgccgtggagcagttaagaggctgcagggtagtcggcgtgattgaaaaggtgcagctcgttcaagacccagcaaccggcggtacgtttgtcgtgaaatcattgcctcggtgtcacatggtgagccgcgaaagactgactattatcccgcatggggtgccttatatgactaagcttctgcggtactttgtgtccgaggacagcatttttcttcatctcgaacatgtccagggtggtacactttggtcacatctactgtctcaggcccactccaggcatagtggcctcagttccggaagtacacaagaacgaatgaaggcgcagctgaatccccacctaaacctgcttactcccgcccgtctcccttctggccacgcccccggacaggaccgcatcgcactggaaccccctagaacttcccccaatctgctactggcgggcgaggcaccctccacccggccacagcgcgaggccgagggcgagccaaccgcaagaacctctacttcaggatcttccgacctgccaaaggccccaggcggacacctgcacctacaagcccgccgggccgggcagaactccgacgctggaccccccagggggcttacctgggttccagaaggagctggccccgtgctgggcggttgcgggcgtggcatggaccagtcctgtctaagcgctgacggagccggacggggctgtggcagggccacttggtccgtgcgggaggagcaagttaagcaatgggccgcagagatgctagtggctctggaggccctgcacgagcagggggtgctgtgcagagacttgcatcccgggaacctactgctggaccaggccggccatatacgactgacttacttcggtcaatggagcgaagtggagcctcagtgttgcggagaggccgttgacaacctgtacagcgctcctgaagtcggaggtatatctgagttaactgaggcgtgcgactggtggtcttttgggtccctgctgtacgagctcttgacaggcatggcactgtctcaatcccatccctctggaattcaagctcatacccaactgcagctcccggagtggctgtcgagacccgcggcctccctgctcaccgagctcctgcagtttgaacccaccaggcgcctaggaatgggagaaggaggagtgtctaagctgaaatcccatccattcttcagcactattcagtggagcaagctggttggctag

SEQ ID NO: 4480 - DNA, 1818 bp, Artificial Sequence
  Description of Artificial Sequence: Synthetic coding sequence
atgctgccccagcaggtgggcttcgtgtgcgccgtgctggccctggtttgttgcgcatctggcctattcggtagcctgggccataagaccgcctccgctagcaaacgcgttttgcccgatacatggcgaaatcggaagctgatggcccctgtgaacggtacccagacagcaaaaaattgtacggatcccgctatacatgaattccctaccgatctgttctccaataaggaacgacaacacggcgccgtgttactgcacatccttggggctctgtacatgttctatgccttagctattgtgtgcgatgatttctttgtgccatcattggaaaagatttgtgaacgattgcacttatcggaagatgtggccggagcaacgttcatggcagctgggtccagtacacccgagctgtttgcaagcgtcatcggtgtgtttattacacacggggacgtcggcgtgggaacgatcgttgggtcagctgtatttaacatcctgtgcatcataggagtgtgcggattgttcgctggccaggtggtgcgcctgacgtggtgggctgtctgccgggattccgtgtactacaccatcagcgtaattgtacttattgtgtttatctacgacgagcaaattgtgtggtgggagggacttgtgctcatcatcttgtacgtcttctatattcttatcatgaagtacaacgtcaagatgcaagccttcttcacagttaagcagaagagcatagcaaatggtaatccggttaatagcgaactcgaagcgggaaacgacttctacgacgggtcttacgatgaccccagtgtccctctgttgggacaagttaaggagaaaccacagtacggaaagaatcctgtcgtgatggtcgacgaaataatgagttcctctccacccaagtttacctttcctgaagctggcctgaggattatgatcaccaataagttcggaccccgaacccgactgaggatggcaagcaggatcatcataaacgaaaggcagagactgatcaactcagctaatggggtgtcatccaagcccctccagaatgggagacatgaaaacatcgagaacggcaacgtccctgtggaaaaccccgaggatccccagcagaatcaggagcaacagccaccaccccagccacctccacccgaacccgaaccggttgaggcagactttttgtcacccttcagcgtccctgaagcccgcggagacaaggtgaagtgggtattcacttggccactgatcttcctgttatgtgttacaattcccaattgtagcaagcctaggtgggaaaaattcttcatggttacatttatcacagctaccctttggatcgccgttttttcctacatcatggtgtggctggtcaccattatcggatacactcttggcatacccgacgtgataatggggataacctttctggctgccggcacgagcgtgcctgattgtatggcctccctgatagtcgccaggcaggggctgggagacatggctgtgtctaataccataggatcaaatgtttttgacattcttgtgggtctcggcgttccttggggacttcagactatggttgttaactacgggtccaccgttaagatcaactctcgaggactcgtgtattccgtggtgttgctcctgggcagtgtggcgctgaccgtcctgggtatacatcttaacaagtggagattggaccggaagctgggggtgtacgtactcgttctgtacgccatctttctctgtttttccattatgattgaattcaacgtctttacctttgtaaacctgccaatgtgcagggaggacgactag

SEQ ID NO: 4481 - DNA, 1059 bp, Artificial Sequence
  Description of Artificial Sequence: Synthetic coding sequence
atgttctacgccctggccatcgtgtgcgacgacttcttcgtgccctcactcgaaaaaatatgcgagcgattacatctgtctgaggacgttgccggtgctactttcatggccgccggatccagcaccccagaactctttgccagcgtcattggggtgtttatcacacacggagatgtcggcgtgggcacaatatctgtcagctttgccctacagttcatatacgacgagcagatcgtgtggtgggaaggccttgtgcttataattctgtatgtgttttacattctgatcatgaagtacaacgttaaaatgcaagctttttttactgtgaagcagaaaagcatcgctaacgggaatcccgtcaattcagaactggaggccggcaatgatttctatgatggaagctacgatgatccatctgttcctctgttaggacaggtaaaggagaagccacagtatggaaaaaaccccgttgttatggtggacgaaattatgtcaagcagtccacctaagttcacattcccagaggctggactgcgcatcatgatcaccaacaaattcgggcctcgcacaagattgaggatggcttcccggattatcatcaacgaacgccagcggctgatcaatagtgcaaatggggttagcagcaagccccttcagaatggaaggcatgagaatatcgagaacggaaacgttccagtggaaaacccagaagacccccagcagaatcaagagcagcagccacccccccaaccccccccccccgagcccgagcccgttgaggctgattttctttctccattctcagtacccgaagccagaggagacaaagtaaagtgggtcttcacttggccactgatctttctgttgtgcgtcacaattcctaattgttcaaaaccgcggtgggaaaagttctttatggtcacatttatcactgcaactctgtggatcgccgtgttctcgtacatcatggtctggttggagcaaagggaaggaaaacaattccaacacggctgttcctcagtggactgtgagacacatagtcagccactgacgccatag

SEQ ID NO: 4482 - DNA, 1761 bp, Artificial Sequence
  Description of Artificial Sequence: Synthetic coding sequence
atgctgccccagcaggtgggcttcgtgtgcgccgtgctggccctggtctgttgcgcctccggcttattcgggtccctgggtcataagaccgcttcggccagcaaacgggtgctgcccgacacatggcggaacagaaagctgatggcccctgtcaatggcacacagacggctaagaactgtaccgacccagctatccatgaattccccacagacctttttagcaacaaggagagacagcacggtgccgtgcttctccacatccttggcgccctgtatatgttctatgccttagccattgtgtgcgacgatttcttcgtcccttcactggaaaagatttgcgagcggcttcacctgtctgaagacgtcgctggtgcaacatttatggccgctggctcttctactcctgaattgttcgccagtgtgattggcgttttcattacgcatggcgacgtaggagttggaacgattgtgggcagcgcagtgttcaacatcctctgtatcataggggtgtgcggcctgttcgccggccaagtcgtgcgactaacttggtgggctgtctgccgcgattcggtgtactacacaataagcgtgattgtgctgattgttttcatctatgatgagcaaattgtgtggtgggaggggctggtgctgattatcctgtacgtgttctatatcttgatcatgaaatacaatgtgaaaatgcaggcctttttcactgtaaaacagaaaagtatcgcgaacggcaatccagtgaattcggagctcgaggcagttaaggagaaacctcagtacgggaagaaccctgttgtgatggtagacgaaatcatgtcaagttctcccccgaaatttacatttcccgaggcgggactgagaataatgatcacaaacaagttcggacccaggaccaggcttagaatggcctctaggatcatcatcaacgaacggcagcgcctgatcaactcagctaacggcgtatcttctaagcccctgcagaacgggagacatgagaatattgagaatggaaatgtacccgtggagaatcccgaggacccccagcaaaaccaggagcagcagcctcctccccagccccctccgccagaacctgaaccggtagaagccgatttcctctccccattttctgtccctgaggcacggggagataaagtaaagtgggtgttcacctggcctctcatttttctcttatgcgtgaccatcccaaactgtagcaagcctcgatgggaaaagttctttatggttacttttattactgctaccttatggatcgccgtattctcctacatcatggtctggctggtgaccattatcggctatacccttggaatacccgatgttattatggggattacgttcctggccgccggcacttcagtgcctgattgtatggctagcctgatcgtggcgagacagggactgggtgacatggcagtctccaatactatcgggtccaatgtcttcgacattctggtgggacttggagtgccctggggattgcagactatggtcgtaaattacggatccacagtcaaaatcaactctcgcgggttggtctactctgtggttttactcttggggtccgtggctctcacggtgctcgggattcacctcaataagtggagacttgatcgcaaactaggggtctacgtgctggtgctgtacgccatctttctatgcttctctatcatgatcgagtttaacgtgtttacgtttgtgaatcttccaatgtgtagggaggacgactag

SEQ ID NO: 4483 - DNA, 1677 bp, Artificial Sequence
  Description of Artificial Sequence: Synthetic coding sequence
atggcccccgtgaacggcacccagaccgccaagaactgcaccgacccagcaatccatgaattccccactgacctcttctccaacaaggagagacagcacggcgccgtgctgctgcacatactcggcgcgctgtatatgttttacgctctcgccatagtctgcgacgacttttttgtgccttcccttgagaaaatctgcgagagattgcatctctccgaggacgtcgcgggggccaccttcatggccgcagggagtagtacccctgaacttttcgctagcgttatcggggtctttattactcacggagatgtgggagtcgggacaatagtggggtctgcagtgtttaacatactgtgcattataggcgtttgcggcctcttcgctggtcaagtagtgagactcacatggtgggcagtatgccgcgacagtgtgtactacacaatatccgtgatcgtccttatcgtctttatttatgacgaacagattgtgtggtgggagggactggttctcataatcctgtatgtattctatattcttataatgaagtacaatgtgaaaatgcaggctttttttaccgtgaaacaaaagagcatagctaatggaaatccagtcaacagcgagcttgaagcaggcaacgatttctatgacgggtcttacgacgatccgagcgtcccgctcctcgggcaggtcaaggaaaagcctcagtatggaaaaaacccagttgtcatggtggatgagatcatgagcagcagtccaccaaagtttaccttcccagaggcaggcctgcggatcatgatcaccaacaagtttggacctcgcactagacttaggatggccagcaggatcattataaatgaaaggcagcgacttattaattcggctaatggcgtgtcatcgaagcccttacagaatggccgtcatgagaatattgaaaacgggaatgtacccgtggaaaatccggaggacccacagcagaaccaggaacagcagccaccaccacagcccccgcctcctgagccagagcccgtagaggccgatttcctgagcccctttagcgtgcccgaggccagaggcgacaaggtgaaatgggtattcacatggccccttatcttcctgctgtgcgttaccatccccaactgctccaagcctcggtgggaaaagttttttatggttaccttcattactgccaccctgtggatcgctgttttctcgtatattatggtgtggcttgttaccataattggctatactctggggatcccggacgtgattatgggtattacattcctcgccgccgggacctccgtgcccgattgtatggcatccctgattgtcgctcgccagggcctcggagacatggcggtgagcaacactatcggaagcaacgtcttcgacatcctagtgggcctcggagtgccttgggggctgcagaccatggtagtcaactatggatcaacggtgaagattaactcgcgcggccttgtttacagtgtagtgctcctactgggttcagtggctctaaccgtactcggaattcatttgaacaaatggcgattggatagaaaattgggcgtatatgtgctggtgctttatgcgatcttcttatgcttctctatcatgattgagtttaatgtcttcacttttgtgaatcttcccatgtgtagagaggatgactag

SEQ ID NO: 4484 - DNA, 1812 bp, Artificial Sequence
  Description of Artificial Sequence: Synthetic coding sequence
atggccctgcggggcaccctgcggcccctgaaggtgcggcggcggcgggagatgctgccacagcaagttggtttcgtgtgcgcggtactggccctggtgtgctgtgcctctggcctgttcggtagcctcgggcataagaccgcttcagcctcaaaaagggtgctgccagatacatggcgcaaccgcaagctgatggctcccgtgaatggcactcagactgcaaagaactgcacagatcctgccattcatgaatttccaacagacctattctcaaacaaggagagacagcacggcgctgtgttgttgcacattcttggtgcgctgtacatgttttacgctctggccattgtttgtgacgacttcttcgtcccaagccttgagaagatttgtgagaggctgcatctcagtgaggacgtggccggggccacattcatggccgctggtagctcgacacccgagctgttcgcctcagtgattggagtgtttataactcacggcgacgtcggcgttggaaccatcgtggggtcagctgtgttcaatattttgtgcatcatcggcgtgtgtggtctgtttgccggacaggtagtacgcctgacttggtgggccgtgtgccgggacagtgtctattacacaatttcagtgatcgtgctcattgtgtttatatacgatgagcaaatcgtttggtgggaaggcttagtcctcataatcctgtacgtcttctatatattgattatgaagtataacgtgaaaatgcaggccttcttcaccgtgaagcagaaatcaattgctaatggaaaccctgttaactccgaattggaggcagttaaggagaaacctcaatatggtaagaatcctgtggtgatggtggatgagatcatgtccagcagtcccccaaagtttacctttcccgaagccggcctgcggatcatgatcactaataagtttggccccagaaccaggctaagaatggcctcacgtattatcattaacgagcgtcaacggctaatcaactccgcaaatggcgtgagttcaaaacccttacagaatggcagacacgaaaacattgagaatggcaacgttcccgtggaaaatcccgaggaccctcagcaaaaccaagagcaacagcctcccccacagccaccgccacccgagccagagcccgtggaagccgacttcttatccccctttagcgtccccgaggcaaggggggataaggtgaaatgggtgtttacatggcctctgattttcttactctgcgtgacaatacccaactgttccaagcccagatgggaaaaattttttatggtgacattcatcaccgccaccctctggattgccgttttttcgtatattatggtgtggctggtcacgattataggctacacactcgggatccctgacgtgattatgggaataacttttttggcggcgggcacatctgttccagactgcatggcctctctcatagtggctcgccagggccttggagatatggcggtcagcaatactatcggctctaatgtgtttgacattctcgtagggctgggcgtgccctgggggctgcaaacaatggtggttaactacggcagcaccgtgaagatcaatagtagaggcttagtgtatagcgtggttctgttattaggttccgttgcactgactgtactgggtatccacctgaacaaatggcgcctggacagaaagctcggggtgtatgtgttggtgttatatgcgatcttcctttgtttttccatcatgatagagttcaatgtgttcaccttcgtgaatctcccaatgtgtagagaagatgattag

SEQ ID NO: 4485 - DNA, 1869 bp, Artificial Sequence
  Description of Artificial Sequence: Synthetic coding sequence
atggccctgcggggcaccctgcggcccctgaaggtgcggcggcggcgcgagatgctcccacagcaggtcggcttcgtttgtgcagtgctcgccctagtgtgctgcgctagcggcttatttggaagcctgggtcacaagaccgcaagcgcttccaagagggtattgcccgacacgtggcgtaacagaaagctgatggcacctgtgaacggtactcagaccgccaaaaactgtactgatccggccattcacgagtttccaacagatctattctccaataaggagcggcaacatggggctgtgttactccatatccttggggcgttgtatatgttctacgctcttgctatcgtctgtgatgatttttttgttcccagtctggagaaaatctgcgagcggctgcatttgagcgaagatgtagcgggcgctacattcatggccgcaggtagcagtacccccgagctctttgcatccgtgatcggagtgtttattacccatggagacgttggggtcggcacaattgttgggtctgccgtttttaatatcttgtgtataatcggcgtgtgtggcttgttcgctggccaagtggtgcgcctcacatggtgggccgtgtgtcgagacagcgtctattacaccatatctgttatcgtccttattgtgtttatatacgacgagcaaatcgtgtggtgggaagggctagttctaatcatcctctacgttttctatatcctgattatgaaatacaacgtgaaaatgcaagctttttttacggtgaagcagaagtcaattgcaaacggaaacccagtgaactcagagcttgaggccggaaatgatttctacgatggaagttacgacgatccctctgtccctctcttgggacaggttaaggagaaacctcagtacggaaaaaatccagtggttatggtggacgagattatgtctagctcaccgcctaagtttacttttccagaagcagggttaaggatcatgatcactaataagttcggcccgcggactaggcttaggatggccagtcggatcatcatcaatgagcggcagagactgattaatagtgcaaacggggtgtcctcgaagcctctgcaaaacggacgacatgagaatatagagaacggaaatgtgccagttgagaatcccgaagacccccagcagaatcaagagcagcagcctcctccacaaccccccccacccgagcccgaaccggtcgaagcagattttctgagcccatttagtgtgccagaagcgagaggcgataaagtgaagtgggtctttacatggccgctcatcttcctgctatgtgtgaccatccccaactgttctaagccgcgctgggagaagttttttatggtcactttcatcactgccaccctgtggatcgctgtctttagttacattatggtatggttggtgacaatcatcggttacacactcggcatacccgacgtgattatgggtattacattcctcgcagccgggacctccgttcccgactgcatggcctccttgattgtcgcccgacagggcttgggagacatggccgtgtctaacaccatcggaagcaacgtgttcgatatcctggtggggttgggggtcccatggggcttacagaccatggtagtaaactacggttccactgtgaagatcaattccagaggactggtgtatagcgtcgtgctgctgcttgggtcggtggctttaaccgtgctgggtattcacttgaataaatggagactggatagaaaactaggggtgtatgtgcttgtgttgtatgctatcttcttgtgctttagcatcatgatcgaattcaacgtttttactttcgtaaaccttccaatgtgccgggaggacgattag

SEQ ID NO: 4486 - DNA, 1503 bp, Artificial Sequence
  Description of Artificial Sequence: Synthetic coding sequence
atgcagaccaagggcggccagacctgggcccggcgggccctgctgctgggaatcctgtgggctactgcccatcttcctctctccgggaccagtctcccgcagagactgccacgggccactggcaacagcacccagtgtgtcatttcgccttcctcagaatttccagaagggtttttcacaagacaagaacggcgagacggcggaattatcatttacttcttgattatcgtttacatgttcatggcgatttcgattgtgtgtgacgaatactttctgccctccctggagatcatcagcgagtcacttggtctttcgcaggacgtggctggtacgaccttcatggcagccgggtctagcgccccagagcttgtcacagcttttctcggagtgttcatcaccaagggagacattggaatctcaacaatcctgggttccgccatatacaaccttctcgggatctgcgcagcctgcgggctgttgagcaatacagtctctaccctgagctgctggcctttgttccgcgattgtgctgcctacactatcagcgccgccgcagttctggggatcatctacgacaatcaggtgtactggtatgaaggtgcattgttgctactcatttatgggctgtatgtgttagttctgtgcttcgacattaaaatcaatcagtacataataaagaagtgttccccatgctgcgcctgtctggcaaaagctatggagagatcagaacagcaaccactcatgggatgggaagacgagggccagccattcatccgccgccagagtagaacagactccgggatcttctatgaggattccggttactcccagctgagcatctctctgcacggactttcgcaagtcagcgaggatcccccctcagtgttcaacatgcctgaagccgatctcaaacgcatattttgggtgctctccctccctattattacgttgctctttctaaccacccccgactgtcgcaaaaaattttggaaaaactactttgtaatcacattcttcatgtctgccatatggatctccgctttcacatacattctggtgtggatggttactattacaggcgaaaccctggaaatcccggacaccgtgatgggcctgacactgctagccgccggcacatccatcccagacactatcgcgagcgtgctcgtggctaggaaaggaaagggagacatggcaatgagcaacatcgtgggctccaacgttttcgatatgctgtgtcttggtataccgtggtttattaagacagcatttataaacggttcagctccagccgaagttaactcccgcgggctcacctacataacaatctcactaaacatcagtatcattttccttttcttggcagttcattttaacggatggaagctggacaggaaactgggaatcgtgtgccttttgagttacttgggtcttgcaacactgtccgtcctttacgaactcggtataattgggaataataaaattcgtggctgcggcggttag

SEQ ID NO: 4487 - DNA, 1323 bp, Artificial Sequence
  Description of Artificial Sequence: Synthetic coding sequence
atgcagaccaagggcggccagacctgggcccggcgggccctgctgctaggcatactgtgggctacagctcaccttccactttctggaacttctctacctcagagattgccaagagctactgctctgggcctcagccaggacgtcgccggcaccacatttatggccgccggcagctctgcccctgagctggtgacagctttcttgggcgttttcattaccaagggcgacatcggaatctcaaccatcctgggtagtgcaatctacaacctgttaggaatttgcgctgcgtgtggtcttctgtctaacacagtgtctaccttgtcctgctggccactgttccgggactgcgccgcttacaccattagtgccgccgctgttctcggtataatctacgataaccaagtgtactggtacgaaggcgctttattactactgatctacggcctttacgtattggttctgtgctttgacatcaaaatcaaccagtatattatcaagaaatgttcgccctgttgcgcctgccttgcgaaggctatggagcggagcgagcaacagcctcttatggggtgggaggacgaggggcagcccttcattcgccgacagagccggacagactctggcattttttacgaagattctggttacagtcagcttagcatctcattgcacggcctgtctcaggtaagcgaagaccctcctagcgtgttcaatatgccggaggctgacctcaagcgtatcttctgggtactgagtttacccattatcactctcttgttcctaaccacccccgattgtcgcaagaagttctggaaaaattattttgttatcacgtttttcatgagcgcgatctggatcagcgcattcacttacattctggtgtggatggtcactatcactggtgagaccctcgaaatcccagataccgtgatgggcctgactctgctggccgcaggaacctccattcctgataccatagcctcggttctcgttgcacgaaaaggtaagggcgatatggccatgtctaacatagtcggatcaaatgtgttcgatatgctgtgcctgggaattccttggtttattaagactgcctttatcaacggcagcgcaccagctgaggtgaatagcaggggcctgacttatattacaattagcctcaatatttctataatctttttatttcttgcggtccacttcaatggttggaagttagacaggaaactgggaatagtctgcctcctgagctacttgggtctggcgacactcagcgttttgtacgaactcggtatcataggaaacaataagatccggggctgtgggggctag

SEQ ID NO: 4488 - DNA, 552 bp, Artificial Sequence
  Description of Artificial Sequence: Synthetic coding sequence
atgctgagccgggccgtgtgcggcaccagccggcagctggcccccgttcttgggtacctagggtccagacagaagcattccctgccggatctgccctacgattacggagccctggaaccccacattaacgcacagattatgcagctgcaccattccaagcatcatgctgcgtacgtgaataacctaaacgtgaccgaagaaaagtaccaagaggccctcgccaagggagaattactggaggcgattaagagggatttcggtagcttcgacaagttcaaagaaaaacttaccgctgcaagcgtgggagtgcagggaagtggctggggctggttggggttcaacaaggaacggggtcaccttcagatcgccgcatgtccaaaccaggatcccctgcagggcacaacaggccttatcccactgttgggcatagacgtatgggaacatgcctattatttgcagtataagaatgtgagacccgactaccttaaagccatttggaatgttatcaattgggaaaatgtaaccgaacggtatatggcctgcaagaagtag

SEQ ID NO: 4489 - DNA, 552 bp, Artificial Sequence
  Description of Artificial Sequence: Synthetic coding sequence
atgctgagccgggccgtgtgcggcaccagccggcagctggcccccgtgctcggctatcttggttctcgccagaagcattctttgccagacctaccctacgattacggagctctggagcctcatattaacgcccagatcatgcagctacatcacagcaagcatcatgctgcttatgtgaataacttgaatgtgacggaggagaagtatcaggaagccctggctaagggggaacttctggaggcaattaaacgcgatttcggcagtttcgataagtttaaggagaaattaacagcagcatccgttggcgtccaggggtctggctgggggtggctgggctttaacaaagagagaggacacttgcaaattgcggcttgtccgaaccaggaccctctccagggtactaccggactcattcctctgttaggcatcgacgtgtgggaacatgcctattacctccagtataaaaacgtcagaccggactatctcaaggcaatctggaatgttattaactgggaaaatgttacggagcgatatatggcttgcaagaaatag

SEQ ID NO: 4490 - DNA, 669 bp, Artificial Sequence
  Description of Artificial Sequence: Synthetic coding sequence
atgctgagccgggccgtgtgcggcaccagccggcagctggcccccgtactgggctaccttggtagccgccagaagcactctcttccagacctgccgtatgattatggtgcgctggagccccacattaatgcccagatcatgcagctccatcactccaagcatcacgccgcatatgtcaacaatcttaatgtcactgaggaaaagtatcaagaggccttggctaagggagacgtgacggcgcagattgctttacaaccagcactgaagttcaacggggggggtcacatcaaccactctatcttttggactaatctttcaccaaatggcggcggcgaaccgaagggggaactgctggaggccattaagcgggactttggttctttcgataaattcaaagagaagctaacagccgcaagcgtgggcgttcagggtagtgggtgggggtggttggggttcaacaaagaacgcggccatctgcagatcgcagcctgtccaaatcaggatccgctgcaaggcactaccggtctgatccccctccttgggatcgacgtgtgggagcacgcctactacctgcagtacaagaacgtgcggcctgactatcttaaggccatctggaacgtgataaattgggagaacgtgacagaacggtatatggcctgtaagaagtag

SEQ ID NO: 4491 - DNA, 669 bp, Artificial Sequence
  Description of Artificial Sequence: Synthetic coding sequence
atgctgagccgggccgtgtgcggcaccagccggcagctggcccccgtgctggggtatcttggttctaggcaaaaacattctctgcccgatctgccctacgattatggagcactggagccccacatcaatgctcaaatcatgcaactgcatcattcaaagcaccacgcagcttatgttaataatctgaatgtaaccgaggaaaagtaccaggaggccctggctaagggcgacgtgaccgcccagatcgctctccaaccagcccttaaattcaacggcgggggccacattaatcattcgatcttctggaccaacctatccccaaacggaggtggtgagcccaagggcgagctgcttgaagctatcaaacgagacttcggatcttttgacaagttcaaggaaaaattaaccgctgccagcgtcggtgtgcagggctcgggctggggatggctgggcttcaacaaagaacgtggccacctacaaatagccgcatgcccaaatcaggatcctctgcaaggcactaccgggcttatacccctcctgggcatcgacgtgtgggaacacgcctactacctccagtataagaacgtcagacccgactacctcaaggccatctggaatgtgatcaattgggagaatgtaaccgaacggtatatggcgtgtaagaagtag

SEQ ID NO: 4492 - DNA, 531 bp, Artificial Sequence
  Description of Artificial Sequence: Synthetic coding sequence
atgcagctgcaccacagcaagcaccacgccgcctacgtgaacaaccttaacgtgacggaggaaaaataccaagaagctttggccaaaggggacgtgactgcacagattgcactgcagccagcactgaagttcaatggcggaggccacatcaaccatagtatattttggacgaacttgtctccgaacggcggaggcgaaccgaagggcgagctgctcgaggcaatcaagagagacttcggcagctttgacaagttcaaagaaaagttaaccgctgctagcgtgggggtgcagggaagcggatgggggtggctgggatttaacaaggagagaggccacctgcagattgccgcctgcccgaatcaggatccccttcagggcacaaccgggctgatcccccttctggggatcgacgtgtgggagcacgcatattatttgcagtataaaaacgtgagaccagactatctgaaagcaatctggaacgtaatcaactgggagaacgtgactgaacggtacatggcctgcaagaagtag

SEQ ID NO: 4493 - DNA, 723 bp, Artificial Sequence
  Description of Artificial Sequence: Synthetic coding sequence
atgctggccctgctgtgcagctgcctgctgctggccgccggcgcctcagacgcttggaccggcgaggattccgccgaacctaacagcgacagcgccgagtggattcgagatatgtatgccaaagtgaccgagatatggcaggaagtgatgcagagacgcgacgacgacggggcgctgcatgcggcatgtcaagtgcagcctagcgctacgctggacgccgcacagccccgggtgactggggtcgtgctgttccgtcagttagcgccacgggcaaaacttgatgctttcttcgccctggagggctttccaactgagcccaacagcagcagtcgggcaatacatgtacatcaatttggagatctaagtcaggggtgtgagtccacagggccacactacaatcccttagccgtgccccacccgcagcatcccggtgattttgggaattttgccgttcgggacggatccctgtggcgctacagggctggtctggcagccagcctggctggcccgcatagcatcgtcggtagggcggttgtggttcacgcgggagaggacgacctggggcggggcggcaaccaggcctcagtcgaaaacggcaatgctgggaggaggctcgcttgctgtgtggtgggtgtgtgtgggccgggactgtgggaacggcaagcaagggaacattcggaaagaaagaagcgccgtagagaatctgaatgcaaagcggcatag

SEQ ID NO: 4494 - DNA, 390 bp, Artificial Sequence
  Description of Artificial Sequence: Synthetic coding sequence
atgaagatcctggtggccctggccgtgttcttcctggtgagcacccaactcttcgcagaggagattggagcaaatgatgacctaaactattggtctgactggtatgatagcgatcagatcaaggaagagcttcctgagcccttcgaacacctgctgcaacgaatcgccaggcggcccaaaccgcagcagttcttcggactgatgggaaagagagatgcagacagctcaatcgagaaacaggtggcactgctgaaagccctttatggccacggtcagatatcacacaaaagacataagacggattcctttgtgggactaatggggaaaagggcgttaaactctgtagcctatgaacgtagtgccatgcaaaactatgagagacggaggtag

SEQ ID NO: 4495 - DNA, 345 bp, Artificial Sequence
  Description of Artificial Sequence: Synthetic coding sequence
atgaagatcctggtggccctggccgtgttcttcctggtgagcacccagttgtttgcggaagagatcggcgcaaatgacgacttaaattattggagcgactggtacgacagcgaccagatcaaagaggaactccccgagcccttcgagcatcttttacagcggatcgcacgccggccgaaaccgcagcaattttttggcttgatggggaagcgcgatgcaggccacggccagattagtcacaaacggcacaaaacggactcattcgtgggcttgatgggaaagcgcgctttaaatagtgtcgcctacgaacgaagcgccatgcagaactacgaacgccggcgctag

SEQ ID NO: 4496 - DNA, 336 bp, Artificial Sequence
  Description of Artificial Sequence: Synthetic coding sequence
atgaagatcctggtggccctggccgtgttcttcctggtgagcacccagttgttcgccgaggagatcggtgcgaacgacgacctgaactactggtcggattggtacgattcagatcagattaaagaagaattacctgagccctttgaacacctgttgcagaggattgcccgccggccaaaaccccagcagttcttcggcctgatgggtaaacgtgatgcagattcttcaattgagaaacaggtggctcttctgaaagctttgtacgggcacggccagatcagccataaaatggcctatgaacggtctgctatgcagaactacgagcggcggagatag

SEQ ID NO: 4497 - DNA, 417 bp, Artificial Sequence
  Description of Artificial Sequence: Synthetic coding sequence
atgaccgccctgttcctgatgagcatgctgttcggcctgacctgcgggcaggctatgagcttctgtatccctaccgagtacactatgcacatcgagaggcgggaatgtgcttattgtcttacaataaatactacaatttgtgccggatattgcatgacacgcgatattaacggcaagctgttcctgcccaaatacgctctttctcaagacgtgtgcacttacagagactttatttatagaactgtggaaattccaggatgtccattgcacgttgccccatacttctcataccccgtggccctttcttgtaaatgtggtaagtgcaacaccgattattctgattgcatccacgaggctattaaaacgaattattgtacaaagccacaaaagagctacctcgtgggattctctgtgtag

SEQ ID NO: 4498 - DNA, 417 bp, Artificial Sequence
  Description of Artificial Sequence: Synthetic coding sequence
atgaccgccctgttcctgatgagcatgctgttcggcctgacctgcggtcaggctatgtcattttgcattccaaccgaatacactatgcatatagaaaggcgtgagtgtgcatattgcctgaccattaacactaccatctgcgcaggatactgcatgaccagggacatcaatgggaaactatttttacccaagtatgccctgagtcaggacgtgtgcacatatcgcgactttatttatcgaaccgtggagattccgggctgcccactccacgtcgccccatatttcagttaccccgtggccctttcctgcaagtgcggcaaatgcaataccgattattcagattgtatacatgaggccatcaagaccaattattgcacaaagccacagaagtcttatctagtggggttcagtgtgtag

SEQ ID NO: 4499 - DNA, 2418 bp, Artificial Sequence
  Description of Artificial Sequence: Synthetic coding sequence
atggcccagcccctggccttcatcctggacgtgcccgagacccccggtgaccagggacagggaccatcgccttacgacgaaagtgaggtgcacgatagttttcaacagcttatccaggagcagagccaatgtacagctcaggaaggcctggaactgcagcagcgagagagggaggtgacgggttcctctcaacaaaccttatggcgccctgagggaacccagagtaccgccactctcagaatccttgcatctatgccgagtagaactattggtaggtctcgaggggctattatttcacagtattacaatagaaccgtccagctgcgatgccgaagcagcaggcctttactggggaattttgtgcgcagcgcctggccaagtctgcggctgtatgacctggagctggaccccactgcgctggaggaggaggagaaacagtctctcttggtgaaggagctgcagtcgctggctgttgctcaacgtgaccacatgcttcgtggcatgcctctgtctctcgctgaaaaaaggtctctgagggagaagagtcgcaccccacgaggtaaatggcggggccaaccaggcagcggcggggtgtgctcttgttgtggccggctccgatacgcatgcgtcctcgctttgcacagcctgggtctggcgctgttgtccgcgttgcaagcactaatgccatggcgatacgccctgaaacgcatcggagggcaatttgggtccagcgttttgagctattttctgttcttgaagacattgctggcctttaacgccttactgttgttactcttggtggctttcattatgggtcctcaagttgcttttcccccagcattacccggcccggcccctgtgtgcaccgggttagagcttctgacaggtgccggctgttttacacatacggtgatgtactacggacactattctaatgccacactgaaccagccttgtggcagccccctggacggatcccaatgcacacctcgcgttggcggcttaccgtacaatatgcctctcgcctacctgagtacggtcggcgtgtccttttttatcacctgcataacactggtttactctatggcgcattcgtttggggagtcttacagagtgggctccacctccggcatccatgccatcacagtgttttgttcttgggactacaaggtgacccagaagagagcctcccgacttcaacaggataatatcagaacacgactgaaagagctgctcgccgagtggcaactaaggcattcgccccgatctgtgtgtgggagacttagacaggcagccgttttggggctagtgtggctgctttgcctggggacagccttagggtgcgctgtcgcagtacatgttttctccgaattcatgatacaatctcccgaagccgcgggtcaggaagccgtcctgctcgtgcttcctctggttgtcggactcctcaatctgggtgccccttacctttgtagagtgctggcagccttagagccacacgatagtcccgtcctggaggtttatgtggcaatttgtcgtaatctgatcttgaagctcgccatcctcggcaccctatgttaccactggctgggccggcgagtgggcgtgctccagggacagtgttgggaagactttgttggccaggagctgtatcggtttctcgttatggatttcgtcctcatgctcctggacacactgtttggtgagttagtttggagaattatttctgagaagaagctgaaaagacgaaggaagcccgagtttgatatcgcccgcaacgtgctagagctgatttacggtcagacactcacctggctcggagttcttttttcgcctctgctgccagccgtccagataatcaaactgctgcttgttttctatgtgaagaaaacttcactcctggccaattgccaggcaccaagacgaccgtggcttgcaagccacatgtccacggtttttctcacgctcctgtgcttccctgcattcctcggggccgcagtgtttttgtgttacgctgtctggcaggtcaagccttcatccacttgtgggccttttagaacacttgacactatgtatgaagctgggcgggtgtgggtccgccatcttgaagcagcgggcccccgtgtatcctggctaccatgggtgcatcggtatctcatggaaaacaccttttttgtgtttttagtgagcgccctcctgctggcagtaatctacctgaacatccaggtcgtgcggggccaacgcaaggtcatctgtctgttgaaggagcagatttctaacgagggcgaagataaaatatttctgatcaacaagcttcacagcatttatgagcgaaaggaacgggaggagcggagcagagtggggacaacggaagaggctgcggccccccctgctcttcttacagatgaacaagatgcttag

SEQ ID NO: 4500 - DNA, 864 bp, Artificial Sequence
  Description of Artificial Sequence: Synthetic coding sequence
atgctgctgccccggagcgtgagcagcgagcgggcccccggcgtgccggaaccagaggagctatgggaagcagaaatggagcgactccgagggtccggaacacccgtgagaggacttccatacgctatgatggacaaaagactgatttggcaattgcgagagcctgccggcgtccaaacgctgagatggcaacgatggcagaggcggagacagacggtcgaaagacggctgagagaagcagcgcagcgactggcccgcgggcttgggctgtgggagggagccctatacgaaatcgggggcctcttcggaactgggattcgttcatacttcacgtttctccgtttcctgctgctgctgaacctgctgagtttactgctgaccgccagcttcgttctgctccccttagtctggctgcggcctccggatccggggcccactttgaaccttaccctgcagtgccccggctctcggcagtctccgccaggcgtgctgcgctttcacaaccagctttggcacgtgctgaccggaagggcctttacaaacacttatctgttctacggggcatatcgggttggtccagagtctagcagcgtctactctatacgtcttgcatacctgttaagccctctggcctgcttgctgctgtgcttttgcgggactttgcggagacttctttctacactggcaagcggtcccggtgccggagggccatgggccccagctcattggccagcttgtccaccactgccaggactaccaagacttcagctgcctccccctcatcatgcacaggttctccgtgcagcaggcgctatgggaggtgacacctggcgcgggagaagctttcttccctggggttggtag

SEQ ID NO: 4501 - DNA, 2181 bp, Artificial Sequence
  Description of Artificial Sequence: Synthetic coding sequence
atgctgctgccccggagcgtgagcagcgagcgggcccccggcgtgcctgagcccgaagaactgtgggaggccgaaatggagcggctgaggggatcaggaactcctgtcagggggttaccatatgccatgatggacaagagactcatctggcaattgagggagcccgctggcgtgcaaacacttcgttggcagcggtggcagcgtcgccgccagaccgtcgagcggagattacgggaagccgctcaacgtctcgcccgcgggctcggcctctgggaaggggcactgtatgagatcggcggcctgttcgggaccggcatacggtcctactttactttcctgaggtttctcctcctgcttaacctgctgtcactgctgctgaccgcctctttcgtgctcctccccttagtctggctgcggccccctgaccccggacctactctaaaccttaccctccagtgcccaggatcacgacagtccccccccggggtgctgcggttccacaatcagctatggcacgtgttgacgggacgagccttcactaatacgtatctgttttatggagcctaccgcgtgggtccagagtcatcttcagtgtactctatcaggctagcttacctgctatcgccattagcctgcttgcttttgtgtttctgtggaactctaagaagaatggttaagggtctgccccagaagacactcctggggcagggctaccaggcaccgctgtccgctaaagtcttttcatcttgggatttttgtatcagggtgcaggaagctgccactattaaaaaacacgagatctcgaatgagttcaaagtcgagctcgaggagggtaggaggttccaactcatgcaacagcagaccagagctcagacagcttgccggctgctcagctatttaagggttaacgtcctgaacgggctgttggttgtgggagccataagtgctatcttttgggctacaaagtactctcaggacaataaagaagagagcctttttctgctattgcagtatctccctcccggggtgattgccctggtgaattttctcggaccgcttcttttcacgttccttgtgcagctggagaattacccacctaacacagaagtgaacctgacactcatttggtgtgttgtattaaagcttgcctcactcggcatgttttccgtctcactcggacagacaattctctgtataggacgggacaagtcatcttgcgagagttacggctacaatgtgtgcgattatcagtgttgggagaactccgtcggcgaggaactttataagctgtccatctttaatttcctcctcacagttgcattcgcctttctggtgaccttaccacgccgcctgctggtcgatcgctttagcgggaggttttgggcttggcttgagagggaggagtttctcgtgcctaaaaacgtcctcgatatcgttgcaggccaaacagtgacctggatgggcttattctactgtccactgctgcccctgctcaattccgtgtttttgttcctcactttttacattaagaagtataccctccttaagaatagcagggcgtcaagccgccccttcagggccagttcatccacattcttttttcagttagtgttacttctcggcctcttactcgcagctgtgccactgggctacgtggtgtccagcatccatagcagttgggattgtggcctgttcaccaactattccgcgccctggcaggtggtccctgaactcgtggcgttagggttgccccccattggccagcgggctctccactacctaggatcacatgcattctcctttccattactgatcatgttgtcgctcgtgctgacagtgtgcgtgtcacagacacaggccaatgcccgggcaattcaccgcctgagaaaacaactcgtctggcaggtccaagagaaatggcacctggtggaagatctttcaaggctcttgcctgaaccgggcccttcggatagtccggggccaaagtatccggcatcccaggcctcgcggcctcaaagcttttgtccgggctgcccatgtcctggcagtcctgggcatcaggccccccgtcccggaccttccgtcgttgacgccgccgggctgcgatccccctgccccggacagcatggcgcacctgccagtgccaggagattccgattccccagtggagcggaactatag

SEQ ID NO: 4502 - DNA, 702 bp, Artificial Sequence
  Description of Artificial Sequence: Synthetic coding sequence
atgagcaccgagagcatgatccgggacgtggagctggccgaggaggctctgcccaaaaaaaccggaggaccccagggctcacgtcgttgtttatttctgtcactttttagttttctgatcgtggcgggcgctaccactctcttctgcctgttgcacttcggagtaattggaccccagagagaggagtttccacgcgacctgtctctgatttcccccctggcacaagctgtgagatcctcctcacgaactccctctgataagcctgttgcccatgtggttgcaaatccacaggctgaaggccaactgcagtggctgaaccgtagagccaatgctctcctcgctaatggggtggaactgcgcgacaatcagttggtcgtgccatcggaagggctgtacttgatctactcacaagtgctgtttaagggccagggctgtcctagtacccacgtccttctgacacacaccatcagcagaattgctgtgtcgtaccagacgaaggtcaacctcctgagtgcaatcaagagcccgtgtcaacgggaaacccctgaaggagctgaggctaaaccttggtacgaacctatttacctcggcggagtgttccagttagagaagggtgatagactgagcgccgaaattaatcgccccgactatcttgattttgctgaatccggtcaggtctacttcggaatcatcgccctgtag

SEQ ID NO: 4503 - DNA, 702 bp, Artificial Sequence
  Description of Artificial Sequence: Synthetic coding sequence
atgagcaccgagagcatgatccgggacgtggagctggccgaggaggcactgcctaaaaaaaccgggggcccacagggatcccggagatgcctcttcctctcccttttctcatttctgatcgtggcaggtgccacaacactattttgcctcctgcattttggtgtaataggccctcagagagaagaattcccaagagatctaagcctgatctcaccactggcgcaggctgtaagatcctcttccagaaccccgtccgacaaacctgtggcccacgtagtagctaaccctcaagctgaaggacagctgcagtggcttaacagaagagccaatgccctcttggcaaacggggtcgaactccgggataaccaactggttgtccccagtgaaggcttgtacctgatttatagccaagttctgttcaaagggcaaggatgcccgagtactcatgttctgttgacacacacgatctctaggattgcggtttcataccagactaaggtcaacctcctgagcgccataaagtccccgtgtcagagggaaactccggagggggccgaagctaaaccttggtacgagcccatttacctgggtggtgtgttccaactagaaaagggcgatcgtctcagcgccgaaataaaccgccccgactatctggatttcgccgagtccggtcaggtgtattttgggattatcgctctgtag

SEQ ID NO: 4504 - DNA, 702 bp, Artificial Sequence
  Description of Artificial Sequence: Synthetic coding sequence
atgagcaccgagagcatgatccgggacgtggagctggccgaggaggctctgcccaaaaaaacaggcggaccccagggaagcaggcggtgtctctttctatctctcttttccttcctgattgtggctggagccacaacattgttctgcctgctgcatttcggcgtcattgggcctcagagggaggaattcccccgggatctctccctcattagccccctggcccaggccgtccggtcttcatccaggacaccgtcagacaaacctgttgcccatgtggtggcaaatccgcaggcagagggtcagctccagtggttgaataggagagccaacgctctgttagcaaatggcgtggagttgagggacaatcagttggtggtgccctctgaaggcttgtatttgatatactctcaggttttgttcaagggccagggttgcccatcaacgcacgttttgctgacacatacgatctcccggattgcagtgtcatatcagaccaaagtaaaccttttatctgcaattaaatctccatgccagcgcgaaactcctgaaggcgccgaggccaagccctggtacgagccaatttatttgggcggtgtctttcagctcgagaagggcgaccggctgagcgccgagataaataggccagattacctggatttcgctgagagtgggcaggtttactttgggatcattgccttatag

SEQ ID NO: 4505 - DNA, 702 bp, Artificial Sequence
  Description of Artificial Sequence: Synthetic coding sequence
atgagcaccgagagcatgatccgggacgtggagctggccgaggaggcgctgcctaaaaagaccggggggccccagggaagccggcgctgtttgtttttgtccctgttttccttcctcattgtagcaggtgctaccacgctgttttgcctgctacatttcggcgtgataggcccgcaacgggaagaatttcccagggatttgagcttgatctctccactggcacaggccgttcggagcagctctcggacgcctagcgacaaacccgtggcccacgtagtcgccaatcctcaggccgaaggccagctgcaatggttgaatagacgggccaacgctttgttggctaatggggtggagctccgagacaatcagctggtcgtgccttcggagggtctgtatctcatctatagccaggttctgttcaagggccaggggtgtccttcaactcacgtcttgcttacacatacaatctcccgcatcgcagtaagttaccaaacaaaggtcaatctgttgagcgccatcaagtcaccttgccagagggagacccccgagggagcagaagccaaaccctggtacgaaccgatttacttgggaggtgtgtttcagctggaaaaaggagatagactgtctgccgagatcaacagaccagactacctggattttgccgagtctggtcaagtgtacttcggcatcatcgcactgtag

SEQ ID NO: 4506 - DNA, 702 bp, Artificial Sequence
  Description of Artificial Sequence: Synthetic coding sequence
atgagcaccgagagcatgatccgggacgtggagctggccgaggaggcgttgcccaaaaagaccggcggcccacaggggagccgccggtgcctgtttttaagcttattttccttccttattgtcgccggtgccacaacacttttttgtttgctgcactttggcgtaattgggccacaacgcgaggagtttcccagagatcttagtcttatctcccccctggcccaggccgtgagaagtagctctcggacaccttcagacaagcctgttgctcacgtggtggccaacccacaggcggaaggtcagctgcaatggctaaatagacgtgcaaacgcgcttctagccaatggggtcgaactgagagataatcaactggtcgtcccctctgaagggctgtacctcatatacagccaggttctgtttaaaggccaggggtgcccatctacacatgtcctcttgacgcacactatttcccgtattgctgttagctatcagacaaaggtgaacctcctgtcagcaatcaagtccccgtgccagagggaaacccccgagggggccgaggcaaagccttggtacgaacctatttatctgggcggcgtgtttcaattagagaaaggggaccgattaagcgctgagatcaacaggcctgactatttggacttcgccgaaagtgggcaggtgtactttgggatcatcgctttgtag

SEQ ID NO: 4507 - DNA, 702 bp, Artificial Sequence
  Description of Artificial Sequence: Synthetic coding sequence
atgagcaccgagagcatgatccgggacgtggagctggccgaggaggctttacctaaaaagaccggcggcccccaaggctcaagacggtgcctttttctgtcactcttttcatttctgatagtggctggcgccacgactctcttctgtttgctacacttcggagttattggacctcagcgagaggaatttccccgcgacttgtctctgatctccccactggcccaggccgtacgctccagtagccgaaccccctctgataagcccgttgcccacgtagtggctaacccccaggctgaaggacaactgcagtggctgaatcggagggccaatgcactgctggcaaatggcgtcgaacttcgggacaaccagttggtggtccctagcgaggggctctatttgatatatagtcaggtgcttttcaagggacagggttgtccatccactcacgtcttacttacacacacaatttcccggatcgcagtgtcttaccagacaaaagtgaacttactaagcgcaatcaagagcccatgccagagggagacacctgaaggagccgaggccaagccttggtacgaaccaatctatctcgggggtgtattccagctcgagaaaggcgatcggctgtctgcggagattaataggcctgactacttggactttgctgagtccggtcaggtctacttcgggatcattgctctgtag

SEQ ID NO: 4508 - DNA, 702 bp, Artificial Sequence
  Description of Artificial Sequence: Synthetic coding sequence
atgagcaccgagagcatgatccgggacgtggagctggccgaggaggctctgccgaagaagaccggcggacctcaggggagtaggcgctgtctctttcttagcctgttttccttccttatcgtggccggggctaccactctgttctgcctactgcactttggagttattggaccccagcgggaggaattcccaagagatctatccctgatttcccctctcgcccaggcagtgaggagctcttcccggaccccctctgataagcctgtggcccacgtggtagccaacccgcaagcggaaggtcagctgcagtggttgaatagaagagcaaacgctctcttagctaacggagttgaactgagggacaatcaacttgtagtcccatccgaagggttatatctgatctattcgcaggtcctgttcaaggggcagggttgcccttcaacccacgtgctgttaacccacacaatcagtagaatagcagtgagctaccagactaaagtgaatcttctaagcgccatcaaatccccgtgtcagcgggaaactccggagggcgctgaagctaaaccttggtacgagcctatttatctggggggcgtttttcaactggagaagggagatcggctctcagctgagatcaacaggcccgattatctggacttcgccgagagcggtcaggtttactttggtatcattgctctctag

SEQ ID NO: 4509 - DNA, 741 bp, Artificial Sequence
  Description of Artificial Sequence: Synthetic coding sequence
atggcccaggtgcccccccccgccagcggcgagcggcacgccggcactgaagatggaccaattcgccggaaccccgcaggaaatgttgctcgtccgatggtccagaggctgcccgaacctcaagatgtggcgcaatgcctagaggtaggactctttgatacacctcctttttattccaactccacgaatagcttcaggaacactgttgaaggaaacgacccgaccggaaagtatgatccagccgtgcgttcactgcacaacctcgcccacctcttcctgaatgggacaggcgggcagactcacctctctccaaatgaccccatctttgtgctactgcatactttcacagacgctgtgttcgatgaatggctgcgccggtacaacgccgacatctccacctttcccctggagaatgctccaatcgggcataacaggcagtacaatatggtacccttctggccccccgtgactaataccgaaatgtttgtgaccgccccggacaaccttggctacacgtatgaaatccagtggccttcacgagaattcagcgtacccgagatcatcgcgattgccgtagtgggtgcacttctacttgtagccctgatctttggcactgctagctatcttattagagccaggagatctatggacgaggcaaatcagccgctcttgacagaccagtatcagtgttatgccgaagagtatgagaaactgcagaacccaaatcagtctgtcgtttag

SEQ ID NO: 4510 - DNA, 1614 bp, Artificial Sequence
  Description of Artificial Sequence: Synthetic coding sequence
atgagcgcccccaagctgctgagcctgggctgcatcttcttccccctccttctgtttcaacaggccagagctcagttccctaggcagtgcgcaacggtggaggccctcagatccgggatgtgctgcccagacctctcgccggtgagcggtcccgggactgatcgatgcggttcttcctcaggtcgcgggcgctgcgaggcagttactgctgactctcgtcctcactcccctcagtatccccatgatggtagagacgatcgggaagtctggccccttagattcttcaaccggacatgccactgcaatggaaatttttctggacacaattgcggcacttgtagacccgggtggcgcggagcagcttgcgatcagagagtgctgatagtccggagaaatttgctggacctgagcaaggaggaaaagaaccattttgtgcgggcactggatatggccaagagaactacccaccccctgtttgtcattgctactcggagatccgaggaaatactcggccctgacgggaataccccccaatttgaaaatatttccatttacaattactttgtgtggacccattactattccgttaagaagacatttttgggcgtgggacaggagtctttcggcgaggttgacttctcccatgagggaccggcctttctgacttggcaccgctaccacctattgagactagagaaggacatgcaggagatgctgcaggagccatctttctccctgccatattggaacttcgcgacgggtaagaacgtctgtgatatttgcactgatgacctcatgggaagtcggtctaactttgacagtactcttatcagccctaactcagtgtttagccagtggagggtggtctgcgactctctcgaggattacgacaccctgggcactttgtgtaacagcaccgaggatggaccgatcaggaggaacccggcaggaaatgtcgctcgcccaatggtccaacgcctaccagaacctcaagacgtggcgcaatgcctggaagtcgggctgttcgacacccctcccttttattcgaactcgacgaactcattcaggaataccgtggagggttactcagatcccaccggaaaatacgacccagcagtgcgatccctgcataatctggcccatctgttcttgaacggtactggaggccagacacatctgtccccgaatgatcccatcttcgtactgctgcataccttcactgacgccgtctttgatgagtggctaagacgctataacgccgatatctcgacttttccgctcgagaacgcccccatcggtcacaatcgacagtataacatggtgcctttttggccacccgtgaccaatactgagatgtttgtgaccgcccctgataatctgggttacacatacgagatccagtggccgtccagagagttcagcgttcccgagatcatcgccattgccgtcgtgggtgcattgctgctggtagcattaattttcgggactgcttcttatttgatccgcgcccgccgttccatggacgaggctaatcaacctcttctgaccgaccagtatcagtgttacgcagaggaatacgagaaattgcagaatccgaatcagagcgtggtctag

SEQ ID NO: 4511 - DNA, 309 bp, Artificial Sequence
  Description of Artificial Sequence: Synthetic coding sequence
atgagcgcccccaagctgctgagcctgggctgcatcttcttccccctgttgctcttccagcaagcacgagcccaattcccgcgccaatgtgccaccgttgaagccctcaggagcggcatgtgctgtcccgatctgtcacctgtcagcgggcctggaactgacaggtgcggttcaagctcagggagagggcgatgcgaggcggttactgcggactctcgcccacactctccccaatacccacatgatggcagggacgatagagaggtatggcctctcagatttttcaatcgaacatgtcactgtaactag

SEQ ID NO: 4512 - DNA, 1128 bp, Artificial Sequence
  Description of Artificial Sequence: Synthetic coding sequence
atggaagaagaaatcgcagcacttgtgattgataacggatccggtatgtgcaaagccggtttcgccggagacgatgcaccccgagccgtatttcccagcattgtgggacgaccaaggcatcagggagtgatggtgggaatggggcagaaggattcctatgtgggggacgaggcccaatcaaaaagaggtattctgaccctgaaataccctatcgagcatggaattgtgacaaactgggatgacatggaaaagatctggcaccatacgttctataatgaactgcgagtggcccctgaggagcatcccgtgctcctgactgaagccccactgaaccctaaggctaaccgtgaaaagatgactcaaattatgttcgaaacctttaataccccggcaatgtatgtggccattcaggctgtcctcagtctctatgcaagtgggagaacaacaggcattgtgatggacagtggggacggcgtgacacatacggtgcctatctacgagggctacgccttgcctcacgccatccttcggctggacctcgcaggcagggacttaacagattacctgatgaaaatcctgaccgagcgaggatactccttcactacaaccgctgagcgggagatagtgagagacattaaggagaagctttgctacgtggccctcgactttgaacaagagatggctaccgctgcgagcagttcaagtcttgagaagtcctacgagttgcccgatggtcaagtgatcacgataggcaacgagaggtttagatgcccagaggccctgttccagccttccttcctcggaatggagtcctgcggtatccacgagacaacgtttaacagcatcatgaaatgcgacgtggacatcaggaaggatctgtacgcaaacaccgtgttatctgggggaaccacaatgtaccccggaatcgccgacagaatgcaaaaagagattacagcactggctcccagtaccatgaagataaagataatcgcacctccggagcggaagtacagtgtatggattggaggctccatcctcgcttccctctcaacttttcaacagatgtggattagcaagcaggaatacgatgagtctggtccatcgatcgtgcacagaaagtgcttttag

SEQ ID NO: 4513 - DNA, 1599 bp, Artificial Sequence
  Description of Artificial Sequence: Synthetic coding sequence
atgcctcagctgtacatatacattagactcttaggcgcttatctgttcatcatttcccgcgtccagggccagaatctagattcaatgctccacggcactggaatgaagtcggactctgatcagaaaaaaagcgagaatggggttaccctggccccagaagacacactgcctttcctaaagtgttattgtagcggtcattgccctgacgacgctatcaataacacgtgcatcacaaacggccactgttttgctataattgaggaggatgatcagggggagaccacactggcctccgggtgcatgaagtatgaaggcagcgacttccagtgtaaggactcccctaaagctcaactgcggcgaacaatcgaatgctgccgtacaaacctctgcaatcagtatctgcagcccaccctgccaccggtggtaatcggacccttctttgatgggtctatccgttggctagtgctgctgatttctatggccgtttgcatcattgcgatgataatcttctcttcttgtttctgctacaaacactattgcaagtccatcagtagtcggcgacgctacaaccgagacttggaacaggacgaggcctttatcccagttggcgaaagtttgaaagacctgatagatcaaagccagagcagcggctctggatccggtctcccactgttagttcagagaaccatcgccaagcagattcagatggtcaggcaagtaggcaaaggaagatatggcgaagtgtggatgggaaagtggcgaggggagaaggtagccgtaaaagtcttttttaccaccgaagaggcttcttggtttagggagaccgaaatctatcagaccgtcttaatgagacacgagaatatccttggctttattgccgctgatataaaggggactggatcttggactcagttgtacctcatcaccgattaccacgaaaatgggtccctatatgacttcttgaaatgtgctaccttggatactcgtgccctgttgaaactcgcttacagtgctgcctgcgggctgtgtcaccttcacacagagatttacggcacccagggaaaacctgctatcgctcaccgcgacctcaaatctaagaacatcctgatcaaaaagaacggcagctgctgtatagcagatttggggttggccgtgaagttcaattccgataccaatgaggtggatgtgccgctaaatactagggtcggcactaaacggtatatggctccagaagttctggacgaaagtctcaataaaaaccactttcaaccatatatcatggctgacatttattcttttggcctcatcatttgggaaatggccaggaggtgcatcacaggaggcatcgtggaagagtaccagttgccttattacaacatggtccctagcgacccgtcctatgaagacatgcgggaagtggtatgtgtcaagcggctccgccctattgtgtctaatagatggaatagcgacgagtgtttgagagctgtgctgaaattaatgagcgagtgctgggcccacaaccctgcttcacggctgacggcactcagaatcaaaaaaaccctcgctaagatggtggagtcccaagacgtgaagatttag

SEQ ID NO: 4514 - DNA, 456 bp, Artificial Sequence
  Description of Artificial Sequence: Synthetic coding sequence
atgtgcgaggaagaggacagtacagccttggtctgtgacaatggttcaggcctatgcaaagcgggtttcgccggagacgacgctcccagagccgtatttccgtctattgtgggaagaccaaggcatcaaggagtgatggtgggtatgggccagaaagactcctacgtcggtgatgaggcccaatccaagagaggaatcctcacacttaagtaccctatcgaacacggaattattaccaactgggacgacatggaaaagatctggcaccattcgttctacaacgagcttcgtgtggcccctgaggagcacccgacactgctcaccgaagctcctctgaatccaaaagctaatagggaaaagatgactcagataatgtttgaaacatttaacgtcccagcaatgtatgtggcaattcaggcggttctcagcctgtatgcatccggcaggaccacctag

SEQ ID NO: 4515 - DNA, 456 bp, Artificial Sequence
  Description of Artificial Sequence: Synthetic coding sequence
atgtgcgaggaggaggacagtactgcactggtttgcgacaacgggagcggcttgtgtaaagccggttttgcaggagatgatgcccctcgagccgtgttcccttcaattgtcggcagacccaggcaccagggggttatggtagggatgggtcaaaaggacagctacgtgggggatgaggcccagagcaagcgcggtattctcaccctgaagtatcccatagaacatgggataattaccaattgggacgacatggagaagatttggcaccacagcttttacaacgagttacgcgtggcccctgaagaacatccaacgctactgacagaagctcccctcaatccaaaggccaatcgcgagaaaatgacccagatcatgttcgagacgtttaatgtccccgcaatgtacgttgcgatccaggccgtactttctctctacgcgagcggcagaactacctag

SEQ ID NO: 4516 - DNA, 1134 bp, Artificial Sequence
  Description of Artificial Sequence: Synthetic coding sequence
atgtgtgaggaggaggacagcacagcactggtgtgtgataatggtagcggactatgtaaagccggttttgccggagatgacgcgcctagagctgtgttcccttcgattgtcggacgcccacggcatcagggcgtcatggtgggcatgggccagaaggattcctatgtgggcgacgaagctcagtccaagcgcggtatcctgaccctgaagtatcccatcgaacacggcatcattaccaattgggacgatatggaaaagatatggcaccactctttttacaatgagcttcgggtagctcccgaagaacatcctacattgctgacagaggcccctctcaatcctaaggcaaatagagagaagatgacgcaaatcatgttcgaaactttcaacgtgccagccatgtatgtcgccatccaggcggtgctgtccctgtatgcctctggtcgtacaaccggtatcgtactggatagcggtgatggagtcacccataacgtgcccatctacgaggggtacgccctgccacatgccattatgcgactggaccttgcgggacgagacctgaccgattacttgatgaagatcctgaccgagagaggatacagttttgtgacaacagccgagcgagaaatagtcagggatatcaaagaaaaactgtgttacgtggctctggattttgaaaacgagatggcgacagccgcatcgtcatcaagtctggagaaaagctacgagctacctgacggtcaggtcatcaccattggcaatgaaaggtttcggtgcccggagacactttttcagcctagtttcattgggatggagagtgcaggaattcacgaaactacttacaattctatcatgaagtgcgacatcgacatccggaaagacctgtacgcgaataatgtattatccggcggaactaccatgtatcccggaattgctgatcggatgcagaaggagatcacagctctggcgccaagtacaatgaagattaagatcattgctcctccagagaggaagtactctgtgtggatagggggaagtatactagcctctctgtcaaccttccaacagatgtggattagtaaacaggagtatgacgaagctggcccatccatcgttcataggaaatgtttttag

SEQ ID NO: 4517 - DNA, 999 bp, Artificial Sequence
  Description of Artificial Sequence: Synthetic coding sequence
atggtcggaatgggacagaaggatagctatgtgggggacgaggcccaatcgaagaggggcattctgacactgaaatatccgattgaacacggaatcattacaaactgggacgacatggagaagatctggcatcactcgttttataatgagctcagagttgctccagaggagcacccaaccctgttgactgaagcaccactcaatccgaaagcaaacagggaaaaaatgactcagatcatgtttgaaaccttcaatgtaccagctatgtacgtagcgatccaagccgtcctgagtttgtacgctagtggacgcacaaccggtattgtgttagactcgggcgacggtgttacccataacgtgccaatttacgagggttacgccctgcctcacgcaattatgaggctcgatttggccggacgagatctgactgactacttgatgaagattcttactgagcgcggatatagctttgtcactacggcagaacgggagattgtgagagacataaaggaaaagttgtgctacgtggcccttgactttgagaacgaaatggcaaccgcggcatcttctagcagcctggagaaaagctatgaattaccggacggacaggtgattacgatcggcaacgaaaggtttcgatgcccagaaaccctgttccaaccctccttcatcggtatggagtccgcaggcatccacgagaccacctataattcaatcatgaagtgtgatatcgacatcaggaaagacctgtatgcaaataacgtgttgagcgggggtactaccatgtatccaggcatagcagaccggatgcagaaggagatcacagctctagctccctctacaatgaagattaaaattatcgctccaccagaacgcaaatattccgtgtggatcgggggatccatactagccagtctaagtacattccagcaaatgtggatcagcaaacaggaatatgacgaagccggtccatctatagtgcacaggaagtgtttctag

SEQ ID NO: 4518 - DNA, 1134 bp, Artificial Sequence
  Description of Artificial Sequence: Synthetic coding sequence
atgtgcgacgatgaagagacaactgcgctcgtatgcgataacgggagcggtctagtcaaggctggcttcgccggtgatgacgctcccagggctgtcttcccctcaatagtgggccgacccaggcaccaaggagtgatggtcgggatgggacagaaagattcttatgtgggtgatgaggcacagtcgaaacgtggaattctgacactgaagtatcctatcgagcacggaatcataacaaattgggatgatatggagaagatctggcaccacacgttttacaatgagctaagggtggcacctgaagagcaccctaccctgctcaccgaggcacccctgaaccctaaggccaaccgggagaagatgactcagattatgttcgagacattcaatgtccccgctatgtacgtcgccattcaggccgtgctctcactctatgcttcagggagaacaaccggcatcgtattagactctggtgacggagtgactcacaatgtgcccatttacgagggctacgccctgccccacgctatcatgaggcttgatctagcgggacgcgacttgaccgactacctcatgaagatactgactgagcgtggatattcatttgtgaccacggcagagagagaaattgtacgtgatattaaagaaaaattatgttacgtggccctggacttcgagaacgaaatggcaacggccgcttcctcgtctagtcttgagaagtcctatgagctaccagacgggcaggtgatcactattgggaacgaacggttccgatgtccggaaacactgtttcagccttctttcatagggatggaatcagcaggcattcacgagaccacctataattcgattatgaagtgcgacatcgacattcggaaagacctgtatgcgaacaacgtcctatcaggtggcactactatgtaccccggtatcgccgatagaatgcaaaaagagattaccgcacttgccccttccacaatgaagatcaagattattgcacctccagagcgaaagtacagtgtgtggatcggtggcagcatcctcgcctctttgagcaccttccagcagatgtggattagtaaacaggagtatgatgaagctggaccttctatcgtgcaccgaaaatgtttctag

SEQ ID NO: 4519 - DNA, 1029 bp, Artificial Sequence
  Description of Artificial Sequence: Synthetic coding sequence
atgtgcgatgacgaagagactaccgctttggtctgcgataacggctcaggcctagtgaaggccggattcgctggtgacgatgcccctcgcgcagtgtttccttcaatcgtgggtagacccaggcatcagggcgtgatggtgggaatgggacaaaaggatagctacgtgggagacgaggcgcagtccaagagaggaattttaacacttaagtaccctattgagcacggtataataaccaaagccaatagagagaagatgactcagatcatgtttgagacctttaatgtacctgctatgtacgtcgcgattcaagccgtgctttcactctacgcatcaggcagaaccacaggcattgtcctggactccggggacggagtaacccacaacgtgcctatttatgagggctacgccttgccccacgccatcatgcgcttagatctcgccggaagggacctaactgactatctgatgaagatcctgaccgagagggggtactccttcgtgacaacagccgagcgggaaatcgtgagggacatcaaggaaaaactctgctacgttgcactcgacttcgagaacgaaatggcgaccgcagctagcagcagtagccttgagaagtcttacgaattaccagatggccaagttatcaccatcgggaacgagaggtttcgatgtcctgagaccctgttccaaccctcgttcatcgggatggagagcgcaggcatccacgagacgacttataacagcataatgaagtgcgacattgatattcgaaaggacttatatgccaataatgtgctatccggaggtacaacaatgtaccccggaatcgcggataggatgcagaaagagattactgccctggctccgtccacaatgaagataaagataatcgctcctcctgagagaaagtactcggtctggatcggaggttccatactagccagtttatcgacgttccaacagatgtggataagcaagcaagaatatgacgaggccggtccttccatcgtccaccgcaagtgcttctag

SEQ ID NO: 4520 - DNA, 885 bp, Artificial Sequence
  Description of Artificial Sequence: Synthetic coding sequence
atggagaaaatttggcaccacacgttctataacgaattgcgggtcgcacctgaggagcaccccgtactgctgaccgaagccccacttaaccctaaggccaacagggagaaaatgactcagatcatgttcgagaccttcaacacgcctgcgatgtacgtcgctatccaggctgttctgtctctgtacgccagcgggagaactacaggcattgtgatggactctggcgacggggttacccacacagtgccgatctatgaaggctatgcactgccacatgcaattttacggctggatttggcaggacgcgatctgactgattacctgatgaagatcttaactgagcgcggatactccttcaccaccacggctgagagggagatagttcgagacattaaggaaaagctgtgttacgttgcactggacttcgagcaggaaatggctactgccgcaagtagcagcagcctggaaaaatcttatgagctccccgacggccaggtcatcaccatcggaaacgaacggttccgatgcccggaagccctctttcaaccgagtttcctgggaatggaatcctgcggaatccatgaaaccacctttaatagtataatgaagtgcgatgttgatattcgcaaggatctgtatgcgaatacggtcttaagtgggggaactacaatgtaccctggtattgccgatcggatgcagaaagagattacagcattggccccttcaaccatgaagatcaaaatcattgcacccccagaaagaaaatactctgtgtggatcgggggatccatacttgcatctcttagcaccttccagcaaatgtggatatctaaacaagaatatgatgaatccggaccctcaatagtgcacagaaagtgtttctag

SEQ ID NO: 4521 - DNA, 1128 bp, Artificial Sequence
  Description of Artificial Sequence: Synthetic coding sequence
atggatgacgatatcgcggctctggttgtggataacggaagtgggatgtgtaaggctggctttgccggagacgatgctcctcgggcagtattcccaagtattgtgggtagaccacgtcaccagggggttatggtcggaatgggtcagaaagacagttacgttggcgatgaggcgcagagcaaacgcggaattttaactctcaaataccccattgagcatggaatagtaactaactgggatgacatggaaaagatctggcatcacacattctataacgaactgcgagtggctcccgaggaacatcccgtgttgctgaccgaggcccctttgaatccaaaagcaaatcgagagaagatgactcagatcatgtttgagacgtttaacacccccgctatgtacgtagcaattcaggctgtcctcagtttatatgctagtgggagaaccaccggcatagtcatggactccggtgatggggttacacacaccgtgcccatttacgaaggatacgctctgcctcatgcaatcttgagactggatctcgctgggcgagatctcacagactatctgatgaaaatcctcacagaaagaggctattctttcacaaccactgccgagagggaaatcgtacgagatatcaaagaaaagttgtgttacgtggctctggacttcgagcaggaaatggccactgcagccagttctagctcactggagaagtcgtatgaattgccagatggacaggtgataaccatcggtaacgagcgcttccggtgtcccgaagccctctttcagccaagtttcttaggcatggagtcctgcggaatacacgaaactacattcaactctatcatgaaatgcgatgtcgacatccgcaaggacctgtacgccaacactgtgttatctggtgggaccactatgtaccctgggatagctgaccgcatgcagaaagaaatcacagctctggcccctagcactatgaaaatcaaaattatcgcacctcctgaacgaaagtacagcgtgtggatcggaggcagtatcctggccagcctgagcactttccaacagatgtggattagcaagcaggaatacgacgaatccggcccatcaatagtgcatcggaaatgcttctag

SEQ ID NO: 4522 - DNA, 1044 bp, Artificial Sequence
  Description of Artificial Sequence: Synthetic coding sequence
atggacgacgacattgctgccctcgtggtagacaatggcagcggcatgtgcaaagcaggattcgccggagacgatgccccacgagcagtgtttccatccatcgtcggtcgcccaagacaccagggtgtgatggtgggcatagtgacaaactgggacgacatggaaaagatatggcatcatactttctataacgagcttagagtggctccagaagagcatccggtactcctcaccgaagccccactgaaccctaaggcgaaccgagaaaagatgacgcagattatgtttgaaacatttaatacacctgccatgtatgtcgctattcaggccgtactctcactgtacgcctctgggcgtacaacgggaattgtgatggactccggggacggagtcacccacaccgtgcccatctacgagggctatgccttaccacatgccatcctgagattagaccttgccggaagggacctcacggattatctgatgaaaattttaaccgaacggggatattcattcacaaccacagccgaacgggagatcgttcgagacattaaggagaaactttgttacgtggccctcgactttgaacaggaaatggccactgctgctagctcttcctctcttgagaaaagttatgagcttcccgacggacaggtcattaccattggcaacgaacgcttccggtgtcccgaagccctgttccagcctagctttctgggcatggaatcctgcgggatccacgagaccacttttaacagtatcatgaagtgtgacgttgatatcagaaaagacctttacgcaaacaccgtgctctccgggggaacaacaatgtatccgggtatagccgacagaatgcagaaggaaataaccgccctggcgccttctaccatgaaaatcaagatcattgcaccccctgagagaaagtattccgtgtggattggtggaagcatccttgcatctctctcaacattccaacaaatgtggatcagcaagcaagagtatgatgagtccggcccaagtatagtccatcgcaagtgcttttag

SEQ ID NO: 4523 - DNA, 243 bp, Artificial Sequence
  Description of Artificial Sequence: Synthetic coding sequence
atggacgatgacatcgcagccctcgtcgtggataatggctcaggcatgtgcaaagccggatttgccggtgatgacgccccaagggccgtgtttccaagtattgtcggcaggccccgtcatcagggagtgatggtcgggatgggacagaaagattcctacgtcggcgacgaggcccaatctaagagagggatcctaacactcaagtacccaattgagcacggcattgtgaccaattgggactag

SEQ ID NO: 4524 - DNA, 300 bp, Artificial Sequence
  Description of Artificial Sequence: Synthetic coding sequence
atgcttacaatggatgacgacattgccgcacttgtcgtggataacgggtcagggatgtgtaaagccggatttgcaggcgacgacgcgccacgtgcggtcttcccatcaatcgtgggtaggcccagacaccaaggcgttatggtcggcatgggtcaaaaagatagttacgtaggagatgaggcccagtccaaacgcggtatactgacactcaagtacccgatagagcacggcatcgtcacgaactgggatgatatggagaagatctggcaccatactttttacaacgagttgagggtttag

SEQ ID NO: 4525 - DNA, 495 bp, Artificial Sequence
  Description of Artificial Sequence: Synthetic coding sequence
atggatgacgatatcgctgctctagtcgttgacaatggatcagggatgtgcaaggcgggattcgccggtgacgatgctccaagggccgtgtttccttccatcgttggcagaccaagacaccaaggcgtgatggttggaatgggtcagaaagacagttatgtgggcgacgaggcccagagtaaaaggggcatcctgaccctaaagtacccaatcgaacatggaatcgtgacgaattgggatgacatggagaaaatctggcaccataccttttacaacgagctgcgggttgcgccagaggaacaccccgtgctcctcactgaagcccctttaaacccgaaagcaaatcgggagaaaatgacacagattatgttcgagacattcaataccccggctatgtacgtcgccatacaggccgttctatctctttacgcatccggtcgaaccaccggtatcgtgatggattcaggggacggcgtgacgcacacggttccgtag

SEQ ID NO: 4526 - DNA, 312 bp, Artificial Sequence
  Description of Artificial Sequence: Synthetic coding sequence
atggatgatgacatcgctgccctggttgtggataatggctccgggatgtgcaaggccggatttgccggagacgacgcccctcgggcagtgtttccaagtatcgtagggagaccacggcaccaaggtgtcatggtgggcatggggcagaaagactcttacgtgggagatgaagcccagagtaagagagggatcctcacgctaaagtaccctatagagcacggcattgtaacaaactgggatgatatggaaaaaatatggcatcatactttctataatgagctgagggtggctcctgaggaacacccagtctag

SEQ ID NO: 4527 - DNA, 1056 bp, Artificial Sequence
  Description of Artificial Sequence: Synthetic coding sequence
atggacgatgacatagcagccctggtggtggacaacggatctgggatgtgcaaggccggattcgccggtgacgatgctccccgagctgtttttccttccattgtgggacgccctaggcaccagggcgtgatggtgggtatgggacagaaggattcctacgtgggggacgaagcccagtcaaagagaggtatcctaacattgaagtacccaatagaacacgggattgtgacaaactgggatgacatggaaaagatttggcaccatactttttataacgaattgagggtggccccagaggagcacccagtcttgcttacagaagccccattgaatccaaaagcgaatcgggagaagatgacacagattatgttcgagacctttaatacccccgctatgtacgttgccatccaggccgtactgagtctctacgctagcggcaggacaaccgcaatccttcggctggatctggcaggaagagacctcactgactatctaatgaaaattttaactgaaagggggtatagtttcactactaccgccgagcgggagatcgtacgtgatatcaaggagaaactttgctacgttgcgctggacttcgaacaggagatggccacagccgctagctcatcatctctcgaaaagtcttacgagcttcccgatggccaggtcatcaccatcggaaatgaacgatttaggtgccctgaggcactatttcagccgtcattccttggcatggaatcttgcggtatacatgaaacgactttcaattctatcatgaagtgtgatgtggatatccggaaagacctctacgccaacaccgtcctgagcggcggaactacaatgtaccctgggattgctgatcggatgcagaaggaaattactgccctggctccgagtaccatgaaaattaaaattattgcaccccctgaacgcaagtactctgtgtggatcggcggatcaatactggcaagcctgagtacatttcagcagatgtggatatccaagcaggaatacgacgaaagcggcccttcgatcgttcataggaaatgcttctag

SEQ ID NO: 4528 - DNA, 1131 bp, Artificial Sequence
  Description of Artificial Sequence: Synthetic coding sequence
atgaccgataacgagctttctgcgttggtggtcgataacgggagtggaatgtgcaaagccggtttcggcggagatgatgcaccccgagctgtgtttccctctatgattggcagaccacgacatcaaggagtgatggttggcatgggtcagaaagattgttatgtgggcgacgaggcacaatctaaaaggggcgtgctgacactgaagtaccccattgagcatggcgtagtaactaactgggatgacatggaaaagatttggtatcacactttttacaacgagctgcgtgtcgccccagacgaacacccaattctactgaccgaggcccctctgaacccaaagattaaccgggaaaaaatgacccaaatcatgtttgaagcctttaatacccctgccatgtatgtggccattcaggccgtgttgtctctgtatgcgagtggccgaacaaccggcatcgtgatggactctggcgatggcgttacccacattgtcccaatctatgagggctatgccctcccccatgctattctgcggctggacttggctggcagggatctgactgactacctgatgaagattctcacagagcggggttataactttacaaccacggctgaaagggagatcgtgagggatgttaaagaaaaactgtgctatgtggcgctggatttcgagcaggagatggtgagggcagccgctagctctagtcctgaacgcagctacgagctcccagacggacaagtgatcaccatcggcaatgagaggtttcggtgcccagaggcaatcttccagcctagctttttaggcatcgagtccagtggaatccacgagacgacttttaattccatcatgaagtgcgatgtggatatccgtaaggacctttatgccaacacggtgttatccggcggatcaacgatgtatccagggatcgctgatagaatgcaaaaggagatcattaccctcgccccatcaacaatgaagattaagattattgccccacccgagcggaaatattccgtttggataggaggtagcattctggcatctctttccactttccagcagatgtggatcagtaaacaagaatacgacgaggccggtcctccaatcgtgcacagaaaatgtttttag

SEQ ID NO: 4529 - DNA, 1128 bp, Artificial Sequence
  Description of Artificial Sequence: Synthetic coding sequence
atggaggaggagattgcagcactcgtcatagacaatggatccggcatgtgtaaggccggattcgccggagacgacgcaccaagggctgtttttccaagcattgtgggcagaccacggcaccagggtgtcatggtgggcatgggccagaaagactcctatgtgggcgacgaagctcagtccaagcgcggtatcctgaccctgaaataccccatcgaacacggtattgtcaccaattgggatgacatggagaaaatttggcaccataccttctacaatgagctaagagtggcccctgaagagcaccccgtgctgctgaccgaagcgccattgaatcctaaggccaatcgggaaaaaatgacacagattatgttcgagacgtttaacactcccgcaatgtacgttgctatccaagccgtgctctccctctacgcctctggacgtacaacaggcattgtaatggactcaggagatggtgtcacccatacggtaccaatctatgaaggctatgctctaccacatgccattctcaggttggacttggccggtagggatctgactgactatctcatgaaaattctgaccgagcgcggttacagctttacaactaccgccgagagggagatcgtgcgcgacataaaggaaaaactatgctacgtggccctcgatttcgagcaggaaatggctacagccgctagcagcagctcactggagaagtcctatgagcttccagacgggcaggtgattaccatagggaatgagcgcttccgatgcccagaggctttgttccagccttctttcctggggatggagtcttgtggaattcacgagacaaccttcaattctatcatgaaatgtgacgtggatattcggaaagacctttacgctaacaccgtgctgagcggtggaactaccatgtatcctgggatagccgatcgtatgcagaaagaaataacggctctggcaccgagcacaatgaagatcaaaatcatcgccccacctgagaggaaatacagcgtgtggattggcggatctatattggccagcctgtccacatttcagcagatgtggatcagtaaacaagaatatgacgagtcagggccatcaatcgtacacaggaagtgtttttag

SEQ ID NO: 4530 - DNA, 1002 bp, Artificial Sequence
  Description of Artificial Sequence: Synthetic coding sequence
atggaggaggagatagccgctttggtcatcgataacggcagtgggatgtgcaaggcaggattcgccggagacgatgcgccaagggctgtctttccatcaatagtaggtcgcccacgacatcagggcgtgatggtcggcatgggccagaaggattcgtacgtgggcgacgaggcccagtcgaagagagggattctaacactgaagtaccccatagagcacggtatcgttaccaattgggacgacatggagaaaatctggcatcacaccttctacaatgaactaagagtagccccagaggagcacccagtactcctgacagaggctcctttgaatcctaaagccaatcgcgaaaagatgacccagattatgttcgagacttacgccctcccccacgctattctgagactggacctggccggtcgcgatctgaccgattatttaatgaaaatcttgacagaaagaggttattctttcaccactaccgcagagcgagaaatcgtgagagatattaaggagaaattgtgctacgtggcgctcgactttgaacaggagatggccaccgctgcgtcctcgagttcgctagagaagtcgtacgaactgcccgacggtcaagttataactatcggcaacgagcgcttcaggtgcccagaggcactgttccaaccttcctttctgggcatggagtcctgcggcattcacgaaaccacctttaattcaataatgaagtgtgatgttgatatcagaaaagacctatacgccaatactgttttatcaggcggaactacaatgtaccctgggatagcagaccgcatgcagaaggagatcacagcactggctccctctacgatgaagatcaagattattgccccaccagagaggaagtacagcgtgtggataggaggatccatactcgcatccctgtcgacatttcagcagatgtggatatctaagcaggagtatgacgagagtggcccttccatcgttcaccgcaaatgcttctag

SEQ ID NO: 4531 - DNA, 1131 bp, Artificial Sequence
  Description of Artificial Sequence: Synthetic coding sequence
atgtgtgaggaggaaacaactgcgctcgtttgtgataacggctcgggcctgtgtaaagcagggttcgccggagacgacgcgcctcgcgcagtgttccccagcattgtgggcagaccaagacaccagggagtcatggtgggcatggggcagaaagactcctacgtcggggatgaagcacagtccaaaagagggattctcactctgaagtatcccatcgagcacggcataataacaaattgggatgacatggagaagatttggcatcattccttttataatgagctgagggtggcgcctgaagagcatccgacattactgacagaggcgcctctgaaccctaaggctaaccgcgagaaaatgacccaaattatgtttgaaactttcaacgttcccgcaatgtatgttgctatccaggctgtgctgagcctctatgcctctgggaggaccacgggcatcgtgcttgactcaggcgatggagttacacacaacgtgcccatttacgaaggatatgccttgccccacgcaattatgcgactggaccttgccggtcgcgatctaactgactatctgatgaagatcctcaccgagcgcggatacagttttgtcaccacagcagagcgtgaaatcgtgcgtgacatcaaggaaaagctttgttacgtggcccttgatttcgagaacgaaatggccaccgctgcaagcagcagcagtctggaaaaatcctatgagctccccgatggtcaggtgattactatcggcaatgaacggttccgctgtcccgaaacactcttccagccatcctttattgggatggagtccgctggcattcacgagacaacatataacagcatcatgaagtgcgatatagacattcggaaggatttgtacgccaacaacgtcctgagcgggggaacgacgatgtacccaggcattgctgataggatgcaaaaagaaattacagcactggctcccagcactatgaagattaagatcatcgcaccacccgagcggaaatactctgtttggattggtggaagcatactggcatctctgtctacttttcaacagatgtggatctctaagccagaatatgacgaggctggaccatccattgttcaccgaaagtgcttctag

SEQ ID NO: 4532 - DNA, 1131 bp, Artificial Sequence
  Description of Artificial Sequence: Synthetic coding sequence
atgtgcgaggaagagaccaccgctctggtgtgcgacaacggtagtggtctgtgcaaagctggcttcgccggtgatgatgcccctcgggctgtcttcccctctatcgtgggtcgacctcgccaccagggcgtcatggtgggaatggggcagaaggactcgtacgtaggggatgaggcccagtctaaacgaggcattctaactctcaagtatccaattgaacacggcatcattacaaattgggacgacatggagaaaatttggcaccactccttttacaatgaactccgagtcgctccggaggagcaccccaccctgctaactgaggcccctttaaacccgaaggccaatagagagaaaatgacccagataatgttcgagacatttaacgttcctgcgatgtacgtggctattcaggcagttctgtcactctatgccagcggtcgtactacaggcatagtccttgactctggtgatggcgtgacccataatgtgcctatctatgaggggtatgcgttgcctcatgctatcatgaggttggacctcgctggcagagatctcacagattacctaatgaaaatcctgactgagcggggatatagcttcgtcaccacggccgaacgcgagatcgtccgggatattaaagaaaagctctgctacgttgcactcgactttgaaaacgaaatggccacagccgctagtagctctagtctggagaaatcttacgagctgcctgacgggcaggtaataactatcggaaacgagcggttccgctgcccagagacgttattccagccttctttcattggcatggagagtgccggaatacatgaaaccacctataactctatcatgaaatgcgacatcgacataaggaaagacctatacgctaacaatgtccttagcgggggaaccaccatgtaccccggaattgcagatagaatgcaaaaggaaattaccgctcttgctcctagcaccatgaaaattaagataatagcccctcccgaacgtaagtattccgtctggataggcggatccatccttgccagccttagcactttccagcagatgtggatcagtaagcccgagtacgacgaagcagggccatccatcgttcatcgtaagtgcttttag

SEQ ID NO: 4533 - DNA, 1164 bp, Artificial Sequence
  Description of Artificial Sequence: Synthetic coding sequence
atggtggtagagcgagatgacggcagtaccctgatggagatcgatggcgacaagggcaagcaggggggtcccacttactatattgatacaaatgcattgagagtcccgagagagaacatggaggctataagtcccttgaagaacgggatggtggaagattgggactcattccaggcgatcctcgatcacacttacaagatgcatgtgaagagcgaagcgtctttacatcctgtgctcatgtctgaagccccttggaatactcgggctaagagagagaagttaacagaactgatgtttgagcactataatattcctgccttttttttgtgcaaaacagccgtgctaacagcttttgccaatgggagatccaccggcttgatcctcgattctggagccacacacaccacagcgatccccgtgcacgacggctacgttctgcagcagggaatcgttaagtcccccctggcgggagatttcatcacaatgcaatgtcgggagctgtttcaagagatgaacatcgagttagtgcccccttacatgattgcaagtaaagaggccgtcagagagggcagtccggcaaattggaaacggaaggagaagttgccgcaagtcacccgatcctggcacaactacatgtgcaattgcgtgatccaggacttccaggctagcgtgctccaagtctccgactcgacatatgatgaacaggtcgctgcacaaatgcctactgtccactatgagttcccaaacggatacaactgcgattttggggctgaacggcttaaaattccagaaggcctatttgacccctccaacgtcaagggtctgtcaggcaataccatgctcggcgtttcacacgtggtcacaacctccgtcgggatgtgtgatatcgatattagacccggattgtacggcagcgtcatcgtggctggtggtaacaccctaatacagagcttcaccgaccgactgaacagggagttgtcccagaaaacgccaccatccatgcggttgaagctcattgctaataacaccactgttgaaagacggttttcttcctggatcggtggtagtatcctcgcctcattgggtacctttcagcagatgtggattagtaaacaagaatacgaagaaggcggaaaacaatgtgtcgagagaaagtgcccctag

SEQ ID NO: 4534 - DNA, 1290 bp, Artificial Sequence
  Description of Artificial Sequence: Synthetic coding sequence
atgtccggcggagtttatgggggtgatgaagttggagcactggtgtttgacatcggctcttacacggtgagagctgggtacgctggtgaggactgcccgaaagtcgactttccgactgcgatcggaatggttgtggagcgcgacgacggctccacattgatggagatcgacggcgataagggcaaacagggcggtcccacgtattatatagacaccaacgcacttagagtaccacgcgagaacatggaagccatttcaccgctgaaaaatggcatggtggaggactgggactcctttcaggcaatcctagatcacacatataagatgcacgtgaaaagcgaagctagcctgcaccctgtgctgatgagcgaagccccatggaatactcgggctaaaagagagaagctgaccgagctgatgttcgaacactacaacatccccgctttttttctttgcaaaactgcggttttgactgcgttcgccaatggcaggtccacagggctgattcttgacagcggggcaacacataccaccgctatcccagtacatgatggttatgtcctgcagcagggcatagtgaaatctcctctggccggtgatttcatcactatgcagtgtagggagctctttcaggagatgaatatcgagctcgttcctccctatatgattgctagcaaagaggctgtgcgggagggaagccccgcaaattggaaaagaaaggagaagcttcctcaagttacacgatcctggcataactatatgtgtaactgtgtcatccaagactttcaggctagcgttttacaagtttctgattctacctacgacgaacaggtggccgctcagatgcctaccgtgcactacgagttccctaatggctacaactgcgatttcggagctgaaaggttgaagatcccggaggggcttttcgacccatcaaacgtcaaaggcctgagcgggaacaccatgctgggagtgtcccatgttgtgacgacgtccgtcggcatgtgcgatatcgacatacgcccaggcctctatggttccgtcatagttgccggagggaacaccctgatacagagcttcaccgatagacttaacagagagctgtctcaaaagaccccgcctagtatgaggcttaagctcatcgccaacaacacaaccgtggagcgacgcttttcctcatggattgggggatccattttggccagcctcggaaccttccaacaaatgtggatcagcaaacaggaatacgaggagggaggcaaacagtgcgtggagagaaaatgcccctag

SEQ ID NO: 4535 - DNA, 1164 bp, Artificial Sequence
  Description of Artificial Sequence: Synthetic coding sequence
atggtggttgaacgggatgatggcagcaccctgatggagatcgatggtgacaaaggtaagcaggggggtcctacctattacatcgacactaatgcattgcgggttcccagggagaacatggaagctattagcccattgaagaatgggatggtcgaagactgggattcgtttcaggctatcctagaccacacctataagatgcacgtcaaatcagaggcatcgctgcatcctgtgttgatgtcagaggcaccctggaatactcgtgcaaaacgcgagaaactgacggagcttatgttcgagcactacaacatccctgccttttttctatgtaagaccgctgtcctgactgctttcgccaatgggaggagcacagggctgattctcgactccggggctactcacacaacggcaatccctgtgcatgatggttatgttttacagcaaggcatcgtcaaatctcccctggccggtgatttcatcactatgcagtgtcgagagctgttccaggagatgaacatcgagctcgttcccccttatatgatcgcgagtaaggaggctgtgcgagaaggatccccagctaactggaagcgaaaagaaaagctccctcaggtgacccgaagttggcacaattatatgtgcaattgcgtcatccaggattttcaggcctcggtgcttcaggttagtgactccacatacgacgagcaggtggccgcacagatgccaaccgtgcactacgagttccccaacggctataattgtgattttggcgctgaacggctgaagatcccggagggcctgttcgacccaagcaacgtgaaggggctcagcggcaacacaatgctcggagtgtcccatgttgttaccacatctgtggggatgtgcgatatcgacatccgccctggcctgtatggctccgtgatcgttgccggaggtaacactcttatacagtctttcactgataggctcaatcgcgagctgagccaaaaaacacctcccagtatgagactaaagttgattgcgaacaacactacggttgaacgacggtttagctcgtggattggaggctccatcctggcctccctgggtaccttccagcagatgtggatttctaagcaggaatacgaggaggggggtaaacaatgcgtagagcgcaagtgcccttag

SEQ ID NO: 4536 - DNA, 153 bp, Artificial Sequence
  Description of Artificial Sequence: Synthetic coding sequence
atggtcgtcgagagggatgacggatctacactgatggagatcgacggggataaaggaaaacaggggggaccaacatattatattgacacgaatgctctgcgggtccctcgtgagaacatggaggctatttccccactgaagaatggtatgtag

SEQ ID NO: 4537 - DNA, 1281 bp, Artificial Sequence
  Description of Artificial Sequence: Synthetic coding sequence
atgtctggcggtgtgtacggtggagatgaagtgggggcacttgtgttcgacattggcagcttttctgtgagggccggatacgcaggcgaggactgtccaaaggcggatttcccaacgactgtgggcctcctcgcggcagaggaggggggaggtctggagcttgagggcgataaggagaagaaaggtaagatttttcatatagatacaaatgctctacatgtcccacgggatggggcagaggtaatgtccccactgaaaaatggaatgatcgaggactgggaatgcttccgggcaatattggaccacacatactctaaacacgtgaagtccgagccgaatctgcatcccgttttaatgtctgaagccccatggaacacaagagcgaaaagggagaagctcacagaactgatgttcgagcagtacaatatccccgctttttttttgtgtaagaccgccgtgctcactgcgttcgcgaatgggaggagtaccgggcttgtcctggacagcggggcaacacatactacggccattccagttcatgacggctacgttcttcaacagggtattgttaagtcaccccttgccggtgacttcatctctatgcagtgcagagaattattccaagagatggccatcgacattattccgccttatatgatcgccgctaaagaacctgttcgagagggcgctcctcccaattggaagaagaaggaaaaactacctcaggtgagcaaaagctggcacaattacatgtgtaatgaggtcatacaggacttccaggcttcagttctccaggtctctgactcaccatatgatgaacaagtggcagcccagatgcctacagttcactacgagatgcctaatgggtacaataccgattacggagccgagaggctaagaatccccgaggggctgttcgacccatccaatgtgaaaggactttctggcaacaccatgttgggggttggtcatgtggtaaccacaagtataggcatgtgcgatatcgatatacgacccggtctttacggcagcgtcattgttacagggggaaatacgctactccagggcttcacagatcggctcaatagggagctctcgcagaaaaccccacctagtatgagactgaaattaattgcatcaaactccacgatggagcggaagttctccccatggattggaggctctatactcgcaagcctcggaacttttcaacagatgtggatctctaaacaggaatacgaggagggcggtaagcagtgcgtggagcgaaagtgtccctag

SEQ ID NO: 4538 - DNA, 1308 bp, Artificial Sequence
  Description of Artificial Sequence: Synthetic coding sequence
atgtgggcaccccctgcagccattatgggcgacggtcccacaaaaaaagtgggcaaccaggccccactacaaactcaggcactccaaaccgcgtcactaagagatggcccagcaaagcgtgcggtttgggtaaggcacacttcatcagagccccaggaaccaacagaatccaaagcagcgaaagagcgcccaaagcaagaagtaacgaaagccgtggtcgtggacctgggcaccggatactgtaaatgcgggttcgccggtttgccaagaccaacacacaagatttccacgacggtgggcaaaccgtatatggagaccgcgaagactggagacaataggaaggagacttttgtgggccaggagctgaataatacaaacgtgcaccttaaactcgttaaccccctacgccatggaattattgtggactgggatacagtgcaggatatctgggagtacttgttcaggcaggagatgaaaatcgcccctgaggaacatgccgtgcttgtttccgatcctccattgagccctcataccaaccgtgagaagtacgctgagatgctgttcgaggctttcaacaccccagctatgcatattgcatatcagagcagactatcaatgtatagctatggcagaacatccggccttgtggtcgaggtggggcacggggtgtcttatgtggtacccatttacgagggctatccattgccttcgattaccggacggctggattacgcaggctccgacctcacagcctacctcctggggttgttaaattctgccggtaacgagttcactcaagaccaaatgggaattgttgaagacataaaaaaaaagtgttgcttcgtggccctagatcccatcgaggagaaaaaggttcccctatccgaacacacgattcgatatgtgcttccagacggtaaggagattcaactgtgtcaggagcgtttcctctgctccgagatgttcttcaagccgagcctgatcaagtccatgcagcttggactgcacacccaaactgtctcttgcctcaacaaatgtgacatcgccctgaaacgcgatctgatgggtaacattttactgtgtggtggcagtaccatgctgagtggattccccaatcggctacagaaagagttgtcaagcatgtgtccgaatgatacccctcaagtcaacgtcctgccagaaagggactccgcggtatggaccgggggatccatccttgcatcactgcagggcttccagcccctctgggtccacaggtttgaatacgaggaacatggaccgttctttctctaccgaagatgcttctag

SEQ ID NO: 4539 - DNA, 1248 bp, Artificial Sequence
  Description of Artificial Sequence: Synthetic coding sequence
atggcaacccgtaattctcccatgcctttgggcactgcacagggggacccgggtgaagccggtactaggcccggtcctgacgcctcactcagagacaccggagcggctacccagctcaagatgaagcccagaaaagtccacaaaatcaaagctgttataatcgatctgggcagccagtactgcaagtgcggttacgcaggcgagcctcgtccaacgtactttataagcagtacggtagggaagaggtgccctgaggctgccgacgccggtgatacaaggaaatggactctggtaggacacgagctactcaatactgaggcaccgctcaaattggtaaacccattaaaacacggcattgttgtggactgggattgcgtgcaggatatctgggagtatattttccgaactgccatgaagatcctgccggaagagcacgcagttctcgtgtctgacccaccactttctccatccagcaacagggagaagtacgccgagctcatgttcgagacctttggaatcccagccatgcacgttacatcccagtcactcctatcaatctatagctacggcaaaaccagtggcctggtcgtggagagcggccatggcgtgtcccacgtggttcctatctctgagggcgacgttctgccagggcttacatccagagcagactatgccggaggcgacctgaccaattacctgatgcaactgctgaacgaggccggacatgcttttaccgacgaccacttgcacattattgagcacatcaagaagaagtgttgctatgcagccttcctcccggaggaagaattaggcctggtgccagaggagctgagggttgactatgaattacctgatgggaaactaatcactattggccaggaaagatttagatgcagtgagatgctcttccagccgtccctcgcagggagtacacagccagggctcccagaactgaccgccgcatgcctcggtcgctgtcaagacacggggtttaaggaggagatggcagccaatgtgcttttatgcggaggatgtaccatgttggacggctttcccgagaggttccagagagagttgagtctgctgtgtccaggcgatagtcctgcggtcgcagcggctccagagcgcaagacgtccgtatggaccggaggtagcatcctcgcctcattgcaggcctttcagcaactgtgggtgagcaaagaagagtttgaggaacggggtagcgtggccatttattcaaagtgttag

SEQ ID NO: 4540 - DNA, 1101 bp, Artificial Sequence
  Description of Artificial Sequence: Synthetic coding sequence
atggcggcacgtactgttatcatagaccatggatcagggttcctcaaagcaggcacagcaggttggaacgagccgcagatggtgtttccgaatatagttaactacttaccctgcaaggagaacccaggaccttcatatgccaggcgtagggtgtctttggggatcgacatctgtcaccccgacaccttctcgtatcctatcgaaaggggcagaatcctgaattgggaaggggtgcagtatctctggtccttcgttttggagaatcatagacgagaacaggaggtgcccccagtgattatcaccgaaactccactgcgagaaccagccgatagaaaaaagatgctggaaatccttttcgagctcctacacgttccaagtgtattgctcgccgatcagcttcagatgagtctctacgcaagtggcctgctgaccggggtggtggttgatagtggctacggcctgaccagagtccagccatttcaccaagggcgtccactccctgcgtctgggaagacactggaattcgccggacaggatctgagcgcgtatttacttaagagccttttcaaagaggattgtgaccggaggtgcctgttccagttggagacagttgcggtgactcagatgaacaaatgttacgtgcctcagaatctgggtgaggccctcgatttccgggagagacagcagtccgctctggacgagtcaaacacatatcagctcccagacggcagccgggtcgaactgacccctatgcagcgggtagcacccgagatgttcttctccccacaagtctttgagcagccaggacctagtatccctcgggctattgtcgaatcggtagaaagctgcgaaatttctcttagaccgcttctagtgtcccatgtcatggcgtgtggaggcaatacactgtatccgggatttactaaacgtctttttagagagttgatgggcgaccatgtttcgtcaactaaagctacagtgtgggaaggctcgaaccgcaattttagcgtctggctgggcgcatcagttgtcgcccaccttagtacctaccagtctgaatggatgtccagagaggagtatggggaacatatgcgtatgtag

SEQ ID NO: 4541 - DNA, 1251 bp, Artificial Sequence
  Description of Artificial Sequence: Synthetic coding sequence
atggacgctagccggcctaagagtagcgagagtcagagctcattagaagctcccagaccaggacccaacccatctccaaacgttgtaaataaacctttgcaacgcgatttcccaggcatggtggccgacagactgccgccaaaaactggtgtcgtagtaatcgacatgggaacagggacctgcaaggtaggctttgccggacaggccagccccacctatactgtggcgaccatcttggggtgtcagcctaagaagcccgcaaccagcggccagagcggcctccaaaccttcataggtgaggccgcaagggtgctccccgaactgaccctagtgcaacccctacgcagtgggatcgtggtggattgggatgccgctgaactcatctggcgccatcttctcgagcacgatctgcgggtagcaacccatgatcaccccttgctgttctctgacccacctttttctccggcaactaacagggagaaattggtggaggttgctttcgagtctctgcggtcccccgctatgtacgtagcgtcgcagagcgttttatcagtgtatgcgcacgggagggtctccggcctggtggttgataccgggcatggtgtgacgtataccgtaccagtcttccaaggctataatctactgcatgcgacagaaagactagatctggctggaaatcatctgaccgcctttctggccgagatgctacttcaggccggtctccccctcggtcagcaagatctggatctcgtggaaaatatcaagcaccattattgttatgttgcaagcgatttccagaaggagcaggcaaggcccgaacaggagtacaagcgcacactgaagctgccggatggccgaacggtgaccctcggaaaagaattgtttcaatgccctgaattgctcttcaacccgcctgaagttcctgggctgtctccggtcggactttctactatggccaaacaaagcctgaggaagctgagtttggaaatgagagccgatcttgctcagaacgtactgctgtgcggtggatcctccctcttcacgggcttcgagggcagatttcgggcagaactcctcagagctctcccagccgagactcacgtagttgtggctgctcagcccacccgcaatttctctgtctggatcggagggtcaatactggcgtctcttcgggcattccagtcttgctgggtgctcagagagcaatacgaggaacagggtccctatattgtgtatcgcaaatgttactag

SEQ ID NO: 4542 - DNA, 2763 bp, Artificial Sequence
  Description of Artificial Sequence: Synthetic coding sequence
atggaggtacagcttggccttggcagggtgtatcccagacccccttctaaaacatatcgcggagcctttcagaatttgttccaaagcgtccgcgaggtgatccagaatcccggtccgcgacatccagaggccgcaagcgccgctcctccaggggcaagtctgctgctgttgcaacaacaacagcagcaacagcagcagcagcagcagcagcagcagcagcagcagcagcagcagcagcaggagacctccccccgtcaacagcagcaacagcagggagaggacggcagccctcaagcccacaggagaggcccaaccggctacttggtcctggacgaggagcagcagcccagccagcctcagtccgcattggaatgtcatcccgaaagggggtgtgtgcccgagcctggcgcagcagttgcagcatctaagggtctgccccaacaactaccagccccacccgatgaagatgactccgccgctccgagcacactttccctcctcggacctacatttcctgggctatcctcatgctctgccgacttgaaggacattctgtccgaggcttccactatgcagttgctgcagcagcaacagcaggaggccgtgagtgagggttctagttctggcagggcgagagaagccagcggtgcgcctacttcttcaaaagacaactacttgggcggtactagcacaatatctgataacgccaaggagttatgcaaggccgtgtctgtcagtatgggcctgggagtggaggctctggagcacttgtcacccggagaacagttaagaggcgattgtatgtacgcccctcttctgggtgttccacctgctgtgcggccaactccctgcgctcctctcgccgaatgcaaggggtctctgctggacgattctgccggtaaaagtaccgaagatacagccgagtactccccattcaagggcggatacactaagggcctggaaggagagtcactgggctgtagcgggtcggccgctgccggaagcagcgggactctggagctcccctcgacactcagcctctacaaatccggggctctggatgaagcagcagcatatcagtcccgcgactactataactttcccctagcgctggccggaccgccaccccctcctccaccgccacacccacacgcgaggatcaaactggaaaacccactagactatggaagtgcatgggcagccgctgcagctcagtgtaggtatggggatctcgcctccctgcacggcgctggcgcagccggtccagggtcaggtagcccatctgccgcagcctcttcaagctggcacaccttgttcaccgccgaggagggacagctctatggcccttgcggagggggaggaggtggcggagggggtggcggtggtggtggtggcggtggcggtgggggtggcggaggagaggcaggggcagtagccccttacggttatacccggcctccacagggcctggctggccaggaaagcgatttcaccgcccctgatgtgtggtaccccggaggtatggtcagtagggttccataccccagtcccacctgcgtcaaatctgagatgggcccttggatggactcgtactcagggccttacggtgacatgaggctagagaccgcccgtgaccatgtgttgcccattgattattattttccaccacagaagacctgtctcatctgcggggacgaggcaagcggatgccactacggcgctctgacatgcggatcatgcaaggtgttttttaagcgggcagcagagggtaaacagaaatacttatgtgcatctaggaatgattgtacaattgataagtttcggagaaaaaactgtccatcctgccggttgaggaagtgctatgaagcagggatgaccctcggcgcacggaaactgaaaaagttagggaatcttaagctgcaggaagaaggtgaggcgtcttccaccacgagccccaccgaagagacaactcagaagctgacagtgtcacacattgagggttacgagtgccagcctatctttcttaacgttttagaagccatcgaacccggagtggtgtgcgcgggacatgacaataaccagccagacagtttcgcggcattgctctcctccctaaatgaattgggcgaacggcagctggtccacgtggtgaaatgggctaaggcattgcccggatttcggaacctgcacgtcgacgaccaaatggccgtgatccagtactcttggatgggactgatggtctttgccatggggtggaggtcttttactaatgtgaattcacgcatgttgtacttcgctccagatctagtgttcaacgagtaccggatgcataagtcgagaatgtatagtcaatgcgtccgcatgagacatctgagtcaagagtttggatggctgcagatcacacctcaggaatttctgtgtatgaaggcactcctgctgtttagtattatacccgtcgacggtttaaagaaccagaaattcttcgatgagctgagaatgaattacatcaaagagttggatagaattatcgcctgtaaaaggaagaaccctacgagttgctctaggcggttctatcagttgaccaagctgctcgactcagtccagccaatcgcacgcgagctgcatcagtttaccttcgacctcctgattaagagccatatggtcagtgtggacttccccgagatgatggctgagatcatctccgtgcaggtacctaagattctctctggcaaggtcaagcctatttattttcatacccagtag

SEQ ID NO: 4543 - DNA, 1167 bp, Artificial Sequence
  Description of Artificial Sequence: Synthetic coding sequence
atgattctctggctgcatagcctggagacagccagagaccacgtgttacctattgactattatttccctcctcagaagacttgcctgatctgcggcgatgaggctagtggctgccactatggagcattaacctgcggcagttgcaaggtgtttttcaaaagggctgctgagggaaaacagaagtacctgtgcgcttccagaaacgattgcactatcgacaagttccggcgaaagaattgcccaagttgcaggttgcggaagtgctatgaggcaggcatgactcttggcgctaggaagctcaaaaaactgggaaatctgaaactccaggaagagggcgaggcttcctcaacaacctctcccacggaggaaaccactcaaaaacttaccgtatcacacatagaggggtacgaatgccagcccatctttctcaatgtattggaggcaatagaacccggagtggtctgtgcgggtcatgacaataatcaacctgattctttcgctgctctcctttccagcctgaacgaactaggagaaagacagttagtgcacgttgtgaagtgggcaaaggcactgccaggcttccgtaatctccacgtcgacgaccagatggccgtcattcagtactcttggatgggactaatggtgtttgccatgggctggcgctcgttcacgaatgtgaacagccgcatgttgtactttgcccctgatctcgtgttcaacgagtatcggatgcacaagagtcgaatgtacagtcagtgcgtcagaatgcgacatctgagtcaggaattcggctggctgcaaatcacaccccaggaattcctgtgtatgaaggctctgctgctgttctctattattcctgtagatgggctcaaaaatcagaagttttttgatgaactccggatgaactacattaaagaactcgataggataattgcctgcaagcggaagaatcctactagctgctccaggaggttttaccagctgacaaagctgttggactctgtgcagccgatcgcaagggagctgcaccaatttacttttgaccttttaataaagagccatatggttagtgtcgatttccccgagatgatggccgaaattattagtgtgcaggtccccaagatcctgagcggaaaggtgaagcccatatattttcatacccagtag

SEQ ID NO: 4544 - DNA, 2205 bp, Artificial Sequence
  Description of Artificial Sequence: Synthetic coding sequence
atggaggtgcagctcggactggggagagtgtaccccagacctccatctaaaacttacaggggcgcttttcagaatctgtttcagtccgtgagagaagtgattcagaaccctgggccacggcaccctgaggccgctagcgcggctcccccaggtgcatctcttcttctgcttcagcagcaacagcagcagcagcaacagcagcagcaacagcagcaacagcagcagcaacaacagcagcaggagaccagcccgagacagcaacaacaacagcaaggggaggatggtagcccacaggcccaccgccgagggcctactggatacctggtgctggatgaggaacaacagccgtctcagcctcagtctgccctggaatgccaccccgaacgcggatgcgtgcctgagccaggcgctgcagtcgccgcatctaagggactgccgcaacaactgcctgcccctccagacgaggacgacagcgccgcaccaagtaccctatctcttctcgggccaacttttcctggactgtcctcctgttcagcggatctaaaggacatcctgagtgaagctagtactatgcagttgttgcagcaacagcagcaggaggcggtcagcgagggcagcagtagcggaagggccagagaggcatcaggtgcccctacctccagcaaggacaactacttggggggtacatcaacaatttccgacaatgccaaagaactgtgcaaggcagtcagcgtgtcaatgggcttaggggtggaagccctagagcacctgagtcccggagagcagctgcgcggagattgcatgtatgcaccattgttaggagtgcccccagccgttcgaccgaccccctgcgcgccactggccgagtgcaaggggtcactgctggacgattcagccggaaaatccacagaagacacagcagagtatagtcccttcaagggcggttacacaaaagggttagaaggtgaaagcctggggtgctctggatcagcagccgctggctccagcggcacactggagctgccctctactctgtcactttacaagtccggcgcattagacgaagctgccgcataccagagccgcgactattacaacttccctcttgcactagccggtcctccccctccacctccacccccacacccacacgctagaattaaattagagaatcctctggattatggaagtgcctgggcagctgctgcagctcagtgcaggtatggagatttggccagcttacacggtgcaggcgcagctggaccaggtagtggttcgcccagtgcggctgctagtagctcttggcacacgctattcacggccgaggaaggtcaactctacggaccatgcgggggtggtggaggagggggaggtggtgggggaggaggcggaggtggtgggggagggggtgggggaggcgaagctggggcagttgcaccctacggctacaccagaccccctcaggggctggctggccaggaatctgatttcactgcgccagatgtttggtaccccggagggatggtcagcagggtcccataccctagccccacatgcgtcaagagtgaaatgggaccgtggatggattcctacagtggcccttatggcgacatgagacttgaaaccgcacgggatcacgttctgcctattgactactattttcctccacaaaaaacatgcctgatttgtggagacgaggcctccggatgtcattacggggctcttacatgcggtagctgcaaggtcttcttcaagagagcagctgaggggaaacagaagtatctatgtgcttcacggaatgattgtactattgataagttccgcaggaaaaactgtccttcctgtcgactacggaagtgttatgaagcagggatgacccttggagccagaaagttgaaaaagctgggaaacctcaaactacaggaggagggagaggcttctagcacaacatcccctacggaggagaccacacagaagcttactgtctctcatattgaaggctatgaatgtcagcccatcttccttaatgtgcttgaggccatcgaacccggagtggtgtgtgccggtcatgataataaccaacctgattcttttgccgcactcctgtccagcctaaatgaactgggggaaagacagctcgtgcatgtggtgaaatgggcaaaagctctgcctgattgcgagcgggctgcgagcgtgcacttttag

SEQ ID NO: 4545 - DNA, 1596 bp, Artificial Sequence
  Description of Artificial Sequence: Synthetic coding sequence
atggaggtgcagctcggacttgggagagtctatccccgacccccatcaaaaacatatagaggagcatttcaaaacctgttccagtccgtgcgtgaagtgattcagaacccaggtcccagacacccagaggccgcatcggccgctccaccgggagccagcctgctcttactgcagcagcagcagcagcagcagcagcagcagcagcagcaacagcaggaaacttccccacgacagcaacaacagcagcagggcgaagatggctctccccaggcacatagacggggtcctactggctatttagtcttggacgaagaacagcagccttcccagcctcagagtgccctggaatgtcaccccgaacgaggatgcgtcccagaacccggagcagccgtggctgcaagcaaggggctcccacagcaattgcctgctccccctgacgaggatgactcggcagcccctagcaccttgagcctgctgggtcctacgtttcctggcctctcttcttgctctgccgacttgaaagacatcctgagcgaggcctctactatgcagctgctgcaacagcagcagcaagaagccgtgtccgaaggatcgtcctctggtcgcgcacgggaagcatccggagctcccacatctagcaaagacaactaccttggtgggacttctactatctcagataacgccaaggaactatgcaaagcagtaagcgtttcaatggggctaggcgttgaggcactggagcacctgagtccaggggaacagttgaggggggattgtatgtacgctcctctcttgggcgtgcccccagccgtgagacccactccctgcgcacccctggctgaatgtaaaggtagcctgttagatgattccgctggcaaatcaacagaagacaccgccgaatactctccatttaagggtggttatacgaaaggactcgagggagaaagcctcggctgcagcgggagcgccgctgccggaagttctggcaccttagagttgccctccaccctgtcactttataagagcggggctttagacgaagcagccgcataccagagccgcgattactacaattttccgctcgctttggctggccctcctccccctccacctccaccacatcctcatgcacggatcaagctggagaaccccctcgactacggttccgcgtgggctgccgctgctgctcagtgccgctacggtgacctcgcctctttacatggcgcaggcgcagctggtccagggagcggaagtcccagtgccgcagcgagctcttcttggcacactctcttcaccgccgaggagggacagctgtatggtccatgtgggggtgggggaggcggagggggtggcggaggcggtgggggtggtggcggtggcggaggaggtggaggtgaggctggcgcagtcgcgccatatggctacactcggcctccgcagggtctggctggacaagaaagtgactttaccgctcctgacgtctggtatcccggagggatggtcagtcgggtaccatatcccagccctacttgcgtgaaatccgaaatggggccatggatggatagctatagcggcccatacggagacatgaggtag

SEQ ID NO: 4546 - DNA, 2217 bp, Artificial Sequence
  Description of Artificial Sequence: Synthetic coding sequence
atgcagctcctgcagcaacaacaacaggaggccgtttccgagggaagctcttctggacgggctagggaggcatccggggcacccacttcaagtaaagataactaccttggcggtacaagcactatcagcgataacgcgaaggagctttgcaaggccgtgagtgtctcaatgggactcggcgtcgaggccctggagcatctaagtcctggcgaacagttgaggggagactgcatgtacgccccactgctgggggtccctccagccgttagacctacaccttgcgctccattagccgaatgcaagggctctttgcttgatgattctgccggaaagtcaacggaggacacagccgaatattcacccttcaaggggggttacaccaaaggcctggagggcgagtctttgggttgcagcggttctgcagctgcaggaagctccggcaccctcgagcttccaagcaccctttccttgtataaatctggagcactggatgaggcggcagcttaccaaagtagggattattacaacttcccattggccttggctggcccacctccacccccacctcctcctcaccctcacgccaggatcaagctggagaacccactggactatggtagcgcctgggccgctgcagccgcacagtgccgttacggggacctagcaagcctgcatggggcaggagccgcaggtccgggatccggcagcccaagcgcggctgccagctctagttggcacactttattcactgccgaagaaggccagctatacggaccttgtggcggaggaggcggaggaggaggtggcggaggtgggggagggggaggcggaggagggggagggggaggtgaggcaggcgctgtggccccatatggctacacgcgacccccacaaggtctcgctgggcaagaatccgatttcacggccccagatgtgtggtacccaggcggaatggtgagtagagtcccataccctagccctacctgcgtcaaatccgagatgggcccttggatggactcttacagcggcccatacggtgacatgaggttggagactgcaagggaccatgtgctgcccatcgactattactttcccccacagaaaacctgtctcatatgtggagatgaagcttccggctgccattacggggcattgacctgcggtagttgcaaggtgttcttcaaacgggctgcagaggggaaacagaagtacctgtgtgcttcacgcaacgattgcacgatcgataaattcaggcgaaaaaactgcccaagctgtcgtctgagaaaatgttatgaggctggaatgactctgggggctcggaagctgaaaaagctcggaaacctgaagctgcaagaggagggagaggcaagcagtacaacatctcccaccgaggagactactcaaaagctcacagttagccacattgagggctacgaatgccaacctatatttctgaatgtcctcgaggccattgagcccggtgtcgtctgcgcaggacacgacaacaatcagcctgatagtttcgccgctctgcttagctcactgaatgagctaggtgaacggcagcttgtgcacgtggtgaagtgggcgaaagcacttccaggctttcggaaccttcatgtagatgaccagatggcggtgattcagtattcctggatggggctaatggtgtttgccatgggctggcggtcctttaccaacgtcaacagtcggatgctatatttcgcacccgatcttgttttcaacgagtatagaatgcataaatcgaggatgtattctcagtgtgtccgaatgagacacctatcccaggagttcggctggctacagatcactccccaggaatttctctgtatgaaagccctccttctgttttccatcacattctgcttacatccaacctctgtgcccgtggacggtctgaagaatcagaaattcttcgacgaactcaggatgaattacatcaaggagctggatcggatcattgcatgcaagcgcaagaacccaaccagctgctctcgcagattttaccagctgaccaaattgctcgactccgtgcaacctattgcaagagaactccatcagttcacttttgatctgctaatcaaatcccatatggtgagcgtggacttcccagaaatgatggcagaaattatttccgtccaagttccaaaaatcttgtccgggaaggtgaaacctatttacttccacacccagtag

SEQ ID NO: 4547 - DNA, 4290 bp, Artificial Sequence
  Description of Artificial Sequence: Synthetic coding sequence
atggtggctgccgctgctgcaactgaagcacggctcagaaggagaacagctgcgactgctgccctggctgggcgatctggagggcctcactgggattgggatgtcacacgggctgggaggccaggattaggggctggcctgaggcttcccaggttactctcccctccattgcgacctaggcttctgcttcttctcttgctgctgagtcctccattgctcctgctgcttttgccatgcgaggcagaagccgcagctgctgccgctgctgtcagtggctcagctgcggcagaagcaaaggagtgcgaccggccttgcgttaacggcggacggtgcaatccgggaaccgggcagtgtgtttgcccagcagggtgggtgggagagcagtgtcagcactgtggcggacggtttcggctgactgggtccagcggcttcgtcacagatggtcccggtaattacaagtacaagacgaaatgtacatggctcatcgaaggacagcccaaccggatcatgcgactacgctttaaccacttcgccactgaatgttcctgggaccatttgtatgtgtacgacggcgactcaatctacgctccactggtagcagcattcagcggtcttatcgttccagagagagatggaaatgagactgtgccggaagtggtggccacgtctgggtacgcattgctgcacttcttcagcgacgcagcatataacttgaccggattcaacatcacttactcattcgacatgtgcccaaataattgttccggtcgaggcgagtgtaaaattagcaactcctccgacacagtagaatgtgagtgctccgagaattggaagggggaagcttgtgatatcccccactgtactgataactgtggattcccccaccgcggtatctgcaatagttctgacgttagaggttgtagttgcttcagtgactggcaagggcctggttgttcagttcccgtgcccgctaatcagtcattttggactcgcgaagagtactctaatctgaaactgccacgcgcatctcataaagcagtggtgaatggaaatatcatgtgggtggtaggtggttatatgttcaaccatagcgattataacatggtactggcctatgaccttgcgtcccgggagtggctgcctctgaaccgctcagtgaacaacgtggttgtgcggtacggtcattctctcgcactgtacaaagacaaaatttacatgtatggcggtaaaatcgactccacagggaatgttacaaatgaactgcgagtcttccacattcacaacgaatcctgggtgttgttaaccccaaaggccaaggaacagtacgccgtcgtcggccattccgcccacattgtgactttaaaaaatggaagagtcgtgatgttagttatatttggacactgccccctgtacggctacatctctaacgtccaggagtacgatctcgataaaaatacatggagcattctgcacacacagggtgcgctagtgcagggagggtatgggcatagtagcgtgtatgaccatcggacccgagccctctacgtgcacgggggatataaagcttttagcgcaaacaagtatcgcttggctgacgacctctaccgctacgacgttgacacccaaatgtggactatcctcaaagattcccgctttttccgttatctgcacactgctgttatcgtttcaggaacgatgctcgtgtttggcggtaatacccataacgatacctctatgtctcacggcgcaaagtgcttttcctcagattttatggcatacgatatcgcttgcgatcgatggtccgtgctacctcgacctgatctgcaccacgacgtgaatagatttggtcactccgccgtgctacacaactctacaatgtacgtcttcggcggatttaattctctgctcctctcagacatcctcgtatttacttccgaacaatgcgatgcccaccgcagcgaagcggcatgcttggccgctgggccaggcattagatgtgtgtggaacacaggctcctcacagtgtattagctgggcgcttgccaccgatgaacaagaagaaaaattgaaatctgaatgtttcagcaagcgcaccttagaccacgatcggtgcgatcagcacactgactgttatagttgtacggccaacacaaatgattgccactggtgcaatgaccactgtgtgccacgaaaccatagttgtagtgaggggcaaatttcaattttcagatacgaaaattgtccaaaagataatcccatgtattactgtaacaaaaaaacttcctgtaggagctgtgccctcgaccagaattgtcaatgggaaccacgtaaccaggagtgcatcgccctcccagaaaacatatgtgggattgggtggcacctggtcggcaacagctgcctcaagattaccaccgccaaggaaaactatgacaatgccaagttattttgtcgaaaccataacgcactcctcgccagtcttacaacccagaaaaaagttgagtttgtgctaaagcagttaaggataatgcaatcgtctcagtcaatgtctaagctgaccctcactccttgggtgggtctccggaagatcaacgtctcatactggtgttgggaggatatgtccccttttactaattctttgctgcaatggatgcctagtgagccttctgatgctggcttctgtggcattctcagtgagccgagtacaagaggtcttaaagccgcaacatgtatcaacccgctgaacggttctgtgtgtgagcgcccagcgaaccattctgccaagcagtgtcgtacaccttgcgccttgcggaccgcttgcggagactgtacgtccggatcttctgaatgtatgtggtgcagcaatatgaagcaatgtgttgatagcaatgcttacgtagctagctttcccttcgggcaatgcatggagtggtataccatgagcacctgtccccctgaaaactgtagtggttactgcacatgctcccattgtctagagcagcctggttgcggctggtgtactgatccaagcaatactggcaaaggcaaatgtattgaaggcagctacaaggggccagtgaagatgccgtctcaagctccaacggggaacttctatccccagccactgctgaattcgtctatgtgtcttgaggattctagatataattggagtttcattcactgcccagcctgccagtgcaatggacattccaagtgtatcaatcagtcaatttgcgagaagtgtgagaacctgacaacgggcaagcattgtgaaacctgcatctctggattctacggcgacccgactaacggtgggaagtgccaaccctgcaagtgtaacggccatgcctcactctgcaacaccaataccgggaaatgcttttgtacgactaagggggtcaaaggagacgaatgccagctctgcgaggtagagaataggtatcagggaaatcctctgagaggaacctgctactatacactgctgatcgactatcagttcaccttctcgttatcgcaggaagatgacagatactacaccgccattaacttcgtcgctacccctgatgagcagaatagggatctggatatgtttatcaacgcgagtaagaactttaacctgaatataacatgggcagctagcttctcagccggtactcaggcgggtgaggagatgccagtggtgagcaaaaccaacatcaaggagtataaggactccttttccaatgaaaaattcgactttaggaatcacccaaacattacctttttcgtgtacgtttctaactttacttggccgattaaaatccagattgcattctctcagcattccaatttcatggaccttgtgcaatttttcgtgacattcttctcctgcttcttgtccttactgttggtggctgccgttgtttggaagataaaacaaagctgctgggcaagtaggcgccgtgaacagctgctgcgagagatgcagcagatggcctctaggccattcgcctccgttaacgtggctcttgaaactgacgaagagcccccagacttgattgggggtagcatcaaaacggttccaaagcctattgctctggaaccatgtttcggcaataaagcggctgtgttgagcgtatttgtgcggctcccaaggggtcttgggggtatccctcccccaggccagtccggcctcgctgttgcatcggctttagtggacatctcccagcagatgccaatagtgtataaggaaaagagtggcgcagtgcgtaaccgcaagcagcagccacccgcacagcccggaacttgcatttag

SEQ ID NO: 4548 - DNA, 3582 bp, Artificial Sequence
  Description of Artificial Sequence: Synthetic coding sequence
atggtagcagccgcagctgcaactgaggccagactccggaggcggactgccgctactgcggcactagcaggcaggtcgggtggaccgcactgtgttaacggtggccgatgtaacccagggacaggacagtgtgtgtgtcctgccggttgggttggagaacagtgccagcactgcggcggacggtttcggctcaccgggagttccggattcgtgacagatggacccggtaactacaagtacaaaactaaatgtacatggttgatagaaggccagccaaatcgtataatgcgactgagattcaatcacttcgcaacagaatgctcgtgggatcatttgtatgtttatgatggggacagtatctacgcccctttggtggctgctttcagcggcctcattgttccagagcgggatggaaacgaaactgtcccagaagtcgtggccaccagtgggtatgccctattgcacttcttctctgacgctgcttataacctaacaggattcaatatcacatattctttcgatatgtgtccaaacaattgttcaggcaggggcgaatgtaagatttccaattcctcagacaccgtagagtgtgaatgtagcgagaattggaaaggcgaggcctgcgacattcctcactgtacagacaactgtggcttcccccacagaggcatctgtaacagtagtgacgtcagggggtgcagttgtttctctgactggcaggggcctggctgcagtgtccctgtgcctgccaatcaatctttctggaccagagaagaatacagcaacctaaaactccctcgagcgtcccacaaggcggtggtcaacggcaacatcatgtgggtggttggcggttacatgtttaaccacagtgactacaacatggttttagcctacgatctcgcttctcgcgagtggctcccgctgaacagatccgtaaacaacgtggtggtcaggtacgggcactctctcgcactgtataaggataagatctacatgtatggcggaaaaatcgactccaccgggaacgtaactaacgagctgcgcgttttccatatacataatgagagctgggtccttctgactccaaaggccaaagagcagtacgcagtcgtggggcactccgctcacatcgtcactctgaaaaatgggagggtggtcatgttggttatctttgggcactgccctctctacggctacatatcaaatgttcaggaatatgatctggataagaacacatggtcaattctgcatacccaaggcgctctggtccagggtgggtacggccattccagtgtgtatgatcatcggaccagggcactgtatgtgcatggaggctataaggcgttctccgcaaacaaataccgactcgcagacgatctctatagatatgatgtggacacacagatgtggacaatcctcaaggactcacgcttcttcaggtacttgcacaccgccgtgattgtgtccgggactatgctcgtgtttggtggcaacacccataatgacacttctatgtcacacggagccaagtgcttctctagtgacttcatggcctacgacattgcttgtgatcgctggagcgtcctgcccagaccggacttgcatcacgacgtgaatcggttcggccattccgccgtgctccacaatagtaccatgtacgtgtttggtggatttaattcactgctgttgtccgacatacttgtcttcacaagcgagcaatgcgacgcccatcggtcagaagctgcctgcctcgccgcaggacccggtattcggtgcgtatggaacaccggatcatctcagtgtatttcatgggccctcgccaccgacgagcaggaggaaaaattgaaatctgagtgcttcagcaagcgtactcttgatcacgatagatgcgaccagcacactgactgttattcatgcaccgccaataccaacgactgtcactggtgtaacgaccactgtgtccccagaaaccattcgtgctcagagggacaaatttcgatttttcggtatgagaattgtccaaaggataatcccatgtactattgcaacaaaaaaacatcatgtaggtcatgcgcattggatcagaattgtcagtgggaaccacgtaaccaggagtgcattgcactcccagaaaacatatgtgggattggatggcaccttgttggcaattcgtgcctgaaaattactaccgctaaagaaaattacgataacgccaagctcttctgcaggaaccacaacgctctgttagcttcattgacaacccagaaaaaggtcgaatttgtcttgaaacagctccgcatcatgcagagcagccagtcaatgagtaaacttacccttacaccatgggtgggcctgagaaaaatcaacgtgtcttactggtgctgggaggacatgagcccctttacaaatagccttctgcaatggatgccttccgagcctagcgatgctggcttctgcggtatacttagcgaacctagtaccaggggcctgaaggcagctacctgtattaacccattaaatggatcagtgtgtgagcggcctgccaaccactcggccaagcagtgtcgcacaccctgcgcactcaggacggcctgcggcgattgcacgtcgggatcctcagaatgtatgtggtgttctaacatgaaacagtgtgttgattctaacgcatacgtcgcctcatttccttttggccagtgcatggagtggtatacgatgtccacatgtccccctgagaactgtagcggttactgtacctgctcacactgtctggaacaacccggatgcggctggtgcactgaccctagcaacaccggcaaaggaaaatgcatcgaaggaagctacaagggacccgtgaagatgccctctcaggccccaaccgggaacttttatcctcaaccactgctgaatagcagcatgtgcttggaagattcgcggtataattggagcttcatccattgtcctgcgtgccagtgtaacgggcatagtaaatgtatcaaccagtccatatgtgagaaatgcgagaatcttacaacaggtaagcactgcgagacatgcattagtgggttctatggtgaccctaccaatggtggtaagtgtcagccctgtaaatgtaatggccatgccagcctctgcaatacaaatacagggaagtgcttctgtacaactaaaggcgtcaaaggagacgagtgtcagctttgcgaggtcgagaaccgataccaggggaaccctctccggggaacctgttattacaccctgcttattgactaccagtttacattctcactgagtcaggaggacgaccgctattacactgctataaattttgtggctactcccgacgaacagaatagagacctggacatgtttatcaatgcaagcaagaacttcaatctcaacattacctgggcagcaagcttttcagcgggaacacaggcaggggaggaaatgccagtcgttagcaagacgaacattaaggagtacaaagattcctttagcaatgagaagtttgatttcaggaatcaccctaatattacttttttcgtctatgtcagcaatttcacctggccaattaagattcaatag

SEQ ID NO: 4549 - DNA, 3819 bp, Artificial Sequence
  Description of Artificial Sequence: Synthetic coding sequence
atggttgctgcagctgccgcaacagaggctcggctgcggcgacggaccgctgccaccgcagccctcgcgggaaggagcggaggccctcactgggactgggacgtgacccgcgcaggtcgccctggtcttggcgctggcttgcgactgccccgactgctgagtccccctctccggcctcgccttctcctacttcttttactcctcagtcccccactccttctcctcctgctgccatgcgaggcggaagccgctgctgccgctgcggctgtaagtggcagcgcagccgctgaggccaaagaatgtgacagaccctgtgtgaacggtggccgttgcaaccccggaacaggccagtgcgtgtgcccagctggatgggtgggagagcaatgtcaacattgcggcggtcgattccgactcactggcagttccggattcgtaaccgacggtcccggtaattataaatacaaaacaaaatgcacttggttaattgagggtcagccaaaccgtatcatgagattacgctttaaccattttgccaccgagtgtagctgggaccacctgtacgtgtatgatggggattccatctacgctccactggttgccgcattctccggtctcatcgtgcccgaaagggatggtaatgagactgtcccggaagtggttgcaaccagtgggtacgctctgctccactttttctccgacgctgcgtataacctgacaggatttaacatcacatattcatttgacatgtgccccaacaattgctctggtaggggagagtgtaaaatctctaacagctcagataccgtcgagtgcgaatgcagtgagaattggaaaggtgaggcttgcgacattccacactgtacggacaactgcgggtttcctcatcggggaatctgcaattcaagtgacgtgcggggatgctcatgcttcagcgattggcaagggcctggctgctctgtacccgtccccgctaatcagtctttttggacccgagaagaatatagcaacttgaagctgcctagagcctctcacaaggcagttgtcaacggaaatatcatgtgggtcgtgggtgggtatatgttcaatcactccgactacaacatggtgcttgcttatgatttggcctcccgtgagtggctgcccctgaatagaagtgttaataacgtcgtggtgcgctacggccatagtctagcactgtacaaagataaaatctacatgtacggaggcaagatagacagtactggaaacgtcaccaacgaactgcgcgtcttccacatacacaatgagtcatgggtgctcttgacccctaaggcaaaagagcagtacgcggtcgtaggccactcagctcatattgttaccctaaagaatgggagggtggtgatgcttgtgatctttggccactgtccactgtacgggtatatttccaatgtgcaagagtatgatctggataagaacacatggagcattctgcatacacagggagctttggtgcaaggcggttacggacactctagcgtgtatgaccaccgcacacgcgcactctacgttcacggaggctacaaggccttctctgcaaacaagtaccgacttgcggatgatctctaccggtacgacgtggacacacaaatgtggaccatccttaaggactcgagattcttccgctacctgcatacagcggtcatagtgtcagggacaatgctggtgtttgggggaaacacgcataatgacacctccatgagtcacggggctaagtgcttttcatccgactttatggcctacgatattgcctgtgatcgatggtcagtcctccccagacctgatctgcatcacgacgtgaaccggttcggacactccgctgtgttgcataatagtacaatgtacgtgtttggaggtttcaattccctgcttctcagcgacatcttggtgttcacctccgagcagtgtgacgctcaccggagcgaagctgcatgtcttgccgcaggtccaggtattcgatgtgtttggaacacagggtcctcacagtgcatttcctgggcactcgctaccgacgagcaagaggaaaaactgaaatcagaatgtttcagcaaacgcacattggatcatgacagatgtgaccaacacaccgattgctacagctgcaccgctaataccaacgactgccattggtgcaatgaccattgcgttccacggaaccattcatgcagcgaagggcagatttcaatcttcaggtatgagaattgtccaaaagacaatccaatgtattattgcaacaaaaagacatcctgccgctcttgtgctttggaccaaaactgtcagtgggagccccgtaatcaggaatgcattgctcttcccgagaacatctgtggaattggctggcacctggtggggaacagctgcctgaagatcacgactgcaaaagagaactacgacaacgcaaaactgttctgtaggaatcataatgctctcctcgctagcctaaccacgcagaagaaggtggagtttgtccttaagcagctgcgtattatgcagagtagccagtcaatgtcaaaactgacacttactccatgggtcggattgagaaagatcaatgtgtcttattggtgctgggaggatatgtccccctttacaaatagcctcttacagtggatgccttccgagccctcagacgctggcttttgcggcatattgtctgaaccatctacacgcggactgaaagcagccacttgcattaacccattgaatggcagtgtgtgcgaaaggcccgcaaaccatagcgcaaagcagtgtagaaccccctgcgccctcagaaccgcttgtggtgattgtacttccgggtcttctgaatgcatgtggtgttccaacatgaaacagtgtgtagatagcaacgcttacgtcgcctctttcccttttggtcagtgtatggagtggtacacgatgtctacttgcccaccagagaactgctctgggtattgcacttgttcgcattgtctggagcagccaggttgcggctggtgcaccgacccgtccaacaccgggaagggtaaatgtattgaagggtcttataagggcccagtgaaaatgccttctcaggcaccaactggtaatttttatccccagccattgttgaattccagcatgtgccttgaggactcgagatacaattggtcttttatccattgtcccgcttgccagtgtaacgggcactccaagtgtatcaaccaatcaatttgtgagaaatgcgagaacctaacaaccggcaagcattgtgaaacttgtatatccggcttctacggcgacccgacaaatggcggtaagtgtcagccctgcaaatgcaacgggcacgcctctctgtgtaacaccaatacaggtaagtgcttctgcactaccaagggcgttaagggggatgagtgtcagctgtgtgaggtggagaacaggtaccagggcaaccctctgcgtggaacatgctattacactctgttgatcgattatcagttcaccttttctctctcacaggaggacgataggtactacaccgccatcaactttgtagccacccctgatgaacagaatcgtgatctagacatgtttattaatgcctcaaagaatttcaacctaaacattacttgggccgcttcattctcggccggtacacaggcaggcgaggagatgccagtggtgagtaagacgaatatcaaggagtacaaggattccttcagtaatgagaaattcgactttaggaatcatcccaacatcacattctttgtttatgtcagcaacttcacttggcccattaagatccaggttcagactgagcagtag

SEQ ID NO: 4550 - DNA, 768 bp, Artificial Sequence
  Description of Artificial Sequence: Synthetic coding sequence
atgtttcaccaagtacgaagggtcatgaccatcttgtttcttactatggtcatttcttacttcgggtgcatgaaagccgcacccatgaaggaggctaatataagagggcaaggtggcctcgcataccccggagtgcgaacacacgggacgctggagtccgtcaacggtccaaaggccggaagtcggggactcaccagccttgccgatacgtttgagcacgtcatcgaggaactcctggatgaggatcagaaagttcgccctaacgaggagaacaacaaagacgcggatctctatacctccagagtgatgctcagctcacaagttcccctggagcccccattgttgtttttgttggaggaatacaaaaactatttagacgccgctaatatgtcaatgcgggtgagaaggcacagtgaccccgctaggaggggagagttgtcggtgtgtgattcgatttccgaatgggttactgcagcggacaaaaagacagccgtggatatgagcggcggaaccgtgactgtgcttgagaaggtccctgtatccaagggacagttgaagcagtacttctacgaaacaaagtgcaaccccatgggctacacaaaggagggttgtcgcggaatcgataaacgccactggaacagtcagtgcagaactacgcaatcctacgtgcgcgcactgacaatggacagtaaaaaacgtatcggctggcgtttcattcgaatagatacatcctgtgtgtgcaccctgacaattaaaagagggagatag

SEQ ID NO: 4551 - DNA, 744 bp, Artificial Sequence
  Description of Artificial Sequence: Synthetic coding sequence
atgactattctgtttttgactatggtgatatcatattttggctgcatgaaggccgcaccaatgaaggaagcaaatattaggggccaagggggactagcttatccaggagtgagaacccatggaacactggaatctgtgaatggaccgaaagctggatccagagggctgacatcactcgccgacacttttgagcacgtgatcgaagagttgctggacgaagaccagaaagtccggcctaacgaagaaaacaataaagacgctgacctgtacacttcccgtgttatgcttagcagtcaagtgcccttggaaccgcctttgctttttttgttggaagagtataaaaattatcttgacgccgctaatatgtccatgcgggtccgcagacacagcgacccggcacgtaggggcgaattaagcgtgtgcgattcaattagtgagtgggtgacggctgccgataaaaagaccgctgttgacatgtcaggaggcaccgtcactgtactagaaaaagtccccgtctcaaaggggcaacttaagcaatatttctatgagaccaagtgcaatccaatgggctacaccaaggaggggtgtagaggcattgataaaaggcattggaatagtcagtgtcggacaacacaatcttacgtgcgggctttaactatggacagtaagaaaagaatcggttggagatttattagaatcgacaccagctgcgtgtgcacactcactattaagcgcggtaggtag

SEQ ID NO: 4552 - DNA, 744 bp, Artificial Sequence
  Description of Artificial Sequence: Synthetic coding sequence
atgactatcctctttttaacaatggtgatttcctactttgggtgtatgaaggccgcaccaatgaaagaggctaatatcagagggcaaggaggcctggcctaccccggagtgcgaactcatggcaccttagaatctgtgaacgggcctaaggccggttccagaggcttgacatccctggcagacacatttgagcatgtgattgaggaacttctggatgaagaccaaaaagttcgaccaaacgaggagaacaacaaggacgctgatctctacacttctcgagtgatgctgtcctcacaggtccctctggagcctccgctcctgtttctgcttgaggaatataagaattatctggacgccgcaaacatgtccatgcgtgtcagacgacatagcgatcctgcacgacgtggggaactctcagtctgcgacagtattagtgagtgggtgactgctgctgacaaaaagacggctgtggatatgagtggaggaacagtcacggtgctcgagaaagtgcctgttagtaagggacagttaaaacaatacttttacgaaaccaagtgcaaccctatggggtatacaaaagaagggtgtagaggaatcgataaacgccactggaacagccaatgccgtactactcagtcttatgttcgggcactaaccatggactcaaagaaaagaataggctggcggtttattaggatagacacaagttgcgtgtgtaccctcaccatcaaaagaggcaggtag

SEQ ID NO: 4553 - DNA, 744 bp, Artificial Sequence
  Description of Artificial Sequence: Synthetic coding sequence
atgacgatattattcctcactatggtgattagttacttcggttgcatgaaggcagctcctatgaaagaggcaaatattaggggtcaaggcggattggcctacccaggggtccggacccatggaaccctggagtccgtgaacggcccaaaggctggctcaaggggactgacgtccctggctgacacgttcgaacacgtaatagaggaactgctggatgaggatcagaaggtacggccaaatgaggagaataataaggacgccgacctgtacacttcccgggtgatgttgtcttctcaagtgcctctggagccaccgctgttgtttctgctggaggagtacaagaattacctggatgcagcaaacatgtccatgcgggtgcggaggcactcagatcccgctcgcaggggtgagttgtccgtatgcgattcaattagtgagtgggtgaccgctgccgacaagaagactgctgtggacatgagcgggggtacggtgactgtgctggagaaggtgccagtgagcaagggacagctcaaacagtacttctatgagacgaaatgcaatccaatgggatataccaaggagggctgtcgcggtatagacaagcggcattggaacagccagtgccggaccacacagtcgtacgtcagggctctgaccatggacagtaaaaagcgtattggatggaggttcattaggattgacacatcatgtgtgtgcaccttaaccatcaagcgcggaagatag

SEQ ID NO: 4554 - DNA, 744 bp, Artificial Sequence
  Description of Artificial Sequence: Synthetic coding sequence
atgactattcttttcctgacgatggtcatatcttattttgggtgtatgaaggccgctccaatgaaggaagccaacatccggggtcaggggggtctggcataccctggtgtcagaacccatggtactctagagtcagtgaacgggcctaaagcagggtctcgcggactcacttcccttgccgacacgttcgaacacgtcattgaggagctcctagacgaggaccagaaagtccgcccaaacgaggaaaacaacaaggacgcggatctgtatacctcccgggtaatgctatcgagccaggttccactagagccgcctttactcttcctgctcgaagagtacaagaattatctcgacgccgcaaacatgtccatgcgcgtgcggagacattcagaccctgctaggcgcggagagctgagtgtctgcgacagcatctccgaatgggttaccgcagctgacaagaagactgccgttgacatgagtggcggaactgtaaccgttctggagaaagtcccagtgtccaaaggacaactaaagcagtacttctatgaaaccaagtgtaatccaatgggctacaccaaggagggatgtagaggcattgataaacgacactggaactcccagtgtagaacaactcagtcatacgtgcgcgctctgacaatggacagcaaaaagcggatcggatggagattcattcggatcgacacctcatgcgtgtgcactcttaccatcaaaagggggcgatag

SEQ ID NO: 4555 - DNA, 744 bp, Artificial Sequence
  Description of Artificial Sequence: Synthetic coding sequence
atgacgatactgtttttgacgatggtgatcagttacttcggctgcatgaaggccgcaccaatgaaagaggctaacattcgcggtcagggaggactcgcatatccaggagtgaggactcacggaaccctcgaatctgtgaacggccctaaggctgggtcccgcggactgactagcctggccgacacctttgagcacgtgatcgaggaactcctggacgaggatcagaaagtgaggccgaatgaagaaaacaacaaggatgccgatctttacacatcccgggtcatgctctcgtcccaggtccctttagaacccccactacttttcctccttgaggagtacaaaaattaccttgacgcagctaacatgtcaatgagagtgagaagacacagcgatccggctagaaggggggagctttcagtctgcgactccataagcgagtgggtaactgcagctgacaaaaagaccgccgtggatatgtcaggaggcacggtgactgttctcgaaaaggtcccggtgagtaagggtcagctcaagcaatacttttacgagaccaaatgcaatcccatgggatatactaaggaaggatgccgtgggattgataaaagacattggaattcccagtgtaggacaactcagagctacgtccgggctctgaccatggacagcaagaaaagaattgggtggcggttcattaggattgacacttcgtgtgtctgcacgctgaccattaagcgaggacgctag

SEQ ID NO: 4556 - DNA, 789 bp, Artificial Sequence
  Description of Artificial Sequence: Synthetic coding sequence
atgcaatctcgggaagaggagtggttccatcaagttaggagggtcatgaccatcctgtttctcaccatggttatatcgtattttggttgcatgaaagcagcacccatgaaagaagccaacattcgtggccagggcggactggcctatcccggagtcagaacacatggtacactggagagtgtaaatggacccaaggcgggatcaagaggcctgacttcattagctgacactttcgaacacgtgatcgaagaactgttggacgaagaccaaaaggtgcgacccaatgaagagaacaacaaggacgccgatctgtacacatctagggttatgctcagctcccaagtccctctcgaaccacctctcttgtttctcctcgaagagtataagaattacctggatgctgctaatatgagcatgcgggttaggcggcactctgatcccgctcgtcgcggtgaactctctgtctgtgactcaatttctgaatgggtgactgccgctgataaaaaaacggctgtagatatgtctgggggtactgttacagtcctagagaaggtcccggtaagtaagggtcagcttaagcagtatttttatgaaacaaagtgcaatcctatgggctatacaaaagaggggtgccgtggaatcgataaacgacactggaactcacagtgtagaactacccagtcttacgtgagagcccttactatggactccaaaaagcgtatcggctggcgcttcattagaattgacacctcctgcgtgtgtacattaaccataaagaggggtaggtag

SEQ ID NO: 4557 - DNA, 744 bp, Artificial Sequence
  Description of Artificial Sequence: Synthetic coding sequence
atgaccatcctcttcctgacaatggttatttcttactttggttgcatgaaggctgctcccatgaaggaggccaacatcagggggcaagggggactggcataccccggagtaagaacacacggcacactggaatccgtcaacgggccaaaagccggttcacgaggactcacatcactggcggacactttcgagcacgtcatagaagaactactagacgaggaccaaaaggtaaggcctaacgaggaaaacaacaaagatgccgatctgtacacttcccgcgtgatgttgtcttctcaggtccccctggagccaccactgttgtttttgctggaagagtacaaaaactatttggacgccgcaaatatgagcatgcgcgtgagaaggcactcagatccagcgaggaggggcgagcttagcgtctgcgacagcattagcgagtgggtaaccgccgctgataagaagaccgcagtggacatgtcaggaggaaccgttaccgtacttgagaaagtgccagtaagtaagggacaattaaaacagtacttctacgagaccaagtgtaaccctatgggatataccaaggaaggctgtagaggcatcgataagaggcattggaatagtcaatgtagaaccacccagtcatatgtgcgtgcactgactatggactccaagaaacggatcggctggcgattcattcgcatagacacgtcctgtgtttgtaccctgaccatcaagaggggcaggtag

SEQ ID NO: 4558 - DNA, 744 bp, Artificial Sequence
  Description of Artificial Sequence: Synthetic coding sequence
atgacgatcctgtttttgaccatggtcatctcctatttcggatgcatgaaggcagctccaatgaaagaggcaaacattcggggtcagggtgggttagcttaccccggagtgaggacacacggaactcttgaaagtgttaacggcccaaaagccggatcacggggactcacttcactggcagacactttcgaacacgtgatcgaggaactgttagatgaagaccaaaaggtgcggcctaatgaagaaaacaataaggatgctgatctgtacacctccagggtgatgctatccagccaggtccccctggaacctcctctgctttttttgcttgaggagtacaaaaactacctcgacgccgctaacatgagtatgcgagtccgcaggcacagcgaccccgctcggagaggagaactgtctgtgtgcgactcaatatccgaatgggtcacagccgcagataagaagacagcagtggatatgtccggaggcaccgtgacagtgctcgagaaagtcccagttagtaaggggcaactcaaacagtacttctatgaaactaaatgcaatcccatggggtatacgaaggaaggctgtaggggcatcgacaaacgacattggaactcccagtgtcggaccactcaaagctatgtgcgcgctctgaccatggacagcaagaaaaggatcggttggaggttcattaggatagatacctcctgcgtatgtaccctgacaattaagcggggaaggtag

SEQ ID NO: 4559 - DNA, 990 bp, Artificial Sequence
  Description of Artificial Sequence: Synthetic coding sequence
atgtgcggagctacgagctttctccatgagtgcacacgactgatcctagtcaccacccaaaatgcagaattccttcagaaagggctgcaggttcacacatgcttcggagtgtacccacatgcctccgtgtggcatgattgcgcgtcccaaaagaagggctgtgccgtctacctgcatgtttcggtggagttcaacaagctcataccagaaaatgggttcatcaagtttcaccaggtgaggagggtcatgacaattcttttcttgacaatggtgatctcgtacttcgggtgcatgaaggctgctccaatgaaagaggcaaatatccggggtcaagggggacttgcctaccccggagtgcgcacccatggtacacttgaaagtgttaatggccctaaagccggaagcagggggttgacctcgctagccgacacgttcgagcatgtgatagaggaacttctggacgaggatcagaaagtgcgtcccaacgaagaaaataataaagacgccgatctgtatacttctcgcgtgatgctgtcttcccaggtccccctggaacccccactgctgtttctgctcgaagagtataaaaactacctcgacgccgcaaatatgtcaatgcgggtgcgacggcactcagatcccgcaaggagaggcgaactgtccgtgtgcgatagtatctcagaatgggtaacagccgctgataagaagaccgccgtagacatgtccggcggtaccgtcaccgtgctcgagaaagtccctgtcagtaaaggtcagcttaaacaatacttttacgagacaaagtgcaatcctatggggtacacgaaggagggatgccgcggaattgacaaacggcactggaacagccagtgtcggacaacccaaagttacgttcgtgctcttaccatggacagcaagaaaagaataggttggagatttatccgaatcgacactagctgtgtgtgtacactcaccattaagcgcggtcgatag

SEQ ID NO: 4560 - DNA, 744 bp, Artificial Sequence
  Description of Artificial Sequence: Synthetic coding sequence
atgactatcctctttctaacaatggtgattagctatttcggctgtatgaaagcagcgccaatgaaggaagccaatatcagagggcagggaggccttgcttatcctggagtgagaacgcatggaacactggagtctgtcaacggcccaaaagccggatcaagggggcttacctctctggcggacacctttgaacacgtgatcgaagaactgttagacgaggaccagaaagtccgccctaacgaagagaataacaaagacgcagatctgtacacaagtagagtcatgctttcatcacaggttccgctggagccccctttgctcttcctccttgaggagtataaaaactacctcgatgctgccaatatgtcaatgcgagtccggagacatagcgatccagctagacgaggggaactctcagtctgcgattccatttctgagtgggtcacagcagccgacaagaagacggccgtagatatgtcagggggaactgtgactgtacttgaaaaagtcccagtgagtaaggggcaacttaagcagtacttctacgaaacgaaatgtaatcccatgggctataccaaagaagggtgccggggtattgataaaaggcactggaattctcagtgtaggactacccaatcatatgtccgcgcactaaccatggatagtaagaagcgtatcggctggcgtttcatccggatagacacatcttgtgtatgtactctcaccattaagagaggtcggtag

SEQ ID NO: 4561 - DNA, 744 bp, Artificial Sequence
  Description of Artificial Sequence: Synthetic coding sequence
atgaccattttgtttctcacgatggttattagctacttcggatgcatgaaagccgctccgatgaaggaagccaatattcgcggtcaaggaggtctcgcttatcccggagttagaacgcacggcaccctggaaagcgtgaacggacctaaggccggatcacgagggctgacttctctcgcggatacattcgagcacgtaatcgaggaactactggacgaggaccagaaggtgcgacctaacgaagagaataataaggatgcagatctgtataccagtagagtcatgctttcatcccaggtgcctttggagcctccattactgttcttattggaggaatacaagaactacttggatgcagcaaacatgtctatgagagtgagaagacactccgaccctgccaggcgaggggagctgtccgtctgcgattccatttctgaatgggtgactgccgctgacaaaaagaccgctgtggatatgtctggaggaaccgtgactgtgctggaaaaagtgccagtatccaagggacagcttaaacagtatttttacgagacaaaatgtaatcctatggggtatacgaaagaggggtgtcggggaatagacaagaggcattggaactcccagtgccggactactcagtcttatgttagagctctcacaatggactcaaagaagcggattggatggcgctttatcaggattgacacctcttgcgtttgcactttaactattaagaggggaagatag

SEQ ID NO: 4562 - DNA, 744 bp, Artificial Sequence
  Description of Artificial Sequence: Synthetic coding sequence
atgaccattctgtttcttaccatggtcatctcctactttgggtgtatgaaggccgcacccatgaaagaagctaacataaggggccaagggggtcttgcatacccaggggtgcgtacacacggtacccttgagtctgtcaacggacctaaagctggcagcagggggctgactagccttgccgatacgtttgagcacgtgatcgaagagttactggacgaggaccagaaagtgaggcccaacgaggagaataacaaggacgcggatctgtacacctctagggtgatgctctctagccaggtgcccctcgagcctccactgctgttcctgctggaggagtataagaattacttagacgccgctaacatgagtatgagggtccgccgacactccgaccccgcacggcgaggggaactctcagtctgcgacagtatcagcgagtgggttactgctgctgacaaaaagacagccgtcgatatgagcggtggcactgtgactgtgctggaaaaggtacccgtaagcaagggccaactgaagcagtacttctacgagactaagtgcaatcccatgggctacactaaagagggctgtagaggcatcgacaaacggcactggaacagccagtgcagaactacacagtcctatgtgagagcactaacaatggattctaaaaagcggatcggttggaggttcataagaatcgacacatcctgcgtgtgtacactcaccattaaacggggacgttag

SEQ ID NO: 4563 - DNA, 744 bp, Artificial Sequence
  Description of Artificial Sequence: Synthetic coding sequence
atgactatactgtttctgacaatggttattagttatttcggctgcatgaaagctgcaccaatgaaggaggccaacatccggggacaaggaggactcgcctaccctggcgtgcgcacacatggcaccctcgagtctgtgaatggcccaaaagccggtagtcgcggacttacctctttggctgatacatttgagcatgtcattgaggaattgttagacgaggaccagaaagttcgcccaaatgaagagaataacaaggatgccgacttgtacacatctcgcgttatgctttcctcgcaggtgccactggagcccccactactgtttttactggaagaatacaagaattacttggacgcggctaatatgtctatgcgcgtacgacggcactcagaccccgctcgcaggggtgaactttcggtgtgcgatagcatttccgaatgggtgacggcggcagacaagaagactgcagtggacatgtctggagggactgtaactgtgctcgaaaaggtgcctgtgtccaagggccaactgaagcagtatttttacgaaactaagtgtaatcctatgggatatacaaaggagggatgcagaggtattgataagagacactggaacagccagtgtaggaccacccagagttacgtgcgggcactgacgatggatagcaagaagaggatcggatggcgcttcattcggatcgatacaagctgtgtgtgcacattaaccattaagcgcggtcgttag

SEQ ID NO: 4564 - DNA, 744 bp, Artificial Sequence
  Description of Artificial Sequence: Synthetic coding sequence
atgaccattctctttctgactatggttatcagctatttcgggtgtatgaaggccgcacctatgaaggaggcgaacattcgtgggcaaggtgggctcgcatacccaggtgtccgcactcacggtaccctggagagcgtgaatggaccaaaggctgggagtagggggctgacatccctggctgacacattcgagcatgtcatcgaggagctcctggacgaagatcagaaggttaggcccaacgaggaaaataataaggatgctgatttgtatacctctcgggttatgttatcttcccaggtgccactggagcccccactgttgtttctgctggaggagtataagaactacctcgacgctgcgaacatgagtatgcgggttcgacgacactccgatccagcacggagaggcgagctgtccgtgtgtgattccatctcagagtgggtcacagccgctgataagaaaaccgccgtcgacatgtctgggggaactgtgacagttctggaaaaagtgcccgtcagcaagggacagctgaagcagtatttctacgaaacgaagtgtaacccaatggggtacaccaaagagggctgcagaggcattgacaagaggcattggaattcacagtgtaggaccacccaatcctacgtcagagctctcaccatggactctaaaaaaagaatcggctggcgtttcatccgcattgacaccagctgtgtgtgtactttaactatcaaacgcggacgttag

SEQ ID NO: 4565 - DNA, 744 bp, Artificial Sequence
  Description of Artificial Sequence: Synthetic coding sequence
atgacaattctcttcctgaccatggtgattagctactttggctgtatgaaggcagccccaatgaaggaggcaaatattcggggacagggaggtctcgcctatccaggcgttcgtacccacggcacattggagtccgtaaatggtcccaaagctggttcacgcggacttacttcactcgccgacactttcgaacacgtcatcgaagaactgctcgacgaggaccagaaagttaggcctaacgaggagaacaataaagatgcggatctttacacctcaagagtgatgttgtcaagccaggttcccctagaacctccgctgctgttcctgctcgaggagtataaaaactacttggacgcggctaacatgagcatgagagtgcggaggcactcagaccccgctagacgcggtgagttaagtgtctgtgactcaattagtgaatgggtaacagccgcagacaagaagactgctgttgatatgtctggaggcaccgtaacagttctcgaaaaagtccctgtctccaaggggcaacttaaacagtatttctacgagacgaagtgtaaccccatggggtatacgaaagagggctgcagagggatcgacaagcgccactggaatagtcagtgcaggactacacagtcctacgttagagctctcacgatggattctaaaaagagaatcggctggaggttcatccgcatcgatacctcatgcgtctgcacgctcactattaagaggggccgttag

SEQ ID NO: 4566 - DNA, 744 bp, Artificial Sequence
  Description of Artificial Sequence: Synthetic coding sequence
atgacaatcctttttctcaccatggtgatctcgtactttgggtgcatgaaggccgcaccaatgaaggaggctaatataagaggacaagggggattggcgtacccgggtgtcagaacacatggcactctcgaatcagtgaatgggcctaaggcgggttcaagggggctgacctctctggcagacacctttgagcatgtgatcgaggagttgctcgatgaagatcagaaggtcaggcccaacgaagagaataataaggacgccgacctatacaccagccgcgtgatgttgagttctcaggtacccctggaaccacctctgctcttcctgctcgaggaatataagaactaccttgacgctgccaacatgtccatgagggtgcgacgccacagcgatccggcaagacgcggagagctatccgtctgtgacagcatatcagagtgggtgacagccgcagataaaaagacagccgtggacatgtcaggagggacggtcacagttctggaaaaagttcctgtgtctaagggccagctcaagcagtacttctacgaaaccaagtgtaatccaatggggtatactaaggagggttgtaggggcatagataaacgccactggaatagtcagtgccgaacaacccagagttacgtgcgagcactcactatggactccaaaaaacggatcggttggcgcttcatccggatcgatacctcttgcgtctgtaccttaacaattaaacgtggacggtag

SEQ ID NO: 4567 - DNA, 234 bp, Artificial Sequence
  Description of Artificial Sequence: Synthetic coding sequence
atgtgtggcgctacctcctttctgcatgagtgcacccggctcatactggtgacaacccagaacgccgaattcctgcaaaaggggttacaggttcacacgtgctttggcgtgtacccacacgcttccgtgtggcatgactgtgcatcacagaaaaagggttgcgcggtttaccttcacgtgtcggttgagttcaataagctcattcctgaaaatggcttcatcaagggctggtag

SEQ ID NO: 4568 - DNA, 894 bp, Artificial Sequence
  Description of Artificial Sequence: Synthetic coding sequence
atgtccagtgcccattttaatcgtggcccagcctacgggcttagtgcagaggtgaagaacaagttagcacagaaatacgatcatcagagagagcaggagcttagggagtggatagagggcgttactggccgacgtattggaaataacttcatggacgggttgaaggacgggattatactgtgcgaatttatcaataagctgcagccaggctctgtaaagaaaattaacgagtctacccagaattggcaccaactcgagaacattggaaattttatcaaggctatcacgaagtacggggtgaagccgcacgatatcttcgaggctaacgacttgttcgagaatacaaaccatactcaagtgcagtccaccctgcttgccctcgctagtatggcaaaaactaaaggaaacaaggttaatgtaggggtcaagtatgcagagaagcaggagcggaaatttgaaccaggcaaactccgggaggggagaaatattattggtcttcagatgggcactaacaagttcgcatcacagcagggcatgaccgcttatggaactcgcaggcacctgtacgaccctaagctgggcacggaccagccattggaccaggccacaatcagcctgcagatggggactaataagggagcctcccaggccggaatgaccgctcccggtactaaaaggcagattttcgaaccaggtctggggatggagcactgtgatactctcaacgtttccctccaaatggggtctaataagggagcatcacaacgcggaatgacggtgtatgggctccccagacaagtgtatgaccctaaatattgtttgacacccgagtacccagagctgggagaaccagcacacaaccatcacgcgcataactactataactccgcttag

SEQ ID NO: 4569 - DNA, 744 bp, Artificial Sequence
  Description of Artificial Sequence: Synthetic coding sequence
atggacggactgaaagatggaattatcctgtgtgagttcatcaacaagctgcagcctgggtccgtaaaaaagatcaatgagtccacgcagaattggcatcagctcgaaaatattgggaacttcattaaggccattacaaagtacggagttaagccacacgacattttcgaagcgaacgatctgtttgagaatactaaccacacccaagttcagtctacgctgttggctcttgccagcatggccaagacaaaaggaaataaggtgaacgttggggttaaatatgctgaaaagcaggagagaaaatttgagcctggaaagctaagggagggcagaaacatcatcgggctgcagatggggaccaataaattcgcatcccagcaggggatgacggcgtacggtacacggaggcacctttatgatccaaaattgggcactgatcagcccttagaccaggccacaattagtttgcagatgggtacaaacaaaggggcaagtcaggccggaatgaccgcccctggcacaaagaggcaaattttcgagcccggtctgggcatggagcactgtgacaccctcaatgtgtcgttgcagatggggtcaaacaagggcgcatcacagcggggtatgacagtgtacggactgccacggcaggtgtacgatcccaagtattgtttaacacccgaataccctgaactgggcgaacccgcacataatcaccacgcccataactattacaacagcgcctag

SEQ ID NO: 4570 - DNA, 834 bp, Artificial Sequence
  Description of Artificial Sequence: Synthetic coding sequence
atgctcgctcagaaatatgatcaccagagagaacaggagttgagggagtggatcgaaggagtgaccggcaggcggattggcaacaatttcatggacgggctcaaagatggtatcatcctatgtgagtttatcaacaagctccagcccggatccgtaaaaaaaatcaacgagagtacgcaaaactggcatcaactggagaacattggtaattttataaaagccattacaaagtacggagtcaagccccacgacatttttgaagctaacgacttgtttgagaataccaatcatactcaggtgcagtccacactgcttgctctggcttccatggctaaaactaaggggaacaaggtcaacgtcggggtcaagtatgctgagaagcaggagcggaagtttgaacctgggaagctacgcgaggggagaaatatcattggcttgcaaatgggcaccaacaagttcgcttcccagcagggcatgacagcatatgggacaagacgccacctgtatgaccctaagctaggaaccgaccagcctctcgatcaggccaccattagtctccagatgggaacaaacaaaggagcatcccaggcgggaatgaccgcccctggtacaaagcgtcagatcttcgagcctggactgggtatggaacactgcgacacccttaatgtttccctccagatgggctcaaataagggcgcttctcaacgaggcatgaccgtttacggtctacctagacaggtatacgacccaaagtactgtctaactccagagtaccctgaactcggagagcctgctcataatcaccatgctcacaattactataatagtgcctag

SEQ ID NO: 4571 - DNA, 930 bp, Artificial Sequence
  Description of Artificial Sequence: Synthetic coding sequence
atgtctagcacccaatttaacaaaggaccatcttatggcctatctgcagaagtgaaaaatcgcctgctctcaaaatacgacccacaaaaggaagcggagttgcgcacgtggatcgaggggcttacgggactgtcaattggtccggactttcaaaaggggttaaaggacggtaccatactgtgtaccctcatgaataaattgcagcctggcagtgtacctaaaataaataggagtatgcagaattggcatcagctggagaacttgtcaaactttattaaggcaatggtatcctacgggatgaatcccgtggatctgtttgaagctaacgacttgttcgagagcggcaacatgacccaggtgcaggtctctctgctagctctggccggaaaagcaaagaccaagggtctgcagtccggcgttgacatcggcgtcaaatatagcgaaaagcaggagagaaactttgatgatgccaccatgaaagctggacagtgtgtgatcggtttacagatggggaccaataaatgcgcctcacagtctggcatgacagcatacggcacccggaggcatctttatgaccccaagaaccacatactgcccccaatggatcactcgactattagtctccagatggggacgaacaaatgtgcctctcaggtggggatgaccgccccagggacccgccgacacatatacgacacgaagctgggtaccgataaatgcgataatagctctatgtctttgcagatgggctacactcaaggcgctaaccagtctggacaggtctttggtctggggcgtcagatctacgatccaaaatactgtccacaggggaccgttgccgatggggctcctagtgggacaggggactgtcctgatcctggggaagtgcctgagtatcctccatattaccaggaggaagccggatattag

SEQ ID NO: 4572 - DNA, 813 bp, Artificial Sequence
  Description of Artificial Sequence: Synthetic coding sequence
atgtcctcgacccagttcaacaagggccctagctatgggttgtcagcagaggttaaaaaccggctcctctctaagtatgacccccaaaaagaagcggagcttcgcacctggatcgaaggcttgactgggctttcaataggcccagatttccagaaaggactcaaggacgggacaattctctgcaccttaatgaataagctgcagcccggttcagtgccaaagataaacaggagtatgcaaaactggcatcaactggaaaatctcagtaatttcattaaagccatggtctcctacgggatgaaccctgttgacttattcgaagcaaatgacctcttcgagtcagggaatatgactcaggtccaggtctcactactggctctggctggtaagatgggtacgaacaaatgtgcatctcagagtggtatgactgcttatggcactcgaagacatctctatgaccctaagaaccatattctgccgcctatggatcactctactatctctctccagatgggcaccaataaatgtgcttctcaggtggggatgaccgcgccagggactagaagacatatctatgacactaaattgggaaccgacaagtgtgacaattcgtctatgagtctccaaatgggatatacgcagggcgctaaccagtctggacaggtctttggactcggtaggcagatctacgaccccaaatactgtccgcaggggaccgtggcggacggagcgcctagcggcaccggcgactgccctgacccgggtgaagtgcctgaatatcctccatattaccaagaggaggcagggtattag

SEQ ID NO: 4573 - DNA, 867 bp, Artificial Sequence
  Description of Artificial Sequence: Synthetic coding sequence
atgtctagcactcagtttaacaaggggccatcatatggtctgagcgctgaagtgaagaaccgcctgctttccaagtacgatccacagaagaaaggactgaaggacgggacaattctgtgcaccctgatgaataagcttcaacccggatccgttcctaaaatcaatagaagtatgcagaactggcatcagctggaaaacctgagcaatttcattaaggctatggtgagttacgggatgaaccccgtggacctgttcgaagctaatgatctgtttgagtctgggaatatgacccaggtgcaggtgtcactgttagcactggcaggaaaggccaagaccaagggactgcagagcggggtcgatatcggagtgaaatattctgagaaacaggaacgcaatttcgacgatgccactatgaaagccggacagtgtgtgatcggactgcagatggggacaaataagtgcgcttcacagtccgggatgaccgcttacggcacccgcagacatctgtacgacccaaaaaatcacattctgcctccaatggaccactctaccatttccctgcagatggggacgaataagtgcgcttctcaggtcggcatgaccgcacctggcacccgacgccacatctacgataccaagttaggcaccgacaagtgcgacaacagtagcatgagtcttcagatgggatatacccagggtgcaaaccagtcaggccaggtgttcggtctgggacggcagatctatgacccaaagtactgtccccagggaacggtggcagacggcgctccttctggaacaggagactgcccggaccctggggaagttcccgaataccccccatactaccaggaagaggccggttattag

SEQ ID NO: 4574 - DNA, 990 bp, Artificial Sequence
  Description of Artificial Sequence: Synthetic coding sequence
atgactcattttaacaaaggcccaagttatggactgagcgccgaagttaaaaacaagatagctagtaagtatgatcaccaagccgaagaggatctcaggaattggattgaggaagtcactgggatgagtattggacccaacttccaactgggcctcaaagacggaattattctatgtgaattaatcaacaagctccagcccggatccgtgaagaaggtgaatgagagcagcctgaattggcctcagttagaaaatatcgggaattttattaaggctatacaggcttacggcatgaaaccccacgacatatttgaagcgaatgatctgttcgagaacggtaatatgacccaggtccaaacaactttggtggccctggccggactggcaaagacgaagggcttccacaccacaattgacattggggtcaaatacgccgagaaacaaactagacgattcgatgagggaaaactcaaggctggccaatcagtgattggtctgcagatgggaactaacaagtgtgcctctcaggcaggaatgacagcgtatggcaccaggagacatctgtatgatccaaagatgcaaaccgacaaacccttcgatcagacgacaattagtctgcagatgggaactaacaagggtgccagccaggctgggatgttggctccagggacacgcagagatatttacgaccagaaactgactctgcagcccgtcgataattccaccattagccttcagatgggcactaataaagtcgccagtcagaagggtatgtcagtctacggcctgggcaggcaagtttacgatccgaagtactgcgcagcccctacagagcctgttattcacaatggaagccagggtactgggacgaatggctctgaaatcagcgatagtgattatcaggccgagtaccctgacgaataccacggagagtatcaggacgattatcctcgtgactatcagtatagcgaccagggcatcgattactag

SEQ ID NO: 4575 - DNA, 852 bp, Artificial Sequence
  Description of Artificial Sequence: Synthetic coding sequence
atgactcatttcaacaaagggccaagttatggcctgtcagcagaggtcaagaacaagatcgcctcaaagtacgaccaccaagccgaggaagatctgcggaattggatcgaggaagtgaccggtatgtctattggacctaatttccaactcggtctaaaggacggaattatcctgtgcgaactgatcaacaaactccagcccggaagcgtcaagaaggtcaatgagtcttctctaaactggcctcaagcaaagaccaaagggtttcacaccacaattgatattggggtgaagtatgcagagaagcagacgagacggtttgatgaagggaagctgaaggctggacaaagtgtaatagggctccaaatgggtacgaacaaatgtgctagtcaggccggaatgactgcttacgggactcgtcgccatctctacgatccaaagatgcagactgataagcctttcgaccagaccactatcagcttgcagatggggaccaataaaggcgctagccaggcagggatgctggcgccaggcaccagaagagatatctacgatcagaaactgaccctgcagcctgtggacaattcgaccatatctctgcagatggggacaaacaaagtggcctcacagaagggaatgtcagtctacggtctaggcaggcaggtctacgatcctaaatattgcgccgcacctacggagcccgtcatacacaatggctcgcagggaacaggcaccaatggtagtgaaatctcggattccgactaccaagcggaatatcctgacgagtatcacggggaataccaggacgactacccacgggattatcagtattccgaccagggaatcgactactag

SEQ ID NO: 4576 - DNA, 558 bp, Artificial Sequence
  Description of Artificial Sequence: Synthetic coding sequence
atgtcaattggccctaattttcaacttgggctgaaggatggtattatcctctgcgagttaatcaataagttgcagcctggttctgtcaagaaagtgaatgaaagctccttgaactggcctcagctggaaaacattggaaattttattaaagcaatccaggcttatgggatgaagccccatgatatcttcgaggccaacgacctgtttgaaaatgggaacatgacccaagtacagactaccttagtagctcttgcaggcctcgcgaagaccaaaggttttcacaccacaattgacattggggtcaaatatgccgagaagcagacccgaagatttgacgagggaaagttgaaggccggtcagtcagtgatcggcttgcagatgggtaccaataagtgcgcaagtcaagccggaatgacggcgtacggcacacggaggcacctctatgacccaaaaatgcagactgataagccattcgatcagactaccattagtctgcaaatgggcacaaacaaaggcgcttcacaggccggtatgctggcaccagggacccggaggtag

SEQ ID NO: 4577 - DNA, 990 bp, Artificial Sequence
  Description of Artificial Sequence: Synthetic coding sequence
atgacccattttaacaaggggcctagctacggcctgagcgccgaagttaagaacaagatagccagtaagtatgatcaccaagctgaagaggacctgaggaactggatcgaagaggtgacggggatgtcaatcgggccaaattttcagctcggacttaaggacgggatcatactctgcgagctcattaacaagctgcagcctgggtcagtgaagaaggtgaatgaatcatcattgaactggccccaactggagaatatcggcaactttatcaaggctatccaagcttacgggatgaagccacacgacattttcgaggccaacgacctgttcgagaacggtaatatgactcaggtgcagacgaccctcgttgccttggccggactggcgaagacaaaaggcttccacacaacaattgatattggcgtgaaatacgccgaaaagcagacaagaagatttgacgaggggaagctgaaggctgggcagagcgtcatcggcctccagatgggaactaataagtgtgcctcccaggccggaatgaccgcctatggcacccgccgacatctgtatgatcccaaaatgcaaaccgacaaaccctttgaccagactacaatctcactgcagatgggtaccaataaaggcgcatcacaggcaggtatgctggcacccggtactaggagggatatctacgatcagaagctgactcttcagcctgtcgacaacagcactattagcctacaaatgggcactaataaggtggcctcacagaaaggcatgtccgtatacggattgggccgacaggtgtacgatccgaagtattgcgcggcaccgaccgagcctgtgattcataacggcagtcagggaactggaacaaacggaagcgaaattagtgatagtgactaccaggctgaatatccagatgagtatcacggcgaatatcaggacgactacccaagagattatcagtattccgaccagggtatcgactattag

SEQ ID NO: 4578 - DNA, 867 bp, Artificial Sequence
  Description of Artificial Sequence: Synthetic coding sequence
atgagtatcggacccaattttcagctcgggctgaaggacggcatcatcctgtgcgaactcataaataagctccagcctggctccgttaagaaagtgaacgagagttccctgaactggcctcagctggaaaacatcggaaactttataaaggccatccaggcctatggcatgaagcctcacgatattttcgaggccaacgatctgttcgagaacggaaacatgacgcaggtgcagacgacccttgtggcgctggctggactggccaaaaccaagggcttccacaccaccattgatataggggtgaagtacgccgaaaaacagaccagaagatttgatgaggggaaactcaaagccggacagtccgtcatcgggctgcagatggggaccaataagtgtgccagccaggccggtatgactgcttacgggacacgtcgtcacctgtatgaccccaagatgcagaccgataagccttttgatcagactaccatctctctgcagatgggcaccaataagggcgctagtcaggcagggatgctagcccctggaacacgacgggatatatacgatcagaagcttacactgcagcccgtagacaattccaccatatccctccagatggggaccaataaggtcgcaagccagaaggggatgtccgtgtatggcttgggcagacaagtctacgatccaaagtactgcgccgcacctacggaacccgtgattcacaacggaagtcaggggacaggcacaaatgggagcgagataagcgactccgattaccaagctgagtatcccgatgagtatcatggagaataccaggatgattatccgagggattatcagtactctgatcaggggatagattattag

SEQ ID NO: 4579 - DNA, 2223 bp, Artificial Sequence
  Description of Artificial Sequence: Synthetic coding sequence
atgggcgaactgtgtaggcgggatagtgccctgacagctctcgacgaggaaaccttgtgggaaatgatggagagtcatcgtcatcgcattgttaggtgcatttgtccaagcaggcttaccccctatttgaggcaggccaaggttttgtgccagctagacgaagaggaagtgctgcactccccgcgactcaccaactccgccatgagggcagggcatctgctggacctgctcaagacgcgcggtaagaatggtgccatcgccttcctcgagagtctgaaattccataacccggacgtgtacacactcgtcaccggattgcaaccagatgtggatttcagcaatttctctggcctgatggaaacctctaagctgacagagtgtctggctggcgctattggaagtctccaggaggagttgaatcaggaaaagggtcagaaagaggtcctcttgcgcaggtgtcagcaactacaagaacatttaggacttgctgaaacccgggcagagggcctgcatcagctagaggctgaccattctaggatgaagcgggaagtgagcgcccactttcatgaagtcctgaggctcaaggacgagatgctcagcctgtctctccactactctaatgctcttcaagaaaaagaattagccgcatcaaggtgccgatcacttcaagaggaactgtacctcctgaagcaggaactgcaaagagccaatatggtctcgtcctgtgagctcgaactgcaagaacagtctttacgaaccgccagtgatcaggaaagtggggacgaggaactgaatagactgaaggaggagaacgagaagctccgaagcttaactttctcattggcagagaaggatatcctcgagcagtcccttgacgaggctcgcggatcacgacaggaattggtggagagaattcactccctccgggagcgcgctgtggccgcagagcgtcaacgggaacagtactgggaggaaaaagagcagaccctgttacagttccagaaatccaagatggcctgccagctttaccgagagaaagtaaacgccctccaggcacaggtttgcgaactacagaaggagagagatcaggcctattccgcaagggatagcgcccaaagagaaataagtcagtctctggttgagaaggattccctgcggagacaagtattcgaactgaccgatcaggtctgcgagctgagaactcagctccgacaattgcaagctgagccgcctggcgttttgaaacaggaggcaagaaccagagagccctgcccgagagagaaacagagactggtacgcatgcacgcaatatgccctagggacgattccgactgcagcctcgtaagttcaaccgaaagccagcttctgagcgacctgtctgctacgtcatcccgggagctggtggacagcttcaggtcatcctctcctgcccctcctagccagcagtctctgtataagagggtcgccgaggacttcggcgaggaaccgtggtcattttcatcatgtttggagattcccgagggggaccccggtgccctgcctggcgctaaggcaggcgacccgcacctggattacgaactgcttgacacggccgatttgccccagctggaaagttcgctccaacccgtctctcctggcagactggacgtgtctgaatcaggggtcctgatgcgacgacggcctgcacggagaattctcagccaggttacaatgttggccttccaaggggatgccttgctagaacagatttcagtgattggaggaaatctgaccggcattttcattcatcgggtgacacctggatccgccgctgatcagatggcccttaggccgggaacacagattgtgatggtggactatgaagcctctgagccactgttcaaagcagtgctggaggatacaacactcgaggaggcagtaggcctcctgcgtcgcgtcgacggattttgctgtctgtccgttaaggtgaacaccgatggctacaagcgcctgctgcaggacctggaagcaaaggttgccacttcgggagactctttttatatacgggtgaatctggctatggagggaagggctaagggcgaactgcaagttcactgcaatgaggtgctccacgtgacagacaccatgtttcagggttgcggttgctggcatgctcaccgcgtcaattcttacaccatgaaagataccgccgcacatggcaccattcccaactactctcgctag

SEQ ID NO: 4580 - DNA, 3015 bp, Artificial Sequence
  Description of Artificial Sequence: Synthetic coding sequence
atgggagagctgtgtcgccgagactctgctctgaccgcgttggacgaggaaactctttgggaaatgatggagagccatagacacaggatcgtaaggtgtatttgtcccagtagactcactccctatctccggcaggccaaggtcttatgtcaacttgatgaggaggaggtcttgcatagtcctcgtctgaccaatagcgctatgcgggctggacaccttctggacctgcttaaaacacgcggtaagaacggggctatagcatttctcgagtcacttaagttccataatcccgacgtgtacaccctcgttactggcctccagcccgatgtcgacttctctaatttttctgggttgatggagaccagcaagttgacggagtgtctggccggagcgattggatcactgcaagaggaactcaatcaggagaagggccagaaggaagttttactgagacgctgtcagcaactgcaagagcacttgggcctggccgagacgagggctgagggtctccaccagctggaggcggaccacagccgaatgaagagggaagtatctgctcatttccacgaggtccttcgcctgaaagatgagatgctgagtctcagtttgcactacagcaatgccctgcaggagaaggaattggccgctagtcgttgccggtcattacaggaagagctctatttactgaaacaagaactccaaagggcgaatatggttagctcatgcgaattggagctgcaagaacagtcacttcgcacagcctccgatcaagagagcggagatgaggagctaaatcgtttaaaggaggagaacgagaaactgaggtccctgaccttctccctggctgagaaggacattttagagcagtctctcgatgaggcacgtggtagcaggcaggagctagtggaaaggattcatagcctccgtgagcgcgctgtcgctgcagagcgccagagagaacagtactgggaagagaaggaacaaacgcttctgcagttccagaagtccaagatggcttgccagctctacagagaaaaggtgaacgctttacaggctcaggtctgcgagcttcaaaaagagcgagaccaagcttactccgctagggacagtgcgcagagggagatcagccagtcactagtggagaaggattctttgcgcaggcaggtgttcgagctcaccgatcaggtctgcgagcttcgaactcagctgcgccagctccaggctgagcctcctggggttttaaagcaggaagctcgcactcgcgaaccgtgtcctcgcgaaaagcagaggcttgtacggatgcatgctatctgtccaagagatgatagcgactgtagtttggtgtcttccaccgaatcccagcttctctctgacctgagcgccaccagtagcagggagttggtagattcctttcgttcatccagtcctgctcctccctcccagcaatctttgtacaaaagggttgctgaggacttcggcgaagaaccttggtccttttctagttgtctggaaatccctgaaggcgatcccggagctctgccaggagccaaggccggtgatccacacttagactacgagttactggatactgccgatctgcctcagttggagtcgtcactgcaaccggttagtccgggtcgactagacgtctccgagtctggcgtcctgatgcgtcggcgtccagcacgcagaattctgagtcaggtcacgatgctggctttccaaggggacgctctgctggagcagatcagcgtgataggcggaaacctgacaggaatttttatccatcgcgtcactcccggaagcgccgcagaccagatggcgttaagaccaggcacccagatcgttatggtggactacgaggctagcgaaccccttttcaaagctgtgctcgaagatacaacccttgaggaagcagtaggcctgctcaggagagttgacggcttttgttgtctcagtgtcaaggtaaacaccgacgggtacaaacgcctactacaggacttggaggcaaaggtcgccacaagtggagacagcttctatatcagggttaatctagccatggagggcagggctaagggtgagctccaagtgcactgtaacgaagtccttcacgtgactgataccatgtttcaggggtgtggttgctggcacgctcaccgggtgaattcctacaccatgaaagatacagccgcacacggcacaattccgaattatagcagagctcaacagcaattgatcgctctcatccaagacatgactcaacagtgcaccgttacaagaaagccatcaagtggcggaccacaaaagcttgtgcgcattgtctccatggacaaggctaaagcctcccccttgcggctgagcttcgacagagggcaactagacccctcgagaatggagggatcaagcacatgtttttgggccgaaagttgcctaaccctggtcccatacacactggtgcgtccccatcgtcctgcgaggcccaggccagttctcctcgtgccacgagcggtagggaaaatcctatctgaaaaactctgccttctgcagggtttcaagaagtgtctggccgagtacctatcccaagaggagtacgaggcatggtcacagaggggagatatcatacaagagggagaggttagcggtgggcgatgttgggtgacgcgacatgcggtcgaatctctgatggagaaaaatacccacgcactgttagacgtgcagttggatagcgtgtgcaccctgcacaggatggatattttccccattgtgatccatgtgtctgtcaatgaaaaaatggctaagaagctgaagaaaggactccagcgactgggaacatcagaggagcagctcctcgaggcagctcgccaggaggagggagacctggacagagccccatgtctgtatagcagtctggcgcctgatggctggtccgatcttgatggattgctcagctgtgtgcggcaggctattgctgatgagcagaaaaaggtggtgtggactgaacagagccctagatag

SEQ ID NO: 4581 - DNA, 1305 bp, Artificial Sequence
  Description of Artificial Sequence: Synthetic coding sequence
atggtttctagctgtgaattggagttacaggagcagagcctgaggacagcctcggaccaggagtcaggagacgaagaactgaaccgtttaaaagaggaaaacgaaaagctgcgcagcctcacattctcattggctgagaaggacattctcgagcaaagcctcgacgaggcacgaggtagccgccaggagttggttgaaagaatccatagtttgcgggagcgtgccgtggctgcagagcgtcaacgcgagcagtactgggaagagaaagagcagactcttctccagtttcaaaaatcgaaaatggcctgtcagctctatcgcgagaaggtgaacgcactgcaagcccaggtttgcgagctgcagaaagaacgtgaccaagcctattctgctcgtgactctgcgcagcgtgaaatcagccagtcattagtagagaaagatagcctgaggaggcaggtgttcgaactcaccgatcaggtctgtgagctacgcacgcagcttcggcagctccaggcggaaccccctggggtcctgaagcaggaagccagaactagagagccttgtcctcgcgagaaacagcgcctcgttaggatgcacgccatctgccccagggatgactccgactgctccctggtctcgtcaactgagtctcaattactgtcagacctttccgctacaagttcgcgggaactagttgatagcttcaggtcttcatcgcctgcccctccctcccagcagagtctgtataaacgcgtcgcagaggatttcggggaggagccttggtcattttcaagttgcctggaaatacccgagggggacccaggggctctgcctggtgcgaaggcaggcgatccccatctggactacgagttgctggatacagcagatctgccccagttagaaagttctctgcagcctgtgagccccggtcggctggatgttagcgaaagcggtgttttgatgcgcagaaggcctgccagacgcatcctgagccaagtcactatgcttgcatttcagggagacgctttactcgagcaaatatctgtcatcggcggaaacctgacggggatttttatacacagagtcactcccggttcagccgctgaccaaatggcgttgcgacctgggacccaaatcgtgatggtgtcgcgcgctcgtccgttattgagccctggacttctcatgggcaccgttgccgcaggcggagttacacaggcagatttcacctcaccgaggcgctgccggagcaccctaggatgggctagcgctctgtcatgggcagacgtgaaacgatcagcccacctgtag

SEQ ID NO: 4582 - DNA, 3015 bp, Artificial Sequence
  Description of Artificial Sequence: Synthetic coding sequence
atgggcgaactatgccgacgggattcggcactgactgcattggatgaagagaccttatgggagatgatggagagccacagacaccgcattgtgcggtgcatctgcccctcaaggctcacgccatacctgagacaggcaaaggtgctgtgccagctcgacgaggaggaagtactccatagcccaagactcaccaactctgctatgcgggctggccatctgctcgatctgcttaagacacggggtaagaacggggctatcgcatttctggaatcattgaaatttcataaccccgacgtatacaccctggtgacaggccttcaaccagatgtggactttagtaattttagcgggttgatggagacatccaagctcactgagtgtttggcaggcgctatcgggtctctccaggaagagctgaatcaggaaaagggccagaaggaggtcctgttgcggaggtgccagcaacttcaggaacatctggggttagcggaaacccgagcagagggcctccaccaactggaagccgaccattcacggatgaaaagagaggtgtccgctcacttccatgaagtgctgaggctgaaagatgaaatgcttagccttagccttcactactccaacgccctccaggaaaaggagttggccgcttcgaggtgccggagccttcaggaggagctttaccttttgaagcaggaactccagcgcgctaatatggtgtcctcctgcgagctggagcttcaggagcagagcctccgaacagcctctgaccaggaaagtggtgatgaggagctgaaccggttgaaagaggagaacgagaaactccggagtttgaccttcagcttagccgagaaggacatcctcgaacagagtttggatgaagccagaggatctagacaggaacttgtggaacgcattcactctctgcgcgagagagctgtagccgcagaacggcaacgtgagcagtattgggaggaaaaagagcagaccctactgcaattccagaagagcaaaatggcatgtcagctgtaccgagagaaggtcaacgccctacaggcccaggtttgtgagctacaaaaagaaagagatcaggcctactccgcccgtgacagcgcccaacgggaaataagccagtcgctggtagaaaaggactcactcagacgacaggtgttcgaattgacggaccaggtctgcgaactccgaacccaacttcgacaacttcaggccgagccccctggggtgctaaagcaagaagccaggactcgggagccctgccctagagagaagcagaggctagtgcggatgcatgccatatgcccaagagatgacagcgattgctcacttgtctccagcacggagagccagcttctgtcagatctgagtgcaacaagtagccgggagctcgtggattctttccggagttcaagccctgccccacctagccagcagagtttatataagagggtggccgaggacttcggcgaggaaccctggtccttttccagctgcctggaaataccagaaggcgaccccggagcgctgcctggggctaaagctggggacccccatctagactacgagctccttgacacggcagacctgccccagctggagtcctctttgcagccagtgtcaccaggacgtttagacgtatctgagagcggagtgctgatgagaagacggccagcacggcgtatcctctctcaagtgacaatgcttgctttccagggcgatgccctcctcgagcaaatttctgttattggtggtaatctgaccggcatcttcatccacagggtcacacctggctcagccgctgatcagatggctctccgcccagggactcagattgtcatggtagactacgaagccagcgaaccactcttcaaggccgttctcgaggacacgactctggaggaggccgtaggtctcctgcgaagagtggacgggttctgttgcctctctgttaaggtgaacacagacggatacaagaggttgttacaagatctggaagctaaagtcgcgacatctggtgactccttctacatcagagtgaacctcgcgatggaaggtagggctaagggcgaactccaggttcattgtaacgaggtgctccacgtgacagacacaatgttccaggggtgcgggtgttggcatgcccatagagtcaattcatatactatgaaagacacagccgctcacggtacaatccctaattattcacgtgcccagcagcagttgattgctctaatccaggatatgacccagcagtgcaccgtcacacgaaagccaagctcgggagggcctcagaagcttgtccgtatcgtctcaatggataaggccaaagctagtcctctcaggttaagtttcgatcggggtcagctcgacccttccaggatggaagggagctcaacctgtttttgggccgagtcgtgcctgacgctagtgccatacacgctcgtgagacctcaccgaccagccaggccaaggcctgtgctactcgtgcccagggctgtcggaaagatcctaagtgaaaagctttgtctgcttcagggatttaagaagtgcttggccgagtatttgtcacaggaggaatacgaggcttggtcacagcgtggcgatatcatccaagagggcgaagtttccgggggaaggtgctgggtcacacgccatgcagtggagagcctcatggagaagaacacccacgcattgctggacgtgcagctggatagcgtgtgcacattgcatcgaatggatatctttcctatcgtcatccacgtgagtgtcaatgaaaaaatggcgaaaaagttgaagaagggcttgcagcggctcggcaccagcgaggagcagctcctggaggccgctagacaggaggaaggagatctcgaccgcgctccatgcctgtacagcagtttggctccagatggatggagcgatctggacggattgctaagctgtgtacgacaagcaattgctgatgagcaaaagaaagtagtttggacagaacaatcaccacgatag

SEQ ID NO: 4583 - DNA, 1326 bp, Artificial Sequence
  Description of Artificial Sequence: Synthetic coding sequence
atggtatcaagttgtgagctggagctacaggagcagtctctgcgtacagcaagtgaccaggaatctggtgacgaggagctgaatcgccttaaagaggaaaatgaaaaacttcgatctctgacattttctcttgctgagaaagatatccttgagcagtcccttgacgaggcccgaggatccagacaggaactcgtcgaaaggattcattcactgagagagagagctgtcgccgcagaaaggcagcgcgaacagtactgggaggaaaaagagcagacactcctccagttccaaaaatctaaaatggcatgccagctgtacagggagaaggttaacgctctccaagcccaggtttgcgagttgcagaaagaaagggatcaagcatatagcgccagggactccgcccagagggagattagccagagcttggtggagaaggacagtctgcggaggcaggtgttcgagttaacagaccaggtctgtgaactgcgtacccagctgagacagcttcaagcagagccaccgggagtccttaaacaggaagccagaacccgggagccctgtccgagggaaaaacagagacttgtgagaatgcatgccatctgccctcgtgatgacagtgattgcagcttagtgtcttcgactgaatctcaacttctcagtgacttaagcgctacttcctcccgtgagctggtggacagcttcagaagttctagtccagccccaccgtcacaacaatctctgtacaagcgggtggcggaggacttcggtgaggagccttggagtttttcttcatgcttggaaatccctgagggcgacccaggagcactccctggcgctaaagccggagacccccacctggactatgagctgctggatacagccgaccttccacagctggagtcatccctgcagcccgtctcccccggacgtcttgacgtgagcgaaagtggagtgctgatgcgaagacgtcctgcccgaaggatcctgtcgcaggtgaccatgttagcattccagggagacgctcttctcgagcagatctccgtcattggtggaaacctgaccggcatattcattcacagagtgactcccggaagtgcagccgatcagatggctctgagaccaggcacccagatcgtgatggtgattcgcggatatagccggacgtggcgaccgaaatggcggccacggggaactcatagtacatcaggctcaacatggccgtggagagctgggccaaagggatcctgtcgatgcatcgccaccagatcctgtacgtctccgactccctgcagcagggcagccgcagctggtatgccaaccgcatag

SEQ ID NO: 4584 - DNA, 2349 bp, Artificial Sequence
  Description of Artificial Sequence: Synthetic coding sequence
atgtttccgccttcgggaagcacaggcttgatacctcccagccattttcaagcacggcctctttcaaccttaccaaggatggcccctacctggttatcagacattcccctggtgcaaccacctggacatcaggatgtctccgaaaggcggctagatacccagcgccctcaggttacgatgtgggaaagggacgtgtccagtgatcggcaagagcccggacgtcgcggaagatcatggggtctcgaaggcagccaggctctcagccagcaagcagaggttattgtccgccaattgcaagagctgcgtcggcttgaagaggaggtgcggctcttacgcgaaacatccctccagcagaaaatgcgcctagaagcgcaagcaatggaactcgaagcgctagcaagggccgagaaggctggcagagctgaagcagagggtcttcgcgctgcactggccggagccgaggttgtcaggaagaatttagaggaaggaagccagcgcgaactagaggaggttcagagattgcaccaggagcagctgagttccctcacacaagcgcacgaggaagcactctcttccctcacctctaaagccgaagggctcgagaagagtctgtcaagcttggagacaagacgggctggcgaggcaaaggaacttgcggaagcccagagagaagccgaactcctgcgtaagcagctttctaagacacaggaggacttagaggctcaggtgacgctggtggagaatttacggaagtatgtgggtgagcaggtcccgtctgaagtacactcccaaacatgggagttggagaggcagaaactgctggagaccatgcaacacctccaggaagatagagactctttgcacgctactgcagaactgttgcaggtgagggtccagagcctgactcatattctggccttacaagaagaagaattaacccgtaaggtgcagccgtcagatagcctggagcctgaatttacccgtaaatgccagtcattgttgaaccggtggcgggagaaggtttttgcgctcatggtacaactgaaggcccaggaactcgagcacagtgattccgtgaaacagctgaaaggacaggtggcgtccttgcaagaaaaggtgacgagccaaagccaagaacaagctatccttcagcgtagcctgcaagataaggccgctgaagtggaggtcgagcggatgggggctaagggtttacagttggagctgagtagagcccaggaggccagaagaagatggcagcagcagactgcttctgccgaagaacagttgcgtttagtggttaatgctgtttccagctcccaaatatggctagagactacaatggccaaggttgaaggcgctgcagcccagctgccttctctgaacaataggctgtcctacgccgtaagaaaagtacacacaatacggggattgattgccagaaaacttgcacttgctcagctgcgccaggagagttgccctcttcctcctcccgtgacagatgtaagtctggagttgcagcagctccgcgaagagcgaaatagactcgacgccgagctgcagctcagtgcaaggctgatccagcaggaagtaggaagagcccgtgagcagggcgaagctgaacggcagcaactgtccaaggttgcacaacaactggaacaggaattacaacaaacacaggaatctctcgctagcctgggtctgcagcttgaggtggctaggcaggggcagcaggagtccacagaggaggcagcctccttgcgccaggaactgacgcagcaacaggaactgtatggtcaagcactccaggaaaaagtggcggaggttgaaactcggcttagagagcagttatccgatacagagcgcagactgaacgaggcccgaagagaacacgctaaagccgtggtgtccctccgacagatccagcgacgtgctgcccaggaaaaagaacgctcccaggagcttaggcggctgcaggaggaggcacgtaaggaagaaggacagaggctggccaggagactgcaggagctcgaacgcgataaaaatcttatgcttgcaaccctccagcaagaaggcctgcttagccggtacaagcaacagcgactgcttaccgtgctcccatcattactggacaaaaagaagagtgtcgtgtcaagccctcggcctcctgaatgtagcgcttcagcccctgtggccgctgctgtgccgaccagagaaagcattaaagggtctttaagtgtccttttggatgacctgcaagatctgtccgaagccatcagtaaagaagaggccgtgtgtcagggagacaatctggacaggtgctccagcagtaaccctcagatgtccagttag

SEQ ID NO: 4585 - DNA, 2349 bp, Artificial Sequence
  Description of Artificial Sequence: Synthetic coding sequence
atgttcccgccttccggcagcaccggcctcataccaccgtcacactttcaggcaaggcccctctctaccctgccgagaatggccccaacctggctctctgacattcccctggtgcaaccgcctggacaccaggatgtatctgaaagacgcctggacacacagagaccccaggtgaccatgtgggaacgtgacgtgagctccgaccggcaggagcctggtcggaggggcaggagctggggtctagagggatcccaggccttatctcagcaggcagaggtcattgtgagacagctgcaagaactgaggtggttagaagaagaagtctggctgttaagagaaacttcattgcagcaaaagatgcgcctggaggcccaggccatggaactcgaagccctcgctcgcgcagaaaaggccggtcgcgcagaggctgaaggcctgcgcgctgctctggcgggtgctgaagtcgtgaggaagaacttggaagaggggcgtcagcgagagctcgaagaagtgcagagattgcatcaggagcagcttagtagcttaacccaagcacacgaggaggcccttagttccctgacaagtaaggcagagggactagagaagtctctgtcctcacttgaaacacgacgcgctggagaggccaaagaactggcagaggctcaaagggaagcagaacttctccggaagcagctatccaaaacccaggaggatctggaggcacaagtgaccctagtcgagaatttgcgaaagtatgtgggtgaacaggtgccgagtgaggtgcactcccaaacctgggagctagagaggcagaaacttctggagacaatgcagcacctgcaggaggatagggattctctgcatgccaccgcagaactattacaagtgagggtccagtcactgactcatatcctggccttgcaggaagaggaactaaccagaaaagttcagccgagcgattctctagagccggagtttacaaggaaatgccagtccctcctcaaccgttggcgggaaaaggtttttgctcttatggtgcagttaaaagcccaggagctggagcactccgactcggtcaagcagctgaaaggacaggtggcctcccttcaagaaaaggttacgagtcaaagtcaggagcaggctatactccaacgcagtctgcaggataaggccgcagaggtggaggtagagcggatgggcgctaaaggacttcagttagaactctcgcgcgcacaggaagcaaggcgttggtggcagcagcaaacggcgagcgcagaggaacagttgcgcctcgtcgtcaacgcagtgtcgtcttctcagatttggctggaaaccactatggctaaagtcgagggggcagctgctcagttgccttcccttaataatcgattgagttacgccgttcgaaaagtgcacaccatcaggggtctgatagcaaggaaactggccctggcgcagttgcgtcaggagtcttgtcccctgccaccacctgttaccgatgtcagcctggagctgcagcagttacgagaggaacggaaccggctcgacgccgaactgcagctttccgcccgactcattcaacaagaagtgggaagggccagagagcagggagaggcagagcgccagcagttatcaaaggtggcccagcagttggaacaggaactgcagcagacccaggaatctctcgctagtctaggccttcagctcgaggtagcacgtcagtgccagcaggagtcgacagaagaggctgcgtcgctgaggcaggaacttacccaacagcaggagctgtatgggcaagctctgcaggaaaaggtggctgaggtggaaacaagactgagagagcagctttcagatacagagagacgcctgaatgaggcacgacgggagcatgcaaaagccgtggtgagcttaaggcagatccagcgacgggcagcgcaggaaaaggagcgatctcaggagctgcggaggctgcaggaggaggcccgaaaggaggagggacaaaggctcgctcgccgtctgcaggagctcgagcgtgacaaaaacttaatgttagcaacactgcagcaagaggggttgctgagccggtacaagcagcaacggttattgacagtgctgccctcccttctggataaaaagaagagtgtggtgtcgtctccaagacctccagagtgtagcgctagtgcacccgtcgctgcagcagtgcctacccgggaaagcatcaaggggtccctgtccgtgctgctggacgacctgcaggatctgtctgaggcaatctctaaagaagaggccgtgtgccaaggagacaacttagaccgatgttcaagttgtaacccacagatgagctcttag

SEQ ID NO: 4586 - DNA, 2349 bp, Artificial Sequence
  Description of Artificial Sequence: Synthetic coding sequence
atgttccccccatctgggtctactgggcttattcctccatcccactttcaggctcgccctctgagcaccctcccaaggatggctccaacatggctgagcgacatccctttagtccagccaccgggacaccaggatgtgtctgagaggcggttggacacgcagcgccctcaagtcaccatgtgggagagagacgtgagcagtgacaggcaggagcccggtcggaggggcagatcttggggattggaaggcagccaggccctgagtcagcaggccgaggtcatcgtgcgccaactgcaggaattgagaaggcttgaggaggaagttcgcctgttgcgggaaacgtcgctccagcagaaaatgcgcctggaggcccaagccatggagctggaggccttggccagggctgaaaaggctgggagggcggaggctgaaggtcttcgagccgcactggctggagctgaagtcgtcagaaagaacttggaggaaggctctcagcgggagctggaggaagtacaacggctccaccaggaacagctgtccagcctgacccaggcccatgaggaagccctcagcagcttgacgagtaaggcggagggacttgagaagtcattgtcttctctggaaacccgacgcgctggcgaggccaaggagctggcagaggctcagcgtgaagcagagctcctgcgaaaacagcttagtaaaacccaagaagatcttgaagcccaagtcacccttgttgagaaccttcgtaaatatgtaggggagcaggtgccttccgaggttcacagtcagacgtgggagctcgagcgacagaaactcttggagaccatgcagcatctccaggaagacagagattccctacacgctaccgccgaactgctacaagtcagggtacagtcccttacacacattctcgccctgcaggaggaggagctgacaagaaaagtccagccctcagatagcctggaacctgagtttacacgaaagtgccagtcactcctgaaccggtggcgagagaaagtttttgccctgatggtgcaactcaaggcacaggagttggagcacagcgacagcgttaagcaactgaaaggccaggttgcctctctgcaggaaaaggtaacctcccagtctcaggaacaggcgatacttcaaagaagcctccaggataaggccgcagaggtcgaggtggaaagaatgggggcaaaggggctccagttggaattgagccgggcacaggaggctagacgtaggtggcagcagcagacggccagcgccgaggagcagctgagactggtggtgaatgccgtgagtagcagtcagatatggttggaaaccactatggccaaagtcgagggtgcagctgcccagctcccaagtctgaataaccgtctcagctatgccgtgagaaaagtgcacactattcgaggattgatcgcgaggaagctggcattggcccagctccggcaagagtcatgtccgctccctcccccagtgacggacgtcagccttgagctacagcagctcagggaagaaagaaaccggctggatgccgagctccagctttctgcccgactgatacaacaggaagtgggccgagcaagggagcagggggaagcagaaagacagcagctctctaaggttgcccagcagcttgagcaggaactgcagcagactcaggaaagtctcgcgtccctcggattacagctagaagtcgcccgacagggtcagcaagagtccaccgaggaggcagctagtctgcgacaagaactgactcaacaacaagaactctatgggcaggccttacaggaaaaggtggccgaagtcgagaccaggttgcgcgaacagctgagcgacacggagcgcaggttgaatgaggcgagacgcgaacatgcaaaagcagtcgtgagcctgcgccagattcaaaggcgggcagcccaggagaaagagagatcacaggaacttcgcagactgcaagaagaagcaagaaaagaagaagggcagaggctcgcgaggaggctgcaggagctagaacgcgataagaatctgatgctggcgaccctgcagcaggaggggctgctgtcacggtataaacagcaacgactcctgaccgtgctaccctcactgctggacaagaagaaaagcgtcgtgtcctcgcctagaccgcctgagtgctctgcaagcgcacctgtggctgctgccgtcccaactcgggagtcgatcaagggatcactctcagtgcttctggacgacctgcaagacctgtcagaggccatttctaaggaagaagccgtgtgccagggggacaacctggaccggtgttcctctagcaaccctcaaatgtcaagctag

SEQ ID NO: 4587 - DNA, 2190 bp, Artificial Sequence
  Description of Artificial Sequence: Synthetic coding sequence
atgtttccaccatccggctctactgggctcattccaccctcccactttcaggcacgaccattgtccactctgccacgcatggcccctacttggctctccgatatacctctcgtgcagccacctgggcaccaggacgtgtccgaacgtaggctcgatacccaacggccacaggtcaccatgtgggagcgggatgtgtcttctgaccggcaggagcctggtagaagggggcgtagctgggggttggagggtagtcaagcgctttctcagcaggctgaagtcatcgtgagacagctgcaggagctccgcagattggaggaggaagttaggctgcttagagagacatctctgcagcaaaaaatgaggctggaggcccaggcaatggaacttgaggctcttgccagggctgagaaagccggacgagccgaagcagaaggacttcgcgctgcactggccggagctgaggtggtgcgaaaaaatttggaggagggctctcagagagagctggaagaagtccaacgactacaccaggaacagctgtccagcctcacacaggcccacgaagaggccctcagcagtttgacctccaaggccgagggtctagaaaaatccctgagcagcctcgagacacgtagggcaggtgaagccaaagaactggctgaagcccaacgcgaggcggagttacttcgaaagcaattatctaaaacacaggaggacctcgaagcccaggtaactctggtggaaaatcttagaaagtacgtcggggagcaagtgccctctgaggttcatagccagacatgggaactcgagcgacagaaattgctggaaactatgcagcatctgcaggaggatcgtgattccctacatgctaccgccgagctgcttcaggtgagggtccaatccctgactcatattctcgcacttcaagaggaggagctcacgagaaaagtacagccttcagactccctggagcccgaattcacccggaaatgccagtccctgctgaaccggtggagagagaaagtgtttgccttgatggttcagcttaaggctcaagagctcgagcacagcgattccgtcaagcagttaaaagggcaggtggccagcttacaagagaaagtcacctcgcagagccaggagcaggctatcctgcaacgatcgctgcaggataaagctgctgaggtcgaggtggaaagaatgggggctaaggggctccaattggagcttagccgggctcaagaagccagaaggcgctggcagcaacaaaccgcatcagctgaggagcagcttcggctggtggttaatgctgtctcttcttgccctttgccccctcccgtcaccgacgtcagcctggagctccagcagctccgtgaggaacgcaaccggctcgacgccgagctccagttgtccgccaggctcatccagcaggaagtaggccgtgccagggagcagggcgaggccgagcggcaacagctgtccaaggttgctcagcagctggaacaagaactgcaacagacccaggagagtttagcttcccttggattgcagttagaggtagcccgtcagggtcagcaggagtcaaccgaagaggctgctagcctgagacaggagctcacccagcagcaagagctgtatggccaggcactgcaggaaaaggtggctgaggtggaaacgaggctgcgggagcagctgtccgataccgagcggagactcaatgaggcaaggagggaacacgccaaggctgtggtcagtctgcggcagatccagcgccgagccgcacaggagaaagagagatcacaggaattacgacgtttgcaggaagaggcaagaaaagaggaggggcagcgcctggctaggagattacaggaactcgaacgcgacaagaaccttatgctcgcaacacttcagcaagaaggcctgctgagtcgatacaagcaacagagactcctgacagtgctgcctagcctattggataaaaagaagagcgtcgtttcatctccacggcctcccgagtgtagcgcatctgctcctgtcgccgctgccgtacccactagggagtccattaaggggtctctctcagtcttactcgacgatttgcaagatttgtctgaggccatatcgaaagaagaagccgtttgccaaggagacaatcttgatcgttgtagctctagcaatccacaaatgagttcttag

SEQ ID NO: 4588 - DNA, 2616 bp, Artificial Sequence
  Description of Artificial Sequence: Synthetic coding sequence
atgtggccccattcggccggagctcgcccttgggcttccaccctcacaggtaaggaccctagagtcatggcctgctggtgcctggacggccttccaagtggcttagctgagccctggcgagagctatggcggtggcgcagccgccctctacactgcgtcccaccattctcacctttggctaggagttctagggatcacagaaatctcagacgtagaggaaatatcgatgggtggaggcagaacctcgagccttccaataacgtcgagatgtttccacccagcggctcgaccgggctcatcccacccagtcatttccaggcgcgacccctgtccaccttacccagaatggctcctacctggctgtctgacattcccctcgtccagcccccaggccatcaagacgtcagcgagagacgactggacacccaacggccacaagtgacgatgtgggaaagagacgttagttctgatcggcaggagcctgggcgtcgaggacgctcttggggacttgaaggttcccaggctttatcacaacaggcagaagtcatagttagacagttgcaggagttaaggcgcctggaggaggaagtacgattgctgcgggaaacctcccttcagcaaaaaatgaggctggaggcacaggccatggagctcgaagctctggccagggcagagaaggcgggacgcgcagaagcagaagggcttcgagccgctctggctggagctgaggtcgtaaggaagaatttggaagaaggtagtcaacgggagttggaagaagtgcagaggctgcaccaggagcagctttcaagtctgacccaggcccacgaggaggccctgtcctccctcacatccaaagccgaagggctggagaaatcactgtctagccttgaaacccggagagccggtgaagctaaggaactcgccgaagcccaaagagaagccgaactccttaggaaacagttaagtaagacacaggaggacctggaggcacaggtgacgctcgtcgaaaacttgcgcaagtatgtgggcgaacaggttccatccgaggtgcacagtcagacatgggaattggaacggcaaaagctgcttgaaaccatgcagcatctgcaggaggatcgggattcactgcacgccacagccgagctactacaggttcgagttcagagcttgactcacatactggcattgcaggaagaggagcttactcggaaagtccaaccctccgacagtttggaaccagaattcaccagaaagtgccagtccttactgaaccggtggcgtgaaaaagttttcgcactgatggtgcagctgaaagcccaagaactggagcacagtgattcagtgaagcagttgaaggggcaggtggcttctcttcaggagaaggttaccagccagagtcaagaacaagcaatattgcagcggagcctgcaggataaggctgctgaggtcgaggttgagcggatgggcgcaaagggcctccaactggaactttccagagctcaggaagccaggcggagatggcaacagcagacggcttctgccgaggagcagctgcggttagtggttaacgctgttagctcctcccagatctggctcgagaccacaatggctaaagtggagggtgccgcagcacagctcccgagtctcaacaaccggctgtcctatgcagtccgcaaggtgcatacaattagagggctcatcgctcggaagctggccttagcccagctgcggcaggagtcatgtcccttgccaccaccggtaacggacgtgagcttagagctgcagcaactaagggaggagcgaaatcgactggacgcagagctgcaactttctgcaaggctcatccagcaggaagtcggcagggcacgggagcagggagaagctgagcggcagcaactgtctaaagtggctcagcagctagaacaggagcttcagcagacacaagaatctttggcaagtctcggattgcagcttgaggtagctagacagggccagcaggaatcaacagaggaagcagcctcactcagacaggagctgactcagcaacaggaattatatgggcaggcactccaagagaaggtggccgaggtggaaaccaggcttagagaacagttgtcagacaccgaaaggagattgaatgaggcaagacgcgagcacgctaaggctgtggttagcctccgccagattcagaggcgggctgcacaggagaaggagagaagtcaggagttacgacgccttcaggaggaggctcggaaagaagaaggccagcggctggccaggagactgcaggagttagagcgtgacaaaaacctgatgttagccaccttacagcaggagggtctccttagtcgatataagcagcagaggcttctgacagtgctgccctcgttattagacaaaaaaaaatcagtcgtctctagccctcgccctcccgaatgcagtgcaagtgcccctgtcgctgcagccgtgcctactcgggaaagtatcaagggtagtctgagcgtgctgctggatgatctccaagatttgtcagaagctatatcaaaggaggaagccgtctgccagggggacaatttggatagatgctcttcttctaatccgcagatgtcttcttag

SEQ ID NO: 4589 - DNA, 2190 bp, Artificial Sequence
  Description of Artificial Sequence: Synthetic coding sequence
atgtttccgccttctgggtctaccggactgattccgccttcacacttccaagctcggcctctgtctaccctccctaggatggccccaacctggctgtcggacatccctctcgtgcagcccccaggacaccaagacgtgagcgagcgaagactcgatacccagagaccgcaggttacgatgtgggaacgggatgtcagctccgatcgtcaggagccagggaggcggggacgtagctgggggctcgaaggatcgcaagccttgtctcagcaagctgaggtaattgtgcggcagctgcaggagctccggtggttggaggaggaagtgtggcttctgcgcgaaactagtctgcagcagaaaatgcggttggaggcccaagccatggagctggaagctctggctcgcgctgaaaaggccggtcgggctgaggcagaaggcctgcgcgctgcattagcgggagctgaggtggtgcggaaaaatctggaggaaggcagacagagggaattggaggaggtgcagaggctccaccaggaacagttgagcagcttgacacaggcccacgaggaagccctcagttccctgacatctaaagctgaagggctggagaaaagtctctcttccttggagacgaggagagccggagaagccaaggagctggctgaggctcagcgggaagcagagctgctgcgtaagcagttgtccaagacacaggaggatttagaggcgcaggtcactctagtggagaatctgagaaagtatgtcggtgaacaggtcccctccgaagtgcatagccagacttgggaattagagagacagaagctgctggagactatgcaacatcttcaggaggacagggactctctacacgccacagccgagctcctccaggtgagagtacagagtctgacgcacatcttagcactccaggaagaagagcttacgaggaaggtgcagcctagcgattctttggagcccgagtttacgaggaaatgtcaatcattgctgaatcgctggagggaaaaagttttcgccttgatggttcaattgaaggcacaagagttggagcattctgacagcgtaaagcagctgaaaggacaagtcgcgagtcttcaggagaaggtgactagccaatcccaggaacaagctatccttcagcggagcttgcaggataaagccgcagaagtagaagtggagaggatgggcgcaaaaggtttacagctggagctgtcgcgagctcaggaggctagaaggtggtggcagcagcagacagctagcgctgaggagcagctccggctggtggtgaatgctgtgtccagttgtccactaccccctcccgtgaccgacgtgagcctggagctgcagcaactcagagaagagcggaatcgactggatgcagaacttcagctctctgcacgtctgatacagcaggaagttggacgtgccagggaacagggggaggcagaaagacagcagttgagtaaagtggcacaacagttggagcaggagctacagcagacgcaggagagcctcgcgtccctggggctgcagctagaggtggctagacagtgtcagcaggagtctacagaagaggcagcctctctccggcaggagctgacccaacaacaggagctgtacggacaggccctgcaggaaaaggtggctgaagtggaaactagattgcgggagcagctcagcgatacggaacgcaggctcaatgaggccagacgggagcatgcgaaggccgtggttagcctgcggcagatacagagaagagccgctcaggagaaggagagatctcaggagctacgccgactgcaggaggaagcccgtaaagaagaagggcagaggctggccagacggctgcaggagcttgagagggacaaaaacctcatgctggcaaccctgcagcaggaaggcctgctgagccgctacaaacagcagcgattgctgacggtgctccccagcctgctggataagaagaaatcagtggttagctctccccgaccaccagaatgttcagccagcgcccctgtggcagccgctgtccccacacgcgagagcatcaagggtagtctgagtgtactgttagacgacctgcaggatctctccgaggccatcagcaaggaagaggcagtttgccagggcgacaacttagatcggtgcagcagttgcaatccacagatgtcaagttag

SEQ ID NO: 4590 - DNA, 2349 bp, Artificial Sequence
  Description of Artificial Sequence: Synthetic coding sequence
atgtttcctccgagcggatccactggccttatccccccaagtcactttcaagcccgtccactgtctacgctacctcggatggccccaacctggctaagtgacataccacttgttcaaccacccggtcatcaggacgtatcagagcgtaggctggatacacagagaccccaggtaaccatgtgggaaagggacgtttcgagtgaccgccaggagccgggacgaaggggtcgctcatggggtcttgagggctcacaggccctcagccagcaggcagaggtcatagtgcgccagttgcaggaattgaggtggctcgaggaggaggtttggctccttcgagagacctcacttcagcagaaaatgagactggaggctcaggcgatggagctggaagccctggccagggccgagaaggccggaagggccgaagctgagggccttcgagcggcactcgcaggagccgaggtggttcggaaaaatctcgaagaggggagacagcgggagctcgaggaggtgcagagactccatcaagagcagctttcctcactgacgcaagcccacgaggaggccctgagcagcctgactagtaaggctgaaggcctcgagaagtctctgtcatctctcgaaaccaggcgcgctggcgaagcaaaggaattggccgaagctcaaagggaggccgagctgctccgcaagcagctgtctaagacacaggaagacctggaagcacaagtgactctggtcgagaacctgagaaagtatgtgggcgagcaggttcctagcgaggttcatagccagacatgggagctcgagaggcagaagctcctcgaaactatgcagcacctgcaggaggatagagactccctccacgctacagcagagcttctacaggtgcgggtgcagtctctcactcacatcttggcattacaagaagaggagctcacccggaaagttcagccttccgatagcctggagccggaatttaccaggaagtgccagtctctgctgaatagatggcgggaaaaagtgttcgctctcatggtacagctgaaggctcaagaactagagcattccgactccgtcaagcagttaaaaggtcaggttgccagtctgcaagagaaggtgacatcacagtcacaggaacaggcgatcctgcagcgctcactgcaggacaaagcagcggaggtggaagtggaaagaatgggagccaagggcctgcagttggagttatctcgtgctcaggaggccagacgttggtggcagcaacagacggcatctgctgaggagcagctcaggctggtagtcaatgctgtcagcagcagtcagatctggctggagacgactatggctaaggtggagggagcggcagcacagctgccatcacttaacaacaggcttagttacgctgtgcgtaaggtgcacaccatacgcggtcttatagcacgcaagctagctctggcccagctccggcaggagagctgccccctgccgccaccagtgaccgacgtcagcttagagctccagcagctgcgggaggagaggaatcgcttggacgctgagctccagctgtcagcacggttgatccaacaagaggtgggccgtgccagggagcagggcgaggctgagcgacagcagctctccaaagtcgcccagcagctggagcaggagctccagcagactcaggagagccttgcctcactcggattgcagttagaagtggctcggcaatgccagcaggagtccaccgaagaagctgcaagcttaagacaagaactaacccagcagcaggagctgtacgggcaagctctccaggagaaagtggcagaggtcgagaccagactgagggagcagctttcagacaccgaacgacgacttaacgaagctaggcgggaacatgccaaggcagtggtttccctgaggcagattcagcgacgtgcagctcaagagaaagaacgttcacaggagctcaggagactccaagaggaagctagaaaagaagaaggccagcgacttgctcgacgcctgcaggagttagagcgggataagaacctgatgctggccacactgcagcaagagggactcctatctaggtataagcagcagcgactgcttactgttctcccatcactcctggacaaaaagaaatctgtcgtctctagccctagaccacccgaatgctcagctagtgctccggtcgccgctgctgtgcccacacgggaatctattaaaggaagcctcagcgtactgcttgacgacctgcaagatctctctgaggctatatcaaaggaggaggctgtatgtcaaggcgataacctggatcgatgcagttcctgtaacccgcaaatgagttcctag

SEQ ID NO: 4591 - DNA, 2190 bp, Artificial Sequence
  Description of Artificial Sequence: Synthetic coding sequence
atgtttcctccatccgggtctactggcttaatcccgccatcccatttccaggcaagacctctgtctactctgccacgtatggcgcctacctggctgtcggatattccgctggtacaacccccagggcaccaagacgtaagcgagcggaggctggatacacagcgaccccaagtcacgatgtgggagcgagatgtcagttccgatcggcaggagcccggtaggagaggaaggagctggggtctcgagggctctcaggccctttctcaacaggccgaagtaatcgtaaggcagctccaggaactgcgtcgccttgaagaggaagtgagactactgcgcgagacttcgctccagcagaaaatgcgtctcgaagcgcaggcaatggaactggaggcgttggctagagccgaaaaggcaggtagggcagaggctgaagggctcagagcagcactggcaggcgctgaagttgtgcgaaaaaacttggaggagggttcacagagagagctcgaggaggttcagcgcctgcaccaggagcagctgtccagtctcacccaggctcacgaagaggccttgagtagtctgacgtccaaagcagagggcctggaaaaatccctttcatctctcgaaactagaagggctggcgaagctaaggagttggcagaggcccagcgcgaagctgaactccttaggaagcagctttctaagacacaggaggacctggaagcccaagtgaccctcgtggaaaacttaagaaagtacgtgggagaacaggtgccctccgaagtacattctcagacttgggaactggaacggcagaagcttctggaaacaatgcagcacctgcaggaggaccgcgattctctgcatgctaccgcggagctgctgcaagttcgggttcagtctctaacacacatcctggcactccaggaggaggagctgacccgtaaggttcagcccagtgacagtcttgagcctgagttcactagaaagtgtcagagcctgttaaatcgttggagagagaaggtgtttgccctcatggtgcagttgaaagcacaggagctcgagcacagtgatagtgtgaagcaattaaagggtcaagtagcatcccttcaggagaaagttactagccaatcccaagaacaggccattctccagagatcactccaggacaaggcagctgaagtggaagttgagaggatgggagccaagggccttcagctggaactgtcacgagcgcaggaggctagacgccgttggcagcaacaaacagctagcgcagaagagcagctgagattggtggtcaacgccgtgtcctcttgtcctttaccaccacccgtaactgacgtgtctcttgagctgcagcagttgcgggaagagcggaataggctagacgctgagctgcaactgagtgcaagactcatccagcaggaagtcgggagggcaagagagcagggggaggcagagaggcagcagctctctaaggtcgcacagcagctagaacaggaacttcaacaaacacaggagagcctggccagtctaggactacagctggaagtcgccagacaaggtcagcaggagagtaccgaggaagcagcttccctcagacaggaattaactcagcaacaggaactatacggacaagcactgcaggagaaggtcgccgaggtcgagacccgactgagagaacaactctccgacactgaaagaaggctaaacgaggccaggcgagaacacgctaaggcagtggttagtctacgacagattcagcgcagagcagcgcaggagaaggagcgctcccaggaattgagaagacttcaggaggaggccaggaaagaggaaggtcagaggctggctagacggcttcaggaacttgagagggacaaaaatttaatgttagctaccctgcaacaggaggggctgctctctcggtacaagcagcagcgcctcctgactgtgctgccatccttactggataaaaaaaagtctgtggtcagtagccctcgccctccagaatgttctgcatcagccccagtggccgctgctgtccccacaagggagagcattaaaggaagtttgtccgtgctgctcgatgatctacaggacctgagcgaagcaattagtaaggaggaagcagtgtgccaaggggacaacttagacaggtgctcaagtagcaaccctcagatgagttcctag

SEQ ID NO: 4592 - DNA, 2616 bp, Artificial Sequence
  Description of Artificial Sequence: Synthetic coding sequence
atgtggccccatagcgccggagccagaccttgggcttccactttaacagggaaggatcctcgcgtgatggcctgctggtgccttgacgggctgccttctggtctggctgaaccctggcgagagctttggcgttggagaagtcgaccactgcattgcgtgccaccattttcacctctcgcgcgatccagcagggaccataggaatctccgacgaagaggaaatattgacgggtggagacagaacttggagccatcgaacaacgtcgaaatgtttccccctagcggctcgactggcttgattcccccatcccacttccaggctaggccactcagcaccttacctcggatggccccaacctggctgtccgacatccccctggtccaaccaccaggccaccaagatgtttcagagcggcgactagacacacagcggccacaagttactatgtgggagagggacgtcagctctgatagacaggagcctggccgaagaggtcgtagttggggcttagagggctctcaggctctgagccagcaagcagaggtgatagttcggcagctccaggagttacgtaggttggaagaggaagtgcgactgctacgagagacatcactccagcagaagatgcggctcgaggctcaggctatggagctggaggcattggctagggcggagaaggctgggagagcagaagctgaaggtttaagggccgcattagcaggtgccgaagtggtacgtaaaaacctggaagaaggttcacagcgggagcttgaggaggtgcagagactgcatcaagaacaactttcaagcctgacccaggcccatgaggaggctctctcctcattgacatctaaagcggaagggctggagaagtcactctcctctctcgaaacgagacgcgctggtgaagccaaggaactggcagaggcccagagagaagctgaactgctgcgaaaacagctgagcaaaactcaggaagatctggaggcccaggtcaccctggtagaaaatcttcgtaaatatgttggtgagcaggtgcccagtgaagttcactcgcagacctgggagctcgagcggcaaaagctgctcgagacaatgcagcatctgcaagaggaccgggattctttacacgcaaccgcagaactcctgcaggttagagtgcagagtctcacccacatcttggcgctccaggaggaagaattgaccagaaaagtgcaaccctctgactctctggagccagagttcactcgcaaatgccaatcgctactgaataggtggcgagagaaggtgttcgcgctcatggtacagttgaaggcgcaagaactggaacacagcgacagcgtaaagcagctgaagggtcaagtagcctccttgcaggagaaggtgaccagtcaatcccaggaacaggctatcctgcaaagaagcttacaggataaagccgctgaggtggaggtggagcggatgggggctaaaggactccaactagagctgtccagagcacaggaggccaggaggagatggcaacagcaaactgcttccgccgaggagcagctgcggctcgtggtcaatgctgtcagttcaagccagatatggttagagaccaccatggcaaaggtagagggtgcggctgctcagcttcccagcttaaataatcgcctttcttacgctgtccggaaagtgcacactatcaggggccttatcgccagaaagctagcactggctcagctccgacaggagtcgtgcccgctccctccacccgtgactgacgtatcattggaactgcagcaactgcgtgaggagaggaacaggctggatgctgagctccagcttagtgccagattaatccagcaggaggtgggcagggcgagggagcagggtgaggctgagcgccaacagctgtctaaagtggcccagcagctggagcaggaactacagcagactcaggaatctctagccagcctgggcctgcagctagaagtggccagacaggggcagcaggagagtacagaggaggccgcttcacttaggcaggagttgacacagcaacaggagctgtacggccaagccctccaggagaaggttgcagaggtggagaccagattgcgggagcagctgtcagatacggaacgacggctgaatgaggcccgacgggagcatgccaaggccgttgtttctctgaggcagatccagcgtcgcgctgcccaggagaaagaaaggtctcaggagcttcgcaggctgcaggaagaagcccgaaaggaagaggggcagaggctggcccgacgcctgcaggagctggaaagggacaagaacctcatgcttgctaccttacagcaggagggcctgctctcccgatacaaacaacagagattgctgacggtccttccttccttgctggacaagaagaagtccgtggtcagtagtccacgaccccctgaatgctccgcctctgccccagtggcagccgctgtacctacgagagagagcatcaaaggatccctgtctgtactgctggacgacctgcaggacctgagcgaggctatatcaaaagaggaggcagtctgtcaaggagataatctggacagatgcagcagtagcaacccacaaatgagcagttag

SEQ ID NO: 4593 - DNA, 516 bp, Artificial Sequence
  Description of Artificial Sequence: Synthetic coding sequence
atgttcccacctagcggacagtgggatcagacacggggagtggtcgtggtgtctgcatgggagacagatcatctctgtttctgcaattcgagcggatccacggggctgatcccaccctctcactttcaagccagacccttgtcgacgcttcccagaatggcccctacctggctgtccgacataccactagtgcagccaccgggtcaccaggatgtcagcgagcggcgattggacacgcagcgccctcaagtgaccatgtgggagcgcgacgtatcatctgatcggcaggagcccggacggagagggagatcttggggcctggaggggagccaagccctgagccagcaggcagaggtgattgttaggcaactacaagagttaaggcgcctggaggaagaggttcggttgttgcgggagacgtcgctacagcaaaagatgaggttagaggcccaggctatggagctcgaagcccttgcgagagctgagaaggcagggagggctgaggccgagggctag

SEQ ID NO: 4594 - DNA, 516 bp, Artificial Sequence
  Description of Artificial Sequence: Synthetic coding sequence
atgttccctccctccgggcaatgggaccaaacacggggagtcgtggttgtgtccgcctgggaaacagaccatctgtgtttttgcaacagctccggatcgaccggccttattccccctagccacttccaggcgaggcctctgagcacattacccagaatggccccaacgtggctcagtgacattccacttgtccagccaccaggccatcaggacgtctccgagaggaggctggacacccagcgaccacaagtgactatgtgggagcgggacgtctcttccgaccgacaagaaccaggaagacgcggaagaagctggggattggagggaagtcaagccctctcccaacaagccgaggtgattgtcagacagttacaagagcttcggcgattagaagaagaggtgagactgctgcgggagaccagtctccagcagaagatgagacttgaggcacaggcaatggagctggaggctttggcacgcgctgagaaggcaggcagagcagaagctgagggatag

SEQ ID NO: 4595 - DNA, 2190 bp, Artificial Sequence
  Description of Artificial Sequence: Synthetic coding sequence
atgttccctccatctggttctacgggccttattcccccaagtcattttcaggcgcgacccctgagcaccctgcccagaatggctcccacgtggctttcagacatacccctcgtgcagcctcccggtcaccaggacgtgtcagagcgcagactggacacccaacgtcctcaggtgaccatgtgggaaagggacgtctcaagcgaccgtcaggaacccggtaggagagggaggagctggggtctggaaggttcccaggcactcagccagcaggctgaggtgatcgtacggcagctgcaggaactgcggtggcttgaggaagaggtgtggctcctccgagagacatccttgcaacagaaaatgcggttagaggcccaagcaatggaactcgaagccctcgcccgagctgagaaggctgggcgtgccgaggcggaagggttgcgcgcagccctggcgggagctgaggtggtgcgcaaaaacctggaagagggtcggcagagggaattggaggaagtgcagcggttacaccaggagcagctttcttccctgacccaggctcatgaagaggctctgtcgagtctcacaagcaaggccgaaggactggaaaagtccctgtcaagcctcgagactagacgtgcaggggaagccaaagagcttgccgaggcgcagagagaggcagagctcttgaggaagcagttgagcaaaacacaggaggatctcgaagcccaggttaccctcgtagaaaacctaaggaaatatgtgggcgaacaggtgccctccgaagttcactctcaaacctgggagctggaacgtcagaagcttctcgaaacaatgcagcatcttcaagaggatcgggattccttgcatgccaccgcagagctgctgcaggttcgcgtacagagcctgactcatatcctcgccctgcaagaggaagagttaacccgtaaggtgcagccctccgactctcttgagcctgaattcacccgtaagtgccagtccctcttgaatcggtggcgagagaaggtgtttgcactcatggtgcagctcaaagcacaagagcttgagcactccgactccgttaagcagcttaaagggcaagtggcttcactccaggaaaaagtaacctctcagtcccaggagcaggcaatactacaacgctccttgcaggataaggcagcagaggtggaggtggagcggatgggagccaaggggctgcagctggaactcagtagggcccaagaggcaaggaggtggtggcaacagcagaccgcatctgccgaggaacagctaagacttgtggtgaacgcagtttctagttgccccctaccaccaccagtaacagacgtgtctcttgagctgcagcaactccgcgaagagcgcaacagattggatgccgagttgcaattatccgctcggctcatccagcaggaagtcggacgagccagggagcaaggcgaggcagagcggcaacagctttcaaaagttgctcagcaattagaacaggaattgcaacagactcaagagtccctcgcctctcttggcctgcaactggaggtggcccgacagtgccagcaggaaagcaccgaagaggccgcttccttgcgccaagaattgacacagcaacaagaactttacggccaggcactgcaggagaaagttgcggaggtggagacacgtctcagggagcagctgagcgatactgaacggaggctgaatgaagcaagacgcgaacacgctaaagctgtggtaagcctccgccagattcagagacgagcggctcaagaaaaagaacggagccaggaactgcggcgactacaggaggaagcgcgaaaagaagagggccaaagactggctcgcaggctgcaagagcttgaacgggacaaaaatctcatgcttgctacacttcaacaggaaggcttgctgagtcggtacaaacaacagaggcttttaacagtactgccttccctgctggataagaagaaaagtgttgtaagctcacctagacctccagaatgcagcgcttctgctcctgtagcggctgccgttccaacaagagaatccataaagggatcactctcagttcttctagatgatctccaagatctgagtgaggcgattagtaaggaagaagccgtctgtcaaggcgataacctagaccgctgctcctcttgtaacccccagatgtcttcctag

SEQ ID NO: 4596 - DNA, 2349 bp, Artificial Sequence
  Description of Artificial Sequence: Synthetic coding sequence
atgttccctccatccggttccaccgggctcatccccccttcccatttccaggccagaccgttgtccaccctgccccgtatggcccctacgtggctcagtgatattcccttagtacaaccgcctggccaccaggatgtgtcagaaaggcgtctggatacccaacggccacaggtaaccatgtgggagcgggacgtctcaagcgacagacaggagccgggacggaggggaaggtcttggggactcgagggcagtcaagcattaagccagcaggcggaggtcatcgtccgacagctacaagagcttagatggcttgaagaagaagtttggctgttaagggagacatcgctacaacagaaaatgagactcgaggctcaggcaatggagctcgaagctttggccagggcagaaaaggccggaagggccgaggctgagggtctgcgcgcagccctggccggagctgaggtggtgaggaaaaatctggaagaaggcagacagcgcgagctcgaagaggtacagaggctgcatcaggaacaactgtcctctctgacacaggcccatgaagaggctctatctagtcttactagcaaggccgagggccttgagaaaagcctgagctctctcgaaacccgccgtgcgggagaggccaaagagctggccgaggcacaacgggaagccgaactgctacgcaaacagctgtctaagacccaggaggacctggaggcgcaggtgaccttggtcgagaatttaaggaagtacgtcggcgagcaggttccctcagaagtccactcacagacctgggagttggagcgccaaaagctgttggagacaatgcaacatctgcaggaggaccgggattcacttcatgcgactgctgagttgctgcaagtgcgcgtacagagtcttacacatatccttgccctgcaggaagaggagctgaccagaaaggtgcagcccagcgattctttggaaccagagtttaccaggaagtgccagtcattgctgaatcggtggcgcgagaaggtattcgctctgatggtccagctcaaggcacaagagctagaacatagcgactcagtgaaacagctcaaaggccaagttgccagcttgcaggagaaggtcacgagccagtctcaggagcaggcaatcctacagaggtcactccaagacaaagccgctgaggtagaggtggagagaatgggtgctaagggattgcagttggagctgagtcgagctcaggaagctcgcaggtggtggcagcagcagactgcgtcggcagaagaacagttgagattagtggtcaacgcagtttctagcagccagatctggctggagaccacaatggccaaggttgaaggcgctgcagctcaactgcccagcttgaacaaccggttgagctacgcggtgagaaaggtgcatacaatccggggtttgatcgctcgcaaactggctttagctcagctgcggcaggagtcgtgtcccctgccccctcctgtcactgatgttagcttagagctgcagcagctgcgcgaggaacgcaatcggttggatgcagaactccagctgtctgccagactgattcagcaagaggtggggcgagcaagagaacagggggaggccgaacggcagcaattgtctaaggtcgcccagcagctcgagcaggagttgcagcagactcaggaaagcctcgcttcactaggccttcaactggaggtggccaggcagtgtcagcaagagtccacagaggaagccgcatcattgcgacaggagctgacacagcagcaggagctctatggccaggcactccaagaaaaggtcgcagaggtggaaacccgactgcgtgaacagctttctgacaccgagagaaggctcaatgaggctaggcgagagcacgccaaggcagttgtgtccctccgccagattcaaagaagggcagcgcaggaaaaggaaagatcacaggagttacggcgtctccaagaggaagcaaggaaggaagaaggtcagcggcttgcgagacggttacaggagctggagcgggataaaaacctgatgctggccacactccaacaagagggcttgctgtccaggtacaaacagcagcgactcctaaccgtgctgcccagcttactggataagaaaaaatccgtcgtgtccagtcccaggcccccagaatgtagcgcctcggcgcctgtggccgctgcagtacccacccgggagtccataaaaggctctctgtccgtattgctcgatgatttgcaggacctgtcagaagcaatctccaaggaagaggccgtttgccagggcgacaatttggaccgttgttcctcttgcaatccgcagatgtctagctag

SEQ ID NO: 4597 - DNA, 2349 bp, Artificial Sequence
  Description of Artificial Sequence: Synthetic coding sequence
atgttcccacccagtggtagtactggactgatacccccttcacacttccaggctcggcctctgtcaacactccctaggatggcacccacctggctctctgacattcccttggtacagccaccaggacaccaggacgtgtccgaaaggcgtctcgacactcagagacctcaagtgacaatgtgggagcgtgacgtttcatcagacagacaggagcccggtaggaggggacgctcctggggtttagaaggctcccaagccctgtcgcaacaggccgaggtgatcgtgcggcagctgcaggaactaaggagactggaggaagaggtgaggctgttgcgcgagaccagccttcagcagaaaatgcgactggaggcacaggccatggagttggaggctctggccagggctgaaaaagccggtagggcagaggcggaaggattgcgcgcagccctcgctggggcagaagtcgtaaggaaaaacctcgaggaaggtaggcaaagagaattagaggaagtccagcgtctgcaccaggaacagctgtcatctctgacccaagcccacgaggaagcgttgagctccctgacctccaaagccgaaggtctggagaagagcttgagcagcctcgagacacggagggccggagaggcaaaagagcttgccgaagcacaacgggaagccgagttgcttaggaagcagctgtctaagacacaagaggatttggaagcccaggtcaccctcgtagaaaaccttagaaagtatgtcggggaacaggttccctctgaggtccactcgcagacatgggagctggagaggcagaaattactagatactatgcagcacctgcaggaagacagggactcattgcatgctactgctgagctgttgcaagtgagagtccagtcccttactcatatacttgcattacaggaggaggagctgacgagaaaggttcaacccagtgactctcttgaaccggagtttaccaggaagtgtcagtccctcctcaatcgctggcgagagaaggtcttcgccctgatggtgcagctaaaggcacaggaactggagcacagcgactcagtcaagcagttaaaaggccaagtcgcaagccttcaggaaaaggtcacttctcagtcacaggagcaagccatcctccagcgatctttacaggacaaggctgctgaagtggaggttgagcggatgggggctaagggcctccaactggagctgagcagggcccaagaagcccgacgcagatggcagcagcaaaccgcatccgcagaggaacagctgcgtcttgtggttaacgctgtttcttccagccagatctggctagaaaccaccatggcgaaggtagaaggtgcagcagcacagctgcctagcttgaacaatcggttgtcttacgccgtccgcaaggtccacaccatccggggtctcatcgccagaaagctggccctggcccaacttagacaggaatcctgtccactgccgccaccagtgaccgatgtcagtctagagctccagcagctgcgcgaggaaaggaatagattagatgctgagctgcagttgtcagctaggctgattcagcaggaggtgggtagagcccgtgaacagggtgaggctgagcggcagcagctcagtaaggtggcccagcagctggagcaagaactccagcagacccaagaaagcctcgccagcctcgggctccagctggaggtggcacgccaaggacaacaggagtctacagaggaagccgcatcccttagacaggaacttacacagcagcaggagctctatgggcaagcactccaggaaaaggttgctgaggtcgaaacacgactgagagagcaactgtctgacacggagcggcgtctgaacgaagccaggcgcgaacacgcaaaggcagtcgtcagcctgagacagatccaacgcagagctgcccaggaaaaggagcggagccaggagctccggcgattgcaagaggaggcccgtaaggaagaaggccagcgacttgctcgcagacttcaggaactcgagagagacaaaaatctcatgctagccactctgcagcaggaaggcctgctgtcacggtacaaacaacagcgcctgctgactgtccttccttctcttcttgacaagaagaagtccgtggtgtcatcacccagaccacccgaatgttccgccagtgccccagtagcggctgcagtgcccactcgggaatccatcaagggcagcctgagcgtcctcctagacgacctgcaggatctgagcgaagctatttctaaggaggaggccgtttgccagggggataatctagatcgttgcagctccagtaacccccaaatgagcagttag

SEQ ID NO: 4598 - DNA, 384 bp, Artificial Sequence
  Description of Artificial Sequence: Synthetic coding sequence
atgttccccccttcgggccagtgggaccaaacaaggggcgtggtggtcgtctcagcttgggaaaccgaccatctctgcttttgtaacagtagtggctccactggtctcatccctcctagtcactttcaagccagacctctgagtacattacctaggatggcccctacatggctctccgacatacctttagtacaaccacctggacatcaggacgtttccgagcggcgtctggacacacaacgcccacaggtaaccatgtgggaacgggatgtgtcgtcagaccggcaggagccgggtcgcaggggcagatcgtgggggctggaagggtcacaagcactgtcccagcaggcagaagtgatcgttcgtcagttacaggagctgtag

SEQ ID NO: 4599 - DNA, 384 bp, Artificial Sequence
  Description of Artificial Sequence: Synthetic coding sequence
atgttccccccttcaggacagtgggaccagacaaggggcgtcgttgtagtgtcggcttgggaaacagatcatctgtgcttttgcaactcttccggctccacagggctcattcctccctcccacttccaggcacggcctttaagcaccctcccccgaatggcgccaacctggctaagcgatatccctttggtccaacctccaggccaccaggatgtgagtgagcgcaggctcgatacccaaaggccccaggtcaccatgtgggaacgggatgtgagttcagacagacaggagccaggcaggcgtggtcgatcctggggactggagggtagccaagcgctctcacagcaggccgaagtaattgtgaggcagcttcaggagctgtag

SEQ ID NO: 4600 - DNA, 516 bp, Artificial Sequence
  Description of Artificial Sequence: Synthetic coding sequence
atgttcccaccatcaggacaatgggaccagacacgcggagttgttgtcgtgtccgcctgggagaccgaccatctgtgtttctgcaattcttccgggagtacaggcctgatccctcctagccacttccaagccaggccactctctaccctgcctcggatggcccctacatggctctccgatataccgctagtgcaacctcctggtcatcaggacgtcagtgagaggcgcttggatactcaacggcctcaggtgaccatgtgggaaagagacgttagcagcgatcgccaggagcccggtagacgaggtagatcgtggggcctcgaggggtcccaggctctgtcccagcaagctgaagtaatcgtccggcaactccaagagttgaggtggttggaagaggaggtctggctgctcagagagactagcctgcagcagaagatgcgactcgaggcccaggctatggaactagaggccctagcccgtgctgagaaggccggacgcgcagaggccgagggttag

SEQ ID NO: 4601 - DNA, 771 bp, Artificial Sequence
  Description of Artificial Sequence: Synthetic coding sequence
tgaagactggacgccgagcttcagctctctgcgcgtcttatacagcaagaagtgggcagagcccgtgagcaaggcgaagctgaaaggcagcagctgagtaaggtagctcagcaattagagcaggaattacagcagactcaggaatctctcgcctccctggggcttcagcttgaagtcgctcggcagggccaacaggaatcaaccgaggaggccgcttcactgagacaggaactgacacagcagcaagaactgtatggacaggcgctgcaggaaaaggtggctgaggttgaaacccgactcagggaacaactgagcgataccgaaaggagactgaacgaagcccgacgggaacatgccaaagcagttgtaagcctgcgacaaattcaacggagggccgctcaggagaaggagagatctcaggagctgaggcgcctccaagaggaggctcgcaaggaagaggggcagcggctggcacgtagactgcaagagcttgagcgggataagaatcttatgctgcagcgcctcttaacagtcctgccttccttactggataaaaagaagtctgtggtttcctcacccaggccgccagagtgctccgcctctgccccagtcgcggctgcagtcccaacaagggagtccataaagggctcactctctgtcctgcttgatgatcttcaggatcttagcgaagctatcagcaaggaagaagcagtgtgccagggtgacaatttagatcgatgctcatcgtctaacccgcaaatgtcttcttag

SEQ ID NO: 4602 - DNA, 2349 bp, Artificial Sequence
  Description of Artificial Sequence: Synthetic coding sequence
atgttccctccaagtgggtctaccggcctgatacctcccagccattttcaagccagacccctgtccacgctcccgcgaatggccccaacttggctgagtgatattccattggtgcagccacccggacatcaggacgtttctgaaaggcggttggatactcaaaggccacaggtgacaatgtgggaaagggacgtaagctccgatcgacaggagccgggtaggaggggtcgaagctggggcctcgaaggatcccaggctctgtcacagcaggctgaagttattgtgaggcagttacaggagctgagaagactggaggaagaagttcggcttttgagggagaccagcttgcagcagaagatgcgactcgaagcgcaggcaatggaactggaggcactagccagggccgaaaaggcagggcgtgcagaagctgaaggcctccgcgcagcgctcgctggcgcagaggtggtcaggaagaatcttgaagagggtcggcagcgtgaacttgaagaagtgcaacgtctccaccaagagcaactctcttccttaacacaggcccatgaggaggctctgtccagtctcacatccaaagccgaggggttagaaaagtccctcagcagtctggagacccgacgggctggggaggcaaaagaacttgccgaagcccagcgggaggcagagctgcttaggaagcaactgtctaagacacaggaagatttggaggcacaggtgactctcgtggaaaatctccgcaaatacgtcggtgaacaggtgccctccgaggtccatagccagacatgggagctcgaacggcagaagcttctggataccatgcaacaccttcaggaagatagagactccctgcacgcaacagccgaactgctccaggtcagagtgcagtcactgactcacatcctggctctacaagaggaggagctgactcgtaaggtgcaaccctctgattccctggaacctgagtttacaagaaagtgtcagtcattgctgaatcggtggcgggaaaaagtgttcgctttgatggtgcagttgaaggcccaggagctggagcattcagacagcgttaagcagctgaagggccaggtggcaagcctacaggagaaagtgacatcccagagccaagaacaggcaatcctgcagcggtccttacaggacaaggcggctgaggttgaggtggagaggatgggcgctaagggactgcaattggagctgagccgcgcacaggaggcaagacgccgttggcagcaacagactgcatcagccgaagaacaattgaggctcgttgtgaatgccgtgtcaagctcccaaatttggctggaaactaccatggcgaaggtggaaggagctgctgctcagctaccgagcctcaacaatcgcctgagctacgccgtcagaaaggttcatacaatcagggggctgattgccaggaagctagccctggcacagctgagacaggagagctgcccactgccaccacctgttacggacgtctctttagaattgcaacagctcagagaggagcggaatcggctggatgcagagctgcagttgagcgctcgcctcatccagcaggaagttgggcgagcacgggaacaaggggaagcagagcgtcagcagctatccaaggtcgcccaacaactagagcaggagctgcagcaaacccaggaaagcctcgctagcctgggactgcagttagaagtggcgagacaagggcagcaggagtcaacggaggaagccgcatcacttagacaggagctgacacagcagcaggaattgtacgggcaggccctccaagaaaaagtggctgaagtggagacgcggttacgtgaacagctttcagacaccgagcggcgtttaaatgaggctcggagagagcatgcaaaagccgttgtgtccctgcgacagattcaacgtcgagccgcacaggagaaggagcgtagccaggaactgcgcaggcttcaagaggaagctagaaaggaggaaggccaacgcttagccaggcgcttgcaggaactggagagagataagaaccttatgctggccacgctccagcaagaggggcttttgtcacgctacaagcagcagaggctactgaccgtgctgcctagtctgctcgataagaagaaatctgtggtcagctccccacggccacccgagtgttccgcatccgcccctgtggcagcggcagttcccaccagggagtctatcaaaggtagcctgtcagtgctgctggatgatctccaggatctgagcgaagccatcagcaaagaggaggctgtgtgccagggcgataatcttgatcgttgtagctcttcgaaccctcagatgtcctcatag

SEQ ID NO: 4603 - DNA, 771 bp, Artificial Sequence
  Description of Artificial Sequence: Synthetic coding sequence
tagcggctggatgccgaactccagcttagtgcgagacttatccagcaggaagtgggcagagctcgtgagcaaggggaagcggagagacagcaactctcaaaagtggcccagcagttagaacaggaactccagcagactcaagaatccctcgcttctctggggcttcagctggaggtggcgagacaggggcagcaggaaagcacagaagaagcggcttccctgaggcaagagttaactcagcagcaggaactgtacggccaggctctgcaggagaaggtcgctgaggtggagacaagattaagagagcagctcagtgatacagaacgtcggctgaatgaggcaagacgggagcacgctaaggcggtcgtgtccctccgacagattcagcgcagagctgcacaggagaaagagaggagtcaggagctgcgcagactgcaggaagaagcccgaaaggaagagggtcagcgtctcgcccgtcgtctgcaggagctcgaacgcgataaaaatctcatgctgcaacggctccttaccgttcttcccagtttattggacaaaaaaaagtctgtagtctcaagtcccaggcctcctgagtgttccgctagtgctcccgttgcagcagcagtgccgactcgtgagtcaatcaagggatctctgtcagtgctactagatgaccttcaagacctgtctgaagcgattagtaaggaagaagctgtttgccagggagacaacctcgacagatgttcttcttctaacccccagatgagttcatag

SEQ ID NO: 4604 - DNA, 771 bp, Artificial Sequence
  Description of Artificial Sequence: Synthetic coding sequence
tagcgccttgacgctgaattgcaactcagcgcgaggctaatacaacaggaggttggccgtgctagagaacagggcgaagcagagcggcagcagctttccaaggttgctcagcagctggaacaggagttgcagcagacccaggaatccctggcttctctggggctccaattagaggtcgctaggcaatgtcaacaggagtctacagaagaggccgcatctctccgccaggaacttacccagcagcaggagctctatggtcaggcgctccaggagaaggtggccgaagttgaaactcgtcttagagagcagttgagtgacaccgagaggcggctaaacgaagcgcgacgagagcacgctaaagccgttgttagtcttcgtcagattcagaggcgggctgctcaggaaaaggagagaagccaagagcttcgcaggctgcaggaggaggcccgtaaagaagaagggcaaagactggctaggaggctccaagagttggagagggataaaaatctaatgctgcaaagattgctcacagtgctgccatccctactggacaagaagaaaagcgtcgtgtcatcacctcggccacctgagtgtagcgcctctgctcctgtcgccgcagcagttccgacgcgcgaaagcatcaaggggtctcttagcgtactcctggacgacctgcaggatctgtcagaagcaatcagcaaagaagaagctgtatgtcagggggataatcttgatcgctgcagcagctgtaatccgcaaatgtctagctag

SEQ ID NO: 4605 - DNA, 516 bp, Artificial Sequence
  Description of Artificial Sequence: Synthetic coding sequence
atgtttccgccaagcgggcagtgggatcagacccgaggagtggtggtggtgtctgcatgggagacagaccacctgtgtttttgtaactccagcgggtccactgggctgatccccccatcccacttccaagccagacccttgtctaccctgcccagaatggctcctacttggctgtctgatatccccttagtgcagcctcccggtcaccaggacgttagcgaacgccgactcgacactcaacgccctcaggtcaccatgtgggagagggatgtttcctccgacaggcaggagcccggaaggcggggtcgtagctgggggttggagggctcccaagcattatcacagcaggcagaagtcatagttagacagcttcaggaattacgccgattggaagaggaagtaagactgctgcgggaaacctccctgcagcagaagatgcggttagaagcgcaagctatggagttggaagccttagcccgagccgagaaagctggcagggccgaggctgaggggtag

SEQ ID NO: 4606 - DNA, 462 bp, Artificial Sequence
  Description of Artificial Sequence: Synthetic coding sequence
atgttccctccctccggaagtacaggcctgattcccccaagccattttcaagccaggccccttagcactttaccacggatggccccaacctggctgtctgatataccgctggtgcagccacctggacaccaggacgttagtgaaaggaggctcgatacccagcgaccacaggtgaccatgtgggagcgggatgtgtccagcgatagacaggaacctggacgtagaggaagaagctggggtctggagggatctcaggcacttagccagcaagcagaagtcatagtgagacagctacaggaactacgtcggttagaggaagaggtaaggcttcttagagagacctcattacagcaaaagatgaggctggaggcccaggccatggagctcgaggctttggctagggcggagaaggctggtcgagccgaggccgaaggcctccgggctgccctcgccggtgcctag

SEQ ID NO: 4607 - DNA, 462 bp, Artificial Sequence
  Description of Artificial Sequence: Synthetic coding sequence
atgttccccccttcaggatctaccggcctcatacccccatcccatttccaggcgagacccctctctaccctgcctcgcatggcgcctacatggctgagcgatatacctctggtgcagcccccagggcatcaggatgtaagtgaacggagactcgacacccagcgccctcaagtgaccatgtgggagcgagatgtgagctcggaccgccaggagccaggtcgccgtgggagatcttggggcctggaaggatctcaggcactgtcacagcaagctgaagtcatagtgcgacagttgcaggagctgcggagactcgaggaagaggtaagactgctgagagagacatctttgcaacagaagatgaggctcgaagctcaggctatggaactggaagcgctggcaagggcggagaaggccggacgggctgaagctgaggggttaagagcagcgctggcaggtgcttag

SEQ ID NO: 4608 - DNA, 2349 bp, Artificial Sequence
  Description of Artificial Sequence: Synthetic coding sequence
atgtttcctccttcagggtctacaggccttatcccaccgagccacttccaagccagaccactgagcaccttaccaaggatggcacccacctggctgtcagacatcccattagtgcagccacccggacatcaggatgttagcgagcgtcgactcgatacccaaagaccgcaagtaacaatgtgggaacgagatgtcagttcagaccgacaggagccaggaaggcgtggtaggtcttggggattggaaggcagccaggctttgagccaacaagccgaagtaattgttcggcagctccaagagctccggtggctcgaggaagaagtgtggttactgagagagacctctcttcaacagaagatgcgactggaggcacaggctatggaactggaggcactggccagggcagagaaagctggtcgcgcagaggctgaaggcctgcgggctgccctggctggggcagaagtggttcgtaagaatctcgaagaggggcgacagcgcgaattggaggaggtgcagcggcttcatcaggagcagctgagctccctgacccaagctcatgaggaagcactgtcaagtcttaccagcaaagctgaggggctggagaaatctctgagcagtctggagacccgaagggcaggcgaagccaaggagctggccgaagcgcagagggaggcggaattattacgaaagcagctctcaaagacacaggaggatctcgaggctcaggtcacactggtggaaaatctgcggaagtacgttggagaacaggtcccctctgaagtgcattcccagacgtgggaattggagcgccagaagttactggaaacgatgcagcatctgcaggaggatagggacagcctacacgctactgccgaacttctgcaagtgcgggttcagtcactgacacacattttggccctccaggaggaggagctgaccagaaaggtgcaacctagcgatagtctggagcccgagttcactcgtaagtgtcagtctttgctcaacaggtggagagagaaggtgttcgccttaatggtccagctgaaagcccaagagttggaacattctgacagcgtgaagcagctaaaagggcaggtcgccagtttgcaagaaaaagtaactagccagtcccaggagcaggctattttgcagcgcagcctccaagacaaggcagcggaggtggaagtagaaagaatgggtgcaaaaggtctgcagttagagctgtcacgagcacaggaagcccgtcgatggtggcagcaacagacggcgagcgccgaggagcagttgcggcttgtggttaacgctgtctcttcaagccagatatggctggagaccaccatggccaaggtggaaggtgcagccgcacagctgccatctctgaacaatcggctgagctacgctgtccgcaaagttcacacgataaggggccttatagcccgaaagctcgccttagcccagctcaggcaggaatcttgtcccctgccacccccagttactgacgtctcactcgagctgcagcagctgcgcgaggaaagaaacaggttggatgccgaactgcaactgtccgcacgactgattcagcaggaggtggggcgtgcccgtgaacagggagaggccgagaggcaacagttgtctaaagtggcacagcagctcgaacaggagctgcagcaaacccaggagtccctggcttctctgggccttcaactcgaagtcgctcggcagtgtcagcaagagtccaccgaagaggcagccagcctgcggcaggaacttactcagcagcaggagctctatgggcaggcactgcaggagaaggtggctgaagtcgagactagattaagagaacagttgtcagataccgaacggaggctcaacgaagccaggagagagcacgccaaagccgttgtatcgctgaggcaaattcagcgacgggctgctcaagagaaggaaagatcacaggagctgcgacgcctccaggaagaggcacggaaagaggagggacagagactggctcgtagactacaagagctggaaagggacaagaaccttatgctggccaccctgcagcaggagggattgctctcgcgttacaaacagcagaggctgctgaccgtcctgccttcgcttctggataaaaagaagagtgtcgttagttcacctcgcccacccgagtgctcggccagcgcccctgttgctgccgctgtcccgacaagggagtccattaaaggaagcttgtctgtcctgctggacgatctccaggacctgtccgaagctatctctaaagaagaagctgtctgccagggcgacaatctggatagatgtagcagctgcaacccccaaatgtcctcatag

SEQ ID NO: 4609 - DNA, 651 bp, Artificial Sequence
  Description of Artificial Sequence: Synthetic coding sequence
atgtggcctcattctgcaggtgcccgaccctgggcaagcacactcaccgggaaagatccccgtgtcatggcctgttggtgtttagacggcctaccaagcggacttgcggaaccatggcgcgaactgtggcggtggcgatctcgacccctgcactgtgtgcctccgtttagccccctagcacgctcttcccgtgatcataggaacctgcgacgccgagtggaagctctgccacgaattctaaaaggcaacatcgatggctggcggcagaacttggaaccttctaataacgtagagatgttccccccaagcggctccacaggccttataccaccttctcatttccaggctcgacctttgtccaccctcccgcgtatggctccaacttggctctccgatatcccactggttcagcccccagggcaccaggacgtttctgagcgacgccttgacacccagagaccacaagtgaccatgtgggagagagatgtgtcatccgaccgccaggagccaggaaggcggggaagatcctggggactcgaggggtctcaggcgctatcacagcaggccgaagtcatagtgagacaactccaggaactacgcaggctggaggaggaagtccgactgttgcgcgaaactagtttacagcaatag

SEQ ID NO: 4610 - DNA, 357 bp, Artificial Sequence
  Description of Artificial Sequence: Synthetic coding sequence
atgttccccccatctgggtctacaggcctgattccaccaagccactttcaggctcgccctctgtcaacactgccaaggatggccccaacgtggctcagtgatataccactggtccagcccccaggacatcaggacgttagcgagcgccgtcttgacacccagagaccccaggtcaccatgtgggaacgagacgtgtcttctgaccggcaggagccaggcagaaggggcaggtcttgggggcttgaaggatcccaggccctcagccagcaagcggaggttattgtccgccagctacaggagttaagacggctagaggaagaagttcgcctgctgagagagacatctctccagcagtag

SEQ ID NO: 4611 - DNA, 384 bp, Artificial Sequence
  Description of Artificial Sequence: Synthetic coding sequence
atgtttccgccatctgggcagtgggatcagaccaggggcgtcgttgttgtatctgcttgggaaacagatcacctttgcttctgtaactccagcggcagtacagggctgattccgccttcccacttccaggcaaggcccctgtccactctcccacggatggctcctacgtggctgtcagatatcccactggtccagcctcccggtcatcaagacgtgtcagaaagacgtttggacacacagagaccacaagtgaccatgtgggaacgcgacgtgtcttctgatagacaagagcccggaagaaggggacgctcatggggactcgagggcagccaggcgctatcacagcaggctgaagtgattgtgcgccagttgcaggagctgtag

SEQ ID NO: 4612 - DNA, 2190 bp, Artificial Sequence
  Description of Artificial Sequence: Synthetic coding sequence
atgtttccaccgtccggtagtactggactgatcccaccatctcacttccaggccagacccctcagcactctcccaagaatggcaccaacctggctaagcgatattcccctggtgcaaccaccaggccaccaggacgtgtctgagcggagattggacacgcagcgtcctcaagttacgatgtgggagagggatgtgagctcggatagacaggaacccggtaggcgcggtcgctcttggggactagagggatcacaggccctgtcccagcaggctgaggtgattgtgcgacaactgcaggaactcagaaggctcgaagaggaggtaagattactgcgtgagacaagtctgcagcagaagatgcgactggaagctcaggccatggagttagaggccttggctcgagccgagaaggctgggagggctgaggcagaaggactgcgcgcagcattagctggtgcggaggtggtacgcaagaatttggaagagggacgacaacgcgagcttgaggaggtgcagcgattacaccaagaacagctgagcagcctgacacaggcccatgaggaggccctatcgtcactaactagtaaggccgaggggctggaaaaatccctctcctcattagagacacggagggctggagaagccaaggagctcgccgaggctcagcgagaggctgagctgctgcggaagcagctctctaagacgcaagaagatctggaagctcaggtcacccttgtggaaaatctccggaaatacgtgggggagcaggtcccttctgaagtccacagccagacatgggagttggaacgacagaagttactcgataccatgcagcaccttcaggaggaccgtgactccctacacgccactgcagaactgctgcaagttagggtccagagcctcacacatattctcgcattgcaggaggaggagctcacccggaaggtgcagccttcggactccttagaacctgaatttacccgcaaatgccagtcactcctgaatcgatggcgagaaaaagtgttcgctttaatggtgcagctgaaggcccaggaactcgaacactcagatagtgtgaaacagcttaaggggcaggtggcatcactgcaggaaaaagtgacctcgcagtcccaagagcaagcaattctgcagcgctccctgcaagataaagccgcagaagttgaggtggaaaggatgggggcaaaaggcttacagctggaactctcaagggcccaggaagcacggaggaggtggcagcagcaaaccgcatccgcagaagagcagttgcgcttggtcgtgaacgccgtctcctcctgcccattgcctccaccggtgaccgatgtgtcgctcgagctccagcagttgagggaggagagaaataggttagacgctgaactgcagctttctgctagactaatccagcaggaagtgggtcgcgcacgagagcagggcgaggctgaacgccagcagctgagtaaggtagctcagcaattggaacaggaactgcagcagactcaagaatcattggcctccctcggtttacagttagaagtcgctagacagggccagcaggagtcaacagaggaggcagctagtttgcgacaggagctcacacaacagcaggaactttacggacaagcactgcaggaaaaggtggccgaggttgaaacaaggctcagagagcaactatcagatactgaacggagactcaatgaggcccgacgggaacatgctaaagccgtagtgtcgctgaggcagatacagcggcgtgctgctcaggagaaagaaagatcacaggaactgcgtcggctccaggaagaagcgaggaaggaggaaggacagcggctggccagaaggttgcaggaattggagagagacaagaatctcatgcttgctaccctacaacaagagggtcttctgagtcgctataagcagcagcgcctgctgaccgtcttaccctctttattggacaaaaagaagtccgtggtttctagcccaaggccgccagagtgcagtgcttcggctccagtcgcagccgcagtgccgactcgtgagtcaattaaagggtccctaagcgtactgctggatgacctgcaagacctaagcgaggcaatatctaaagaggaagcagtgtgccagggtgataacctggatcgttgtagcagtagtaaccctcaaatgagctcctag

SEQ ID NO: 4613 - DNA, 951 bp, Artificial Sequence
  Description of Artificial Sequence: Synthetic coding sequence
atgttcccaccatccggacaccaggacgtctccgagcggaggctggatacacagagaccacaggtgaccatgtgggaaagagacgtttccagtgatcgccaggaacctggaagacgtggcagatcttggggactggaggggtcccaggctctgtcgcagcaggccgaagtgattgtacgtcagctccaagagctgagacgactcgaagaggaagttagattgctacgcgagacatctttgcagcagaaaatgcgcctcgaagcccaggccatggagctcgaagcactggctagagccgaaaaagccggacgtgctgaagctgaaggtctacgggctgccctggcgggagcggaagtggtccgaaagaacctggaagaaggcagccagcgcgagcttgaggaggtccaacggctgcatcaagaacaactttcttctctcacccaggcacatgaggaggcattgagtagcctgacctccaaggcagagggactagaaaagagtctcagtagcctcgaaacccgccgtgccggagaggctaaagagcttgcagaggctcagagagaggccgaactcctcaggaaacagttgtcaaagacacaggaggatctggaggcacaggtcactctggtggagaacttacggaagtatgtgggagaacaggtgcccagcgaggtgcacagtcaaacatgggagctggagcgccaaaaactgctggagaccatgcaacacttgcaggaagacagagatagcctccacgccaccgccgagcttctccaagtgagagtccagtccctgacacacatactagcccttcaagaagaagaactaacaaggaaggtgcagcctagcgacagcctggagccggagtttacccgcaagtgtcaatcacttctgaatcgttggcgtgagaaagtttttgctctgatggtccagttgaaggctcaggagtag

SEQ ID NO: 4614 - DNA, 771 bp, Artificial Sequence
  Description of Artificial Sequence: Synthetic coding sequence
tagcgcctggatgccgagctgcagctgagtgcccgtctaatccagcaggaggtgggaagggcgagggaacagggagaggcagaacgccaacaactctccaaggtggcgcagcaacttgaacaggagctccagcagacccaggagtccctggccagcctgggtctacagctagaggtggcacgacaggggcagcaagagtctaccgaggaggcggctagcctccgccaggagttgacccagcaacaggagctgtacgggcaggcactgcaagaaaaggtcgccgaagtcgagaccagactgagagagcagctttccgacacagaacgtagactgaacgaggcaagacgagaacatgccaaagctgtggtctcactgcggcagattcaaagaagagctgcccaagagaaagagagatcccaggaattgaggagactgcaggaggaggctaggaaggaggagggccagagattagccagaagactgcaggagctggagcgggacaagaacctcatgctgcagcgcctgctgactgtgcttccttccctcctggataagaagaagtctgtagtcagcagcccgaggcctcctgaatgttccgcctccgcccctgtggctgccgctgtccctacgagggaaagcatcaaggggagtttgtcagtgcttctggacgatctacaggatctttcagaggcaatctctaaggaggaagcagtatgtcagggtgataacctggacagatgctcatcctctaatcctcagatgagcagttag

SEQ ID NO: 4615 - DNA, 357 bp, Artificial Sequence
  Description of Artificial Sequence: Synthetic coding sequence
atgtttcccccttcgggcagcacaggcctgattccaccgtctcactttcaggcaagacctctgagtacactgccccgaatggctccaacttggctgtctgatattcccctagtgcagcccccagggcatcaggacgtgagtgagcgtcgcttggatacacaacgcccacaggtaaccatgtgggaaagggacgtgtcctctgatcggcaggagccaggaaggaggggacgaagctggggcctggagggttcacaagccctctctcagcaggcagaagtgatagtcaggcaattacaggagctgcggaggctagaagaggaagtgaggctgctgcgggagacaagcctgcagcagtag

SEQ ID NO: 4616 - DNA, 2349 bp, Artificial Sequence
  Description of Artificial Sequence: Synthetic coding sequence
atgtttcccccatcagggagtaccgggctcatcccgccatcccactttcaggctaggcctttgtccaccctcccacgtatggcacctacctggctgagcgatattccgctcgtccagcctccagggcaccaagacgtgagtgagagacgccttgacactcagaggcctcaggtaacaatgtgggaaagagacgtgtcttcagacagacaggagcctggacgtaggggcaggagctggggcttggagggctctcaggccctctcccagcaggccgaggtgatagtgaggcagttgcaggagctgcgcaggttagaagaagaggtgagactgcttcgtgaaacatccctgcagcagaaaatgagacttgaagcccaagctatggagttagaggccctggctcgagccgaaaaagctggccgtgctgaggccgagggcctgagagccgctcttgcaggtgcagaggtggtgcggaaaaacctggaggaagggagacagcgggaacttgaggaagtccagaggcttcaccaggaacagttgagttctctaactcaggcacacgaggaggcactttccagtctgacttccaaagcagagggcctggaaaagtctttatcctccctcgaaacgcgacgagcgggtgaagccaaagaactggctgaggcccagagagaggcggagctgttacgaaaacagctgagcaaaacacaggaggacttggaggcgcaggttaccttggtcgaaaacctaaggaagtacgtaggtgagcaggtgccctcagaggtgcactctcagacctgggaactggagagacaaaaactgctggacacaatgcagcacctgcaagaagaccgggactcactgcacgcaaccgcagagctgctacaggtcagagtacagtccctgactcacatcctggcactccaagaggaggagttaacccgcaaggtacagccgtccgatagcctggagccggagttcaccagaaagtgtcagagcctgctcaaccgctggcgggagaaggttttcgccctgatggtgcagttgaaggcccaggagttagaacattctgactcagtgaaacagctcaaggggcaggttgcctcactgcaggaaaaggtgacatcacaatcccaagagcaagctattctgcaacgatccctccaggataaagcagcggaggtcgaggtggagaggatgggggctaaagggcttcaattagagctgagtagggctcaggaggccagaagacggtggcagcagcagacagcctcggccgaggagcagctgcgactggttgtgaatgcagtgagtagctcccagatttggttggaaactaccatggccaaggtggaaggcgcagcagcacagctgcctagtctgaacaacaggctttcatatgccgttaggaaggttcacacaatccggggtcttatcgcccgaaaactcgccctcgctcaactccgccaggaatcttgccccttgccaccaccggtaaccgacgtgtctctcgagctgcagcaattgcgcgaagaacgcaacagactggacgcggaactccagctctccgccaggctgattcagcaggaagtgggtagggcacgtgagcagggagaggcggaaagacagcaactgtcaaaagtagcccaacagttagaacaggaactccagcagacacaggagagtctagctagcctcgggttgcagttggaagtcgcaagacagggccagcaggagagcaccgaggaagccgcttctctccggcaggagctgacccagcaacaggagctgtacggacaggcgctccaggagaaggtagccgaagttgagacgcgacttcgcgaacagttgagcgatacggagaggcgactgaatgaggcgaggagagaacacgccaaggccgttgttagtcttaggcaaatccaacgccgagccgctcaggagaaggaaaggagccaggagctaaggaggctgcaggaggaggccagaaaagaagagggccagagacttgcacgcagactccaagaattggagagagataagaatctgatgctcgcaacactgcagcaggagggactcctctctcggtataagcagcagcgactgcttaccgtgttgccatctctactcgataagaaaaagtccgtggtgtcatcccctcggccaccagaatgctccgctagcgccccagtcgctgctgcagttccaacccgagagtccattaagggatccctgagcgtgctgctggacgaccttcaagacctgtctgaagccatctccaaagaagaggctgtctgccagggtgataacctcgatagatgttcctccagcaatccacaaatgtccagttag

SEQ ID NO: 4617 - DNA, 384 bp, Artificial Sequence
  Description of Artificial Sequence: Synthetic coding sequence
atgtttcccccttctggacagtgggaccaaacaagaggcgtggtcgtggtctctgcctgggagaccgatcacctgtgcttctgtaacagttccggatcgacagggctaatcccaccaagccatttccaggccagacctttgagtactctgccgaggatggctcctacatggctgagcgacatacctcttgtccagcctccaggacatcaggatgtgtcggagaggaggctggacacacagcggcctcaggtgacaatgtgggagagggatgtttccagtgacagacaggaacccggaagaagaggtagaagctggggtctggaaggtagtcaagccttatcccaacaggcagaggttatcgtcagacagttgcaggaactctag

SEQ ID NO: 4618 - DNA, 462 bp, Artificial Sequence
  Description of Artificial Sequence: Synthetic coding sequence
atgttccccccttccggatccactggcctgattccaccttcccatttccaggccaggccactgtctacacttcctaggatggctcctacatggttaagtgacatccccctggttcagccgcctggtcatcaagatgtcagcgagcggagactcgatacacagcggccacaggtgacaatgtgggagcgtgacgtctctagcgacaggcaggagcctggccgtcggggacgttcatggggacttgaagggagccaggctctctcacagcaagctgaagtcatagtgcggcagctccaagaacttagatggctggaggaggaagtctggctgctgagagagacttcattgcagcaaaagatgcgcttggaagcgcaggcgatggagcttgaagcccttgcgcgtgccgaaaaggctggaagggccgaagctgagggcctccgtgctgctctagctggcgcatag

SEQ ID NO: 4619 - DNA, 384 bp, Artificial Sequence
  Description of Artificial Sequence: Synthetic coding sequence
atgtttccccctagtggacagtgggaccaaacacgtggggtggtggttgtgtcagcctgggagactgatcacctatgcttctgtaacagtagcgggtccactggcctcatccctccctcccactttcaggctcggccactgtctaccctgccgaggatggcacctacatggctcagtgacattccacttgttcagccacctggacaccaggacgtcagtgagcggaggttggacacccagcgtccgcaggtcacaatgtgggagcgcgatgttagctcagataggcaggagcccggacggcgaggcagatcgtggggcctggaggggagtcaggctctctctcagcaggccgaagttatagttaggcaactgcaggagctgtag

SEQ ID NO: 4620 - DNA, 567 bp, Artificial Sequence
  Description of Artificial Sequence: Synthetic coding sequence
atgttccctccatctggaagtactgggttgatacctccttcccactttcaggccagacccctgagtacattgcccagaatggctcccacctggctttccgatatccccctcgtacagcctcctgggcaccaggacgtttccgagagaaggctggacacccaacggcctcaggtaacaatgtgggagcgagacgtctcgtcggacagacaggaaccgggaaggagggggcgatcctgggggctggaaggatcccaggccctgtcccaacaggctgaggtaattgtgcgccaacttcaggagctccgacgtcttgaagaggaagttcggctgctgcgggagacttcacttcagcaaaagatgcgactggaagcccaagccatggagctcgaggcgctcgccagagctgagaaggctggacgagccgaggcagaaggactgcgtgctgctctggcaggcgctgaagtggtaagaaagaatctggaggaagggcgacaacgggaacttgaagaggtgcagcggctccaccaggagcaactgagctcccttacccaggcccatgaagaatag

SEQ ID NO: 4621 - DNA, 567 bp, Artificial Sequence
  Description of Artificial Sequence: Synthetic coding sequence
atgtttcctccctcagggtcaaccggccttatccctccatcccactttcaggctcggccactttcaactctgcccaggatggcacctacttggctttccgacatacccctcgtgcagccacctgggcatcaggacgtctccgagcgccgactggatactcagcgtccacaggtcacaatgtgggaacgcgacgtgagctctgataggcaggaacctgggaggcgcggaaggtcatgggggctcgaaggtagtcaagctttgagccaacaagccgaagtgatcgtgcggcaactgcaagagctccggtggcttgaagaagaggtctggctattgcgggaaacctcactgcagcagaaaatgcgcttggaggctcaggctatggagttagaggccctggcgagagccgaaaaagctgggagggccgaggctgaaggtctgagggcagccctggcaggagccgaagtggtgagaaagaacctggaagagggacgtcaaagagagctcgaggaggttcagaggctgcaccaggaacaactctctagcctcacacaagctcatgaggaatag

SEQ ID NO: 4622 - DNA, 951 bp, Artificial Sequence
  Description of Artificial Sequence: Synthetic coding sequence
atgtttcccccaagcggacatcaggacgtgtcagagcggcgtttggatacgcagcgcccacaggtaaccatgtgggaaagagatgtgtctagcgacaggcaggagcccggtcgcaggggtagaagttggggcctcgagggatcccaggctctgtctcagcaggccgaggttattgttcgccagctccaggaactgcggcgactggaagaagaggtgagactcttgagggaaactagccttcagcagaaaatgcggctggaggcacaggcaatggagctggaagcactcgccagagccgagaaagctgggagagccgaagcagaaggcctacgggcagccttagcaggggcagaagtggtcaggaaaaacttggaggaaggcagacagcgcgaactggaggaggttcagagactgcatcaagaacagctgtcttctctgacccaagctcacgaagaagccctgagttcgctaaccagcaaagctgaagggctggaaaagtctttgagcagcttggagacaagacgggctggagaagccaaggagcttgcggaggctcagcgtgaggccgaactgctcagaaagcagctgtcaaagactcaagaggatctcgaagctcaagtcacgctggttgagaatctccggaaatatgttggcgaacaggtgccctctgaagtgcactctcagacttgggaactggaacgccagaaattgctggacacgatgcagcatttacaggaggatcgcgattctctgcatgctaccgccgagctgctgcaggtcagagtgcagtcccttacccatattttagctttacaggaagaggaactgacccgcaaggtccaaccctctgactctctggaacctgagtttacccggaagtgccagtccctgctcaatagatggcgggaaaaggtctttgccctgatggtacagctgaaagcccaagaatag

SEQ ID NO: 4623 - DNA, 567 bp, Artificial Sequence
  Description of Artificial Sequence: Synthetic coding sequence
atgtttccaccatctgggagtaccggacttataccgccttctcacttccaggccaggccgctctccacacttccaagaatggctccaacctggttgagtgatataccactcgtgcagccccctggacaccaagacgtgagcgagcgtaggctcgacacacagcgccctcaggtgacgatgtgggaacgggacgttagctcagaccggcaagagccaggacggagggggcgatcatgggggctggaggggtcgcaggcgttgagtcaacaagccgaggtcatcgtaagacagctccaggaactgcggcgtttggaggaagaggtgcgactactcagagagactagcctccaacagaagatgagactggaggcacaggcaatggaactggaagctctcgccagagccgaaaaagcgggtagggctgaggccgaggggttgagagcagcccttgcaggcgctgaggtcgttcgtaagaatctcgaggaaggtagccaaagggagctggaggaagtacagcgtttacaccaggaacagctgagcagcctgacccaggcccacgaagaatag

SEQ ID NO: 4624 - DNA, 2307 bp, Artificial Sequence
  Description of Artificial Sequence: Synthetic coding sequence
atgtttccccctagcggcagcacagggttgatcccaccctcccacttccaggcacgcccactgtctacactcccccgtatggcgccaacctggctgtccgacattcctctggtacaaccaccaggccaccaggatgtctctgagcggagactcgacacacaacgcccacaggtaacaatgtgggagcgtgatgtgtcaagcgacagacaggaaccagggagacgcggaaggtcatggggactcgagggctctcaggcattatcacagcaagcagaagtcatcgtccgtcaactgcaggagctgcgcaggctggaggaagaggtccggctactgagagaaactagtctccaacagaagatgcggctggaagcccaggctatggagctggaagctcttgcaagagccgagaaggcaggtcgggctgaggccgagggtctacgcgctgctctggccggtgcagaggtcgtgaggaaaaatctggaagaaggcagccagagagagctggaggaggtgcagagacttcaccaggagcagctttccagtcttacacaggctcacgaggaagctttgagctcgcttactagtaaagccgaaggtctggaaaagtcgctttcctccctcgaaaccagacgcgcaggcgaggccaaagagcttgctgaggcccaaagagaagccgagttgctgcgcaagcaactgtccaaaactcaagaggacctggaggctcaagtaactttagtcgagaatctgcggaaatatgtgggcgagcaggtgccgtccgaggtccatagccagacctgggaactggagcgccagaaattgcttgaaactatgcagcacctccaggaagaccgagactctctgcatgctaccgctgaactgctgcaggtacgggtacagagtctaacccatatactggcactacaagaggaggagctaaccagaaaagtgcaaccctcagattccctggagcccgagtttactcgcaagtgtcaaagtctgctgaatcgctggagggaaaaggtgttcgccttaatggtacagctgaaggctcaggaacttgaacattccgattctgtcaagcagctgaaaggacaagttgccagccttcaggagaaagtcacctcacagtcacaggaacaggctatcctccagaggtccctgcaggataaagctgctgaggttgaggtagaaaggatgggggcaaaaggcttgcagctggagctctctcgggctcaagaagctcgcaggagatggcaacagcaaaccgcgagcgccgaggaacaactaagactggtggttaatgcagtgtcatcttcacagatctggctggagacaacaatggctaaagtggagggagctgcagcccagttaccaagtctcaacaatcggctttcttacgctgtgcgcaaggtgcatactattcggggactgatagctcggaaacttgcacttgcgcagcttcgccaggaatcctgtccactccctccacccgtgaccgacgtgtctctggagctacagcagctgcgagaggaaagaaatcgcctggatgctgaactgcagttgtcagccaggctcattcagcaggaagtggggagagccagagaacagggtgaggcagaaaggcagcagctgtcaaaggtcgcacagcaacttgagcaggagctccagcaaacacaggagtcgcttgcaagtctggggctgcagctggaggtcgcaaggcagggccagcaagagagcaccgaggaagccgcatcactccgacaggaactcacacagcaacaggaactctacggccaggctctgcaggagaaggtcgcggaagtcgagacccgcctgagagagcagctgtctgacactgaacggagactcaacgaggcgaggcgggagcacgcgaaagccgttgttagcttaaggcagatccagagacgagcagcccaggagaaggagagatcacaggaactccgaaggttgcaggaggaagccagaaaggaggagggccagagattggctcggcgtctccaggagctggaacgtgacaaaaatctgatgctgcagaggctgctcaccgtgctgccatctttgctagataaaaaaaagagtgtggtctcatcaccaagacccccagaatgtagcgcaagcgcaccggtggccgctgcagtgcctacccgagagtccatcaagggcagcctgagtgttcttcttgatgacctgcaggatctatctgaagctatctcaaaagaggaagctgtatgccagggcgacaaccttgaccgttgcagctccagtaatccccaaatgtcttcctag

SEQ ID NO: 4625 - DNA, 951 bp, Artificial Sequence
  Description of Artificial Sequence: Synthetic coding sequence
atgtttcctccaagtgggcaccaggacgtatctgaaaggagattagatactcagcgcccacaagtgacaatgtgggagcgggatgtttcgtccgatcggcaggaacccggacgtaggggccgttcatggggcctggagggatctcaggccctcagtcagcaggctgaagtaattgtgagacagctccaagaactacgctggctggaagaggaggtgtggctgctccgggaaacctctctgcagcagaagatgcggctcgaggcccaggccatggagcttgaggctctagcgagggctgaaaaagctgggagggccgaagctgagggcctcagagctgctctcgccggagctgaagtggtgcggaagaatctggaagaaggacgccagcgggagttggaagaggtccagaggctccatcaagagcagctcagtagtttgacgcaggctcatgaggaagccctgtcatcactcacttccaaagccgagggactcgaaaaaagtctgtccagtttagagacacgaagggctggcgaagccaaggagttagcagaggcccagcgggaggctgagttgttaaggaaacagctgtcaaaaacccaggaggatcttgaagcacaagtgaccctggtggaaaatctgcgtaagtatgtgggagaacaagtgcccagcgaagtccattcccagacttgggagctggagcgacagaagctactggaaaccatgcaacatcttcaggaggatagagactcactccacgcaactgcagaattgttacaagtgagggtccagagcctgactcatatcttagccctgcaggaagaagaacttactaggaaagtgcagccgagtgatagcctggagcccgaattcacccggaaatgtcagtcactactcaatcgctggagggagaaagtttttgccttaatggtgcagctgaaggctcaggaatag

SEQ ID NO: 4626 - DNA, 357 bp, Artificial Sequence
  Description of Artificial Sequence: Synthetic coding sequence
atgtttcccccttctgggtcaaccggtcttattccgccatcgcactttcaggcgcgtcccctgtcaaccctgcctaggatggcccctacatggctgtcggacattccgctggtgcagccacctgggcatcaagatgtgtcagagagacgattggatacccagagacctcaagttacaatgtgggaaagggatgtctcctcagatcgccaggagcccggacggagggggcgttcttggggactggagggtagtcaagccctttctcagcaagctgaagtgattgtaagacagctccaggagctccgttggctggaagaagaagtctggctgctgcgcgaaacgagcctgcagcagtag

SEQ ID NO: 4627 - DNA, 2349 bp, Artificial Sequence
  Description of Artificial Sequence: Synthetic coding sequence
atgttccctccgtcaggttcgactggactgataccaccttcccattttcaggccaggccgcttagcaccctgccacggatggcacccacttggttatctgatattccgctggtccaacctcccggacatcaagatgtatctgagaggaggttagatactcagcggcctcaggttaccatgtgggaaagggacgtgagttcagaccgccaagaacccggtaggcggggtcgtagctggggcctggagggctctcaggcactgtcgcaacaggctgaggtaatcgtaaggcaactccaggaactcagacgcctcgaggaggaggtgcgcttgctgagagagactagtcttcaacagaaaatgcgcttggaggctcaggcaatggaactggaggcattggcgagagctgagaaggccggtcgtgccgaagcagaaggtctacgcgcagcactcgctggagccgaagtggtccgaaaaaacctggaagagggccgacagcgcgaactggaagaagtgcagaggcttcaccaggaacagctatctagcctgacccaggcccacgaggaagctctatcatctttgacttcgaaggctgaggggcttgaaaagtcattgagcagccttgagacgagaagagccggagaggcaaaagaattagcggaggcgcaacgcgaggcagaactgctacggaagcagttgagcaagacacaggaagacctggaggctcaggtaacgctggtcgaaaacctcagaaagtacgtcggtgagcaggtaccatctgaagtgcattcccagacttgggagctggagcgccagaaacttctggatacaatgcagcacctgcaggaggacagagatagtcttcatgcaacagccgagctgctgcaagtcagagttcagtcccttacacacattttagctctgcaggaagaggaacttacaagaaaagttcagccatcagattcactggagccagaattcacccgtaagtgccagtcactcttaaaccgttggcgagagaaggtcttcgcccttatggtgcagctgaaagcacaggaactcgaacactccgactcagtcaagcaactaaagggacaggtcgcgtccctgcaggaaaaggtgacatctcagtctcaagagcaggccatactgcagaggagtctgcaggataaggcagcggaggtggaagtggagcgaatgggagctaaaggcctgcagctcgaactgtctcgggctcaggaagcacgccgacgatggcagcagcagactgcctcagcagaggagcagcttcgccttgttgtgaacgccgtaagctcttctcagatttggcttgaaactacaatggccaaggtggaaggagctgccgcacagcttcccagcttgaataacaggctgagctatgctgtgaggaaggttcatactattcgcggtctgatcgccagaaagcttgcgctggcacagctgaggcaagagagttgcccacttccgcctcctgttactgacgtttctctggagctccagcaactacgggaggagcgcaacagactggacgccgagctccagctgtctgcacggcttatacagcaggaagtgggcagggctcgagagcagggcgaggcagaaaggcagcagttgagtaaagttgcccagcagctcgaacaagaactacagcagacacaggagtctctggccagcctgggactccagctggaggttgcacgccaggggcaacaggagtccactgaggaggcggcatctctgcggcaggagctcacccaacagcaggagttatatgggcaggccttgcaggagaaggtggccgaagtcgagacccggctgagagaacaactgtccgacactgaacgcaggctcaatgaggccagaagggagcatgcaaaggcagtagtgtccctcaggcagatacagcgccgagccgctcaagagaaagaacgtagtcaggagttacggaggctgcaggaggaagcacgcaaggaggagggccagcgtctcgcacgaagactccaggagctggagagagataaaaatctcatgctcgccacactgcagcaggaaggattgttgtccagatacaagcagcaacgccttctgacggtgcttcctagcctgctggacaaaaaaaaatccgtggtgagctctccacgcccacccgaatgctcagcctccgcacctgtggcagctgccgtccctacacgcgagtccattaaaggatccctgagcgtgcttctcgatgacctccaggatctttcagaggccatctcgaaagaggaggccgtgtgccagggggacaacctcgacagatgcagttctagcaatccgcagatgagcagttag

SEQ ID NO: 4628 - DNA, 567 bp, Artificial Sequence
  Description of Artificial Sequence: Synthetic coding sequence
atgttccctccatcaggatccaccggcctcatcccacccagtcatttccaggcacgccctctgagcacgcttccccgtatggcgcctacgtggctgtccgatatcccactggtgcaacccccaggtcaccaggacgtcagcgagcggagacttgatactcagaggccgcaggtgaccatgtgggaacgcgatgttagttcagacaggcaggagccgggtcggaggggaaggtcctggggactcgagggctctcaggctcttagtcagcaggccgaggtgattgttcgacagctgcaggagctgcgcagactagaagaggaagttcgtttgttacgggagacaagcttgcagcagaagatgaggctcgaggcacaggcaatggagttagaggccctcgctagggccgaaaaagcgggacgtgccgaggcagaaggattacgggcagccttggcaggcgctgaggtggtcagaaagaatcttgaggagggacgccagcgggaactggaggaagtgcagcgcctccaccaggagcagctgtcaagcctgacacaggcacacgaagagtag

SEQ ID NO: 4629 - DNA, 576 bp, Artificial Sequence
  Description of Artificial Sequence: Synthetic coding sequence
atgtttcccccatcgggacatcaggatgtgagtgaacggaggctagacacacagcgtcctcaagtgactatgtgggagcgtgatgtgtccagcgatcggcaagagccaggcaggcgtggaaggagctggggcttggaaggctctcaggccctatcacagcaggcagaagtcatcgtgaggcagctccaggagctgcgtcggcttgaggaggaggtgagattgttaagagagacgtcactccagcaaaaaatgcggctggaagctcaggccatggagctagaagcccttgcaagggctgaaaaggcaggacgcgcagaagctgaaggtctcagagctgctctggcaggcgctgaggtggtgagaaaaaatctcgaggaggggtctcaacgagaactagaggaagtgcagcgtctgcatcaggagcagctgtctagcctgacccaagcacacgaggaggccttgagttccttaacaagcaaggcagaaggtctggaaaaatccctcagcagccttgaaacacggcgagcgggtgaagcaaaagagctagcagaggcccagagggaagcagaactatag

SEQ ID NO: 4630 - DNA, 567 bp, Artificial Sequence
  Description of Artificial Sequence: Synthetic coding sequence
atgtttcccccttctgggagtaccgggctgattccaccctctcactttcaggcacgacccctgtctacactacccaggatggccccaacatggctctctgacattccccttgtgcagcccccaggccaccaagatgtatctgagcgtcgtttggatacccagagaccgcaggtcacgatgtgggagagagacgtctcctcagaccgacaggaacccggtcggcgtggcaggagttggggcttggaggggagtcaggctctgtcccagcaggccgaagtgattgtccgccagctccaggaactgcgtcgtctggaagaggaggttcggctgctgcgcgagacatcccttcagcagaagatgaggctcgaagctcaggctatggaactggaggccctcgcgagggccgagaaggctgggagggccgaagctgagggactcagggcagccttggcgggtgccgaagtggtgagaaagaatttggaggaagggagccagagggagctcgaggaagtccaaaggctacaccaggagcaactttcatcacttacccaggctcacgaagagtag

SEQ ID NO: 4631 - DNA, 951 bp, Artificial Sequence
  Description of Artificial Sequence: Synthetic coding sequence
atgtttcccccatctgggcaccaagacgtgtcagagagacgactggacactcagagacctcaggtgacgatgtgggaacgtgacgtgagctccgacagacaggagccgggacgcaggggaagatcctggggcctggagggtagccaggccctttcacagcaggccgaagtaatagtgagacaactccaagagttgagatggcttgaggaggaagtctggctgcttagagaaacgagcctccagcagaaaatgaggctggaggcacaagccatggagctggaggccctggctcgggcagagaaggcagggcgtgctgaggcagaaggcctgagagccgctttagccggagccgaggttgttcggaagaatctcgaggaaggcagacagcgcgaactggaagaggttcagcggctccaccaggaacagttgagtagtctcacacaggcccacgaggaagctctgtcttcgctgacaagcaaagctgagggtttagaaaagtcgttgtccagtttggagacccgccgtgcaggagaagctaaggaattggccgaagcccagagggaggctgagctgctcagaaagcagttgtccaagacacaggaggatctggaggctcaggtgaccctagtcgaaaatttaaggaaatacgtgggggaacaagtaccaagcgaggtgcacagccagacctgggagctcgagcgccagaagctattagaaactatgcaacatctccaagaagatcgtgactctttgcacgccacagcagagctcctccaagtcagagtgcagtctctgacgcacattctggcccttcaggaagaggagctcacgagaaaagtccagcctagcgactctttagaacccgaatttactaggaaatgccagtccttgctgaatcgctggcgggagaaagtgttcgccttaatggtccagcttaaggcccaggagtag

SEQ ID NO: 4632 - DNA, 516 bp, Artificial Sequence
  Description of Artificial Sequence: Synthetic coding sequence
atgttccctccctctgggcagtgggaccagacacgaggagttgttgtggtctctgcctgggagacagaccacctgtgtttttgtaacagcagtggcagtaccgggctcattcctccctcccactttcaagcgagaccgttatcaacgctgcccaggatggcccctacatggctttctgatatccctctagtccagccgcctggtcaccaggatgtttcagaacgccgtttggatacacaaaggccacaggtgactatgtgggagagggacgtgtcttcagaccgccaggaacccggtcgcagagggagaagttggggactggaaggctctcaggccctatctcaacaagcggaggtgattgtccgtcagttgcaagagttaaggtggctggaagaagaagtctggctcctgagggagacctccctgcagcaaaagatgcgcctcgaagctcaggctatggaactcgaggcacttgcacgggcagaaaaagcaggacgagccgaagcagaaggatag

SEQ ID NO: 4633 - DNA, 357 bp, Artificial Sequence
  Description of Artificial Sequence: Synthetic coding sequence
atgtttcctccatcaggctccaccggactcattccaccgagtcattttcaagccaggccgctgtcgaccttgcctagaatggccccaacatggctctccgacattcctttggtccaaccccctgggcatcaagatgtgagtgagaggagactggatacccagcggcctcaggtcacgatgtgggagagggacgtgagcagtgaccggcaggagcctgggagacgtggtagatcctggggcctagaaggctctcaggccttaagccaacaagcggaagtgatagtgaggcagctgcaggaactgcgctggctggaagaggaggtctggctgctgagagagacgtccctgcaacaatag

SEQ ID NO: 4634 - DNA, 771 bp, Artificial Sequence
  Description of Artificial Sequence: Synthetic coding sequence
tgacgcctggatgcagagctgcagttaagtgctcgactcattcaacaagaggtgggtagagcaagggagcagggagaagctgaacgccagcagttatccaaggtggctcagcaacttgaacaggagctacaacagacacaggagtctcttgcttctttggggttgcaactcgaggtggcccgacaatgtcagcaggaatcaaccgaggaggctgcttctctgagacaggagctgacccagcagcaggagctgtacggtcaagcgctgcaagagaaggtggctgaggttgagaccagactgagggagcagctgagtgatacagaaaggcgattgaacgaagccagacgagagcacgcaaaagctgtggtttcattgcggcagattcagaggcgagctgctcaagaaaaggagcgcagccaggaactgagacgattgcaagaagaagcgcgaaaggaagagggacaaaggctcgccagaagacttcaggagttggaaagggacaagaatctaatgctccagagactgttgacagtgctgccaagcctcttagacaaaaagaagtctgttgtctcaagcccacggcctcctgaatgcagtgcatccgcccctgtggccgctgccgtaccaactagagaatccatcaagggatccctttctgtacttctcgacgaccttcaagatttatcagaagcaatttctaaagaggaggctgtgtgccaaggcgataacctggacagatgcagcagttgtaatccccagatgtcatcctag

SEQ ID NO: 4635 - DNA, 2508 bp, Artificial Sequence
  Description of Artificial Sequence: Synthetic coding sequence
atgtggccccactctgctggcgctcggccttgggcatcaacactgaccggcaaagaccctagggtcatggcttgttggtgtttggacggcctgccgtcagggctggcggagccatggcgagaactgtggagatggaggtccagaccccttcattgcgttcctccatttagccccctggcacggtcctctcgagatcatcggaatttgaggcggcgtggaaacatcgacggctggcgacagaatttggaaccttcgaataatgtggagatgttccctccaagcggacatcaggacgtgtccgaacgcagattggatactcaaagaccccaagtcacaatgtgggaacgtgacgtctccagcgaccggcaggagcctggaagacgcggtcgaagttgggggctagagggatctcaggcccttagtcagcaggcggaagttatcgttcggcagctgcaagagctgagacggctcgaagaagaagtgcggcttctccgtgagacttcgcttcagcagaaaatgcggctggaagcccaggctatggagcttgaagccctggctagggccgaaaaggctggacgcgctgaggccgagggccttagggccgctctggcgggagctgaggtggtgcggaagaatctcgaagagggatcgcagcgcgaattagaagaggtgcagaggctgcaccaggaacagctttcatccctaacgcaggcgcatgaagaggctttgtcaagcttaacaagtaaggccgagggactggagaaatccttgtcgagtctcgagactagacgggcaggcgaagctaaagagctggctgaagctcagagagaggccgagctgttgcggaaacaattgtcaaaaacgcaggaagatctggaagcccaggttacgttggttgagaaccttcgaaagtatgtgggggagcaagtgccttccgaagtacatagccagacatgggaattggaacgccagaagctcctggaaaccatgcagcatcttcaggaagatcgtgacagtctccacgctaccgcagagttgctgcaagtgcgtgtccagtcgttgacccacattctggcactccaggaggaagaactgaccagaaaggttcagccaagtgactcactggagcctgagtttacaagaaaatgtcagtctttgctgaatcggtggagggaaaaggttttcgcccttatggttcagttgaaggcccaagagctcgagcattctgactctgtgaaacagctgaaaggtcaggtggcatctcttcaggaaaaagtaacctctcaatcacaggagcaagccattcttcagcgatccttgcaggataaggccgctgaggtggaagtagagagaatgggggcaaaaggtctacaacttgagctgtcccgagcacaggaggcacgtaggaggtggcagcaacaaactgcgtctgcagaggaacagttgcgactcgtggtcaacgccgtcagtagtagccagatctggttagagaccaccatggccaaagtcgaaggcgcagccgctcaactaccttctctgaacaacaggctgagctacgccgttaggaaagttcacacaatccgcggactcatcgctaggaagctggccctagcccagctacggcaagagagctgtccgctgccccctcctgtcacggacgtgtccctggaacttcagcaactgagggaagagcgaaatcgactggatgcagagttgcagctctccgcacgcctaattcaacaagaggtcgggagagccagggagcagggcgaggctgagcgccagcaactgtccaaagtcgctcagcagctcgaacaggagttacagcagactcaagagtccctcgcctcactggggcttcagctggaagtcgctaggcagggacagcaggagtcgacggaggaagccgcttctctccggcaggagttgactcaacagcaggaactgtatggacaggcgctgcaggagaaggtcgccgaggttgaaacaagactgcgggagcagctaagcgatactgaacggagactcaacgaggctcgccgagagcatgcaaaggcggtggtctccctgcgccaaatccaaaggcgggctgctcaagaaaaagagcgatctcaagagctgcggaggctccaagaagaagccagaaaagaagaaggacagcggctggcacgcaggctgcaagaactggagagggataagaatctgatgctggctaccctgcagcaggagggcctgctgtcccgctataagcagcagcgcttgctgaccgtgctcccaagtctgctcgataagaagaaatctgtggttagttccccaagacctcccgaatgctctgcctcagcaccagtagccgctgcagtgccgaccagggagtccatcaagggatctcttagcgtgctgttggacgatttacaagatttgtctgaagctattagcaaagaagaggccgtctgccaaggcgacaacctggatagatgctcttcatccaatccacagatgagcagctag

SEQ ID NO: 4636 - DNA, 2190 bp, Artificial Sequence
  Description of Artificial Sequence: Synthetic coding sequence
atgttccctcctagtggaagcactggattgatcccccctagccacttccaggctaggccactcagtaccctcccacggatggccccaacttggctctcggacattccactggtccagccgccaggacatcaggacgtctcggagaggcgtctcgatacgcagcgccctcaggtcactatgtgggaacgcgatgtcagcagtgaccgacaagagcccggacgacggggacggtcctgggggctggaggggtcccaggcactctcccagcaggcagaagtgatagttaggcagctccaggaactccgacgtctcgaagaagaagttcgcttacttagggagacaagtctgcagcagaagatgcgactggaggctcaggccatggagctggaggcccttgctagggctgagaaagccggtagggccgaagctgaggggctcagagctgctttggcaggggcagaagtcgtgcgcaagaacctcgaagagggtagacagcgtgaattagaggaagtgcaacgcttacatcaggagcagctgtcaagtcttactcaggcacacgaggaggccctgtcttctctgactagtaaggctgagggcttagagaagagcctctctagcctcgaaactaggcgggctggagaggcaaaagagctcgcagaagcacaaagagaagcagagctattgcgcaagcaattatctaagacacaggaagatctcgaggctcaagtgacattggtggagaacctgagaaagtacgtgggagaacaggtccctagtgaggtccacagccagacgtgggagctggagcgtcagaagttactcgacaccatgcagcatttgcaggaagacagagactccctgcacgcaacagcagaacttctccaagtgcgggttcagagtttaacacatattctagctctgcaggaggaggagctgacccgaaaggtgcaaccctccgattcactagagcccgaatttacgaggaaatgccagtctctactgaatagatggcgcgagaaggtctttgctttgatggtgcagctcaaggcccaggaacttgaacactcggattcagtgaaacagctgaagggccaagttgcttcactgcaggagaaggttacctctcagtcacaggagcaagccattttacagaggtccctgcaggataaagcagcggaggtcgaggtggaacggatgggcgctaaaggcctgcagctggaacttagtcgcgcacaggaggccaggcgacggtggcaacaacaaacagcgtctgctgaagaacagctacggttagtcgttaatgctgtgtcctcctgccccctgcctccacctgtgacggatgtgagcctggagctgcagcaactgcgggaggagagaaacagactggacgccgaacttcaactttcagcaaggctaatccagcaggaagtcgggagggcaagagagcagggggaggcagagagacagcagctgagcaaggtggctcagcagctggagcaggagctccaacagacgcaagagtctctagcaagcctgggtttgcagcttgaggtggccagacagggtcagcaggaatctaccgaagaggctgcctctttgaggcaggaactcactcagcagcaagaactatatggacaggccttacaggaaaaagtggcggaagtagaaaccagactgagagagcagctatctgataccgagaggagacttaacgaagctcggagggaacacgccaaggccgttgtctccctgcgtcagattcagcgcagagctgcccaggagaaggaacgcagccaagagcttagacgtctgcaggaagaggcccgaaaggaagagggccagcgcctggcaaggagactgcaggaactggaaagagataaaaaccttatgctggccactcttcaacaggaggggctgctgtctcgctacaagcaacaaagactcttgacagttctgcctagtctgctagataaaaagaaatcagtagtctcctccccacgtccaccagagtgttccgcatcagcaccggtggcagccgctgtgcctacccgggagagtatcaaaggcagtctgagcgtgctgctggatgatctgcaggacttgtccgaagccattagtaaggaagaggctgtgtgtcaaggcgataatctagatcgctgcagttcttcgaacccacaaatgagctcttag

SEQ ID NO: 4637 - DNA, 384 bp, Artificial Sequence
  Description of Artificial Sequence: Synthetic coding sequence
atgtttccaccttctgggcagtgggatcagaccagaggtgtggtggtggtctcagcgtgggaaactgatcacctgtgcttttgcaactcctctgggagcactgggcttatacccccttcccactttcaggccaggcctctgagtactctgccacgtatggcaccaacctggctaagcgatatacctctcgtgcagcctcctgggcaccaggacgtgtctgagaggaggctggacactcagcgcccacaggtgacaatgtgggagcgtgacgtgagctcagaccggcaggagcccggacgcagggggcgttcctggggcttagaggggagccaagccttgagccagcaggctgaggtgattgtgaggcaattgcaggagctgtag

SEQ ID NO: 4638 - DNA, 462 bp, Artificial Sequence
  Description of Artificial Sequence: Synthetic coding sequence
atgttccctccttccgggtccaccggactgatccccccttctcactttcaggcgaggcccctcagcacactcccgcgaatggccccaacctggttaagcgacatcccattggtgcaacctcctggtcaccaggacgtgtccgagaggcgcctggacactcagcggccacaggtaaccatgtgggaaagagatgtttcatcagatcggcaagaaccaggcaggcgcggtcgaagctgggggttagaggggagtcaagctctcagtcagcaagcagaggtgattgttaggcagctgcaggaactaagacgccttgaagaggaagtccgactgcttcgggaaactagcctgcagcaaaagatgagattagaggcccaggctatggaacttgaggcacttgcaagggctgagaaggcaggcagggcggaagctgaggggctgagagccgcacttgcaggcgcttag

SEQ ID NO: 4639 - DNA, 567 bp, Artificial Sequence
  Description of Artificial Sequence: Synthetic coding sequence
atgttccctcctagtggctccacaggtctcattcccccttctcactttcaagcccgacccctcagcaccttgccgagaatggcccctacttggctgtccgacatccctctcgttcaacctccgggacaccaagacgtgagcgaaagacggctggatacccagagaccccaagtgaccatgtgggaacgagacgtttccagtgatcgacaagaaccaggtaggcgtggacgatcctgggggctcgaaggcagccaggcactgtcgcagcaggcggaggtcatcgtgaggcagctccaggagctgcgctggctggaagaggaagtgtggttgctccgggagacctcactccagcagaaaatgcggttggaggcacaggccatggagctggaggcactggctcgagctgagaaggcaggcagggcagaggctgagggcctgcgcgctgctctagcgggtgctgaggtggtacggaagaatttggaagaaggacgtcagcgggagctagaggaagtccagagactccaccaggagcaattgagcagcctgactcaggcgcatgaagagtag

SEQ ID NO: 4640 - DNA, 462 bp, Artificial Sequence
  Description of Artificial Sequence: Synthetic coding sequence
atgtttcctccatctggctccacgggtctgatccctccgagccattttcaagccaggccattgtcaaccttaccacgcatggcacctacatggctctctgatatccctctcgtgcagccaccaggacatcaagacgtctccgagcgtaggctcgatacacagcgccctcaggtaacgatgtgggaaagggacgtgtctagcgacagacaggaacccggacgccgaggaagatcatggggactggaaggatcccaggcattgtcacagcaggccgaggtaattgtacgacaactgcaggagctacgaagattagaagaagaagtgcgtttgttgagggaaacatccctgcaacagaagatgcgcctggaggcgcaggccatggagttggaagcactggctcgggcagaaaaggccggtcgagctgaggcagaggggttgagagccgcactggcgggagcctag

SEQ ID NO: 4641 - DNA, 462 bp, Artificial Sequence
  Description of Artificial Sequence: Synthetic coding sequence
atgtttcctccctccggatcaactggcctgatcccgccttctcatttccaggctcgccctttaagcacactgccaaggatggccccaacttggctctctgacattcctctggtacaaccccctggccatcaggatgtatccgagagaaggttggatactcaacgccctcaggtaaccatgtgggagagggatgtctctagtgaccggcaggagccagggcgtcggggacggtcctggggcctagaggggtctcaggctctttcacaacaagccgaggtcatagtgaggcagctccaagagctgcggtggctggaggaagaagtatggcttctgcgcgaaacgagtcttcaacaaaaaatgcgtctggaagctcaagccatggaacttgaggccttagcacgggctgagaaggccggtagagcggaagcagaaggactgcgcgctgcgctggccggtgcctag

SEQ ID NO: 4642 - DNA, 951 bp, Artificial Sequence
  Description of Artificial Sequence: Synthetic coding sequence
atgtttcccccaagtgggcatcaggacgtgagcgagcgtcgactggacacacagcgcccacaagtgacaatgtgggagagggatgtgtcatctgacagacaggagcctggaagaagggggagatcatggggcctggagggcagccaggctctgtcacagcaggccgaagtaattgttagacagctgcaagaactccgcagactcgaggaagaggttaggctgcttagggagactagcctgcagcagaaaatgcgattagaggcccaggccatggaactggaggccctggctagagcagagaaggcagggcgtgcagaggccgaaggacttcgcgcagcactggccggagccgaggtagtgcgcaagaatctcgaagagggtcgccagcgtgaactggaggaagtgcagagactacaccaagaacagttgtctagtctgacgcaggcacacgaggaggccctgtcttccttgacctccaaagccgaagggcttgagaagtctctgagctccctggagactaggcgcgctggcgaggcaaaagaactggcagaggcccagcgagaggcagaattgttgcgtaagcaactgagcaaaacacaggaggacttagaggctcaggtcactctcgtggagaatctccgcaagtacgtgggggaacaggtgcccagcgaagtgcactctcagacctgggaactggaacgccagaaacttctagatactatgcagcacctgcaggaggacagagattccctgcatgccacggctgagttacttcaggtgagggtgcagagcttgacgcatatcctggcattacaggaggaggagctgacccgaaaagtacaaccatccgacagccttgagcccgaattcaccagaaagtgccagtccttgttaaatcgttggcgcgaaaaagttttcgccctgatggtacaactgaaggcccaagagtag

SEQ ID NO: 4643 - DNA, 651 bp, Artificial Sequence
  Description of Artificial Sequence: Synthetic coding sequence
atgtggcctcattctgctggagcaaggccatgggcttctactctgactggcaaggatcctcgcgtaatggcatgttggtgcctggacggcttaccgtctggcctggcagagccctggagggagctgtggagatggcgttctcgccctttacactgcgttcctccttttagccctcttgccaggtcttctagagaccacagaaatctgcgtcggagagttgaggctctgccacgaattcttaaaggtaatatcgacggctggaggcagaaccttgagcctagcaacaacgtcgaaatgttccctccttcgggtagtaccggtttgataccaccaagtcacttccaggcacgtcccctgtctacgctgcccagaatggcccctacatggctttcagatattcctctcgtacagccacctgggcatcaggacgtttctgagcgaagactcgacacacagagaccccaagtcacaatgtgggagagggacgtgtctagtgacagacaggagcctggtcggcgaggaaggtcatggggactcgaagggagccaagctctgtctcagcaggctgaggtcatagtgaggcagcttcaggagcttaggcgccttgaggaagaagtccgccttctccgggaaacatctctccagcagtag

SEQ ID NO: 4644 - DNA, 516 bp, Artificial Sequence
  Description of Artificial Sequence: Synthetic coding sequence
atgttccctccaagcgggcagtgggatcaaacacggggagttgtcgttgtgtccgcctgggaaactgatcatctttgtttctgcaattcctcgggaagcacaggactaataccgccatcacactttcaggctagacccctatccacgcttcctcgcatggcccctacatggctgagtgacatcccacttgtgcaaccgccaggccatcaggatgtcagtgagaggcggcttgacacccaaaggccccaggtgactatgtgggagcgagacgtatcgagcgaccggcaggagcccggtaggcgtggtaggtcgtgggggctagaagggtcccaggctctgtcacagcaagcggaggtgattgtacgccagctgcaagaattaagaaggctggaagaggaggtgaggctgttgcgggaaacatctttgcagcaaaagatgagactggaggcccaagctatggagctggaggcgttggcacgtgccgaaaaagccggtagggctgaggcagaaggatag

SEQ ID NO: 4645 - DNA, 357 bp, Artificial Sequence
  Description of Artificial Sequence: Synthetic coding sequence
atgtttcctccatccggttctaccggtttaattccgccttcgcattttcaggccaggccactctccactcttcctagaatggcccctacctggctgtccgacatccccctagtgcagccacctgggcaccaggacgtaagtgagcgcagattggacacccagaggccacaggtgactatgtgggagagagatgtctctagcgatcgacaagaacccggacggcgaggacggtcctggggcctggagggaagccaggccctgtcccaacaggcagaggtgattgtgcggcagcttcaggagctacgcaggcttgaggaagaagtgcggctgttgagggaaacctcgctgcaacagtag

SEQ ID NO: 4646 - DNA, 423 bp, Artificial Sequence
  Description of Artificial Sequence: Synthetic coding sequence
atgtttcctccttctggctctacgggattgatccccccatctcactttcaggcacgtcccctgagtacccttcctcggatggcacctacgtggctaagtgacatccccctggttcagcctcccggtcatcaagacgtaagcgagaggagactggatacccaacggccacaagttacgatgtgggaaagagacgtgtcgtccgatcgtcaggagccaggtcggcgaggcagaagctgggggctggagggctcacaggccttatctcagcaggccgaggttattgtacggcagctccaggaactcagacgactggaagaagaggttagactgctgcgcgagacttcactgcagcagaagatgaggctcgaggcgcaggcaatggagctggaagcattggccagggctgaaaaagcaggaaggtag

SEQ ID NO: 4647 - DNA, 111 bp, Artificial Sequence
  Description of Artificial Sequence: Synthetic coding sequence
atgtttccaccgagcggatctacaggtctgattccacccagccactttcaggccaggccactgtcaaccctgccgcgaatggccccaacatggttgagcgatatcccctag

SEQ ID NO: 4648 - DNA, 291 bp, Artificial Sequence
  Description of Artificial Sequence: Synthetic coding sequence
atgttccccccatctggaagtactggcctgattcccccttcccatttccaagcacgccctctgagcaccctaccacggatggctcctacttggctctccgatattcctttagtccagcccccaggccatcaggacgtgtcagaacggagattagacactcaaaggccacaagtcaccatgtgggagcgagatgtctctagcgaccggcaggaaccaggccgtcgcggaaggtcttgggggctcgagggcagtcaagctctttctcagcaagccgaagttatcgttaggtag

SEQ ID NO: 4649 - DNA, 477 bp, Artificial Sequence
  Description of Artificial Sequence: Synthetic coding sequence
atgtttccgcctagcggatccaccggcctcatacccccatcacacttccaagccaggccactatcaactcttcccagaatggcccctacttggctgtccgatattccactcgtccagcccccaggccaccaggatgtatctgagcgcaggttagatacacagaggccacaagtaaccatgtgggaaagagatgtgagtagcgatcgccaggagcccggacgccgtgggagaagctggggcctagagggctctcaagcactaagtcagcaggctgaggttatcgtccgacagctgcaagaactccggaggctcgaggaagaggtccgtctattgagggaaacatcgttacagcagaaaatgagactggaggcccaggccatggagctagaagcattggcccgagctgagaaggcagggcgtgctgaggctgaaggtctgcgggctgccttagctggtgccgaagttgtccgtaaatag

SEQ ID NO: 4650 - DNA, 351 bp, Artificial Sequence
  Description of Artificial Sequence: Synthetic coding sequence
atgtttcctccatcggggtcgactgggctaatcccaccgtcccacttccaagcgcgaccactgagtaccctgcctagaatggctcctacatggctgtccgatattccgctcgtccagcctccgggtcatcaggacgtgtctgagaggaggctggatacccaacggcctcaggttaccatgtgggaaagggatgtgagttctgaccgccaagagccgggtcgacgcggacgatcatggggcctggaaggcagccaggcactcagtcagcaggccgaggttatcgtacgacagctgcaggagctgagaagacttgaggaggaagtgaggcttctgagggagacaagtctatag

SEQ ID NO: 4651 - DNA, 126 bp, Artificial Sequence
  Description of Artificial Sequence: Synthetic coding sequence
atgtttcctccttcgggaagcactgggctcattcctccatctcattttcaagcaagacctttatctactcttcctcgtatggcacccacctggctgtccgacatccccctggtgcagcccccatag

SEQ ID NO: 4652 - DNA, 480 bp, Artificial Sequence
  Description of Artificial Sequence: Synthetic coding sequence
atgtttcctccttcgggccaccaagacgtttcggagaggaggctggatacacagcgccctcaagtgaccatgtgggagcgtgatgtgtcaagcgataggcaagaacctggacggcgtgggcgaagctggggcttagaggggagccaggccctgtctcagcaggcagaggtgattgtgcgacaactccaggagctaaggcggcttgaggaggaggtcagactcctgcgagagacctcgttgcagcaaaagatgaggctcgaggctcaagctatggagctggaggcactggccagggcagagaaggctggaagggccgaggccgaagggctccgtgctgcgctggcaggtgctgaagtggtccgcaagaatctagaggagggttcccaacgcgagctcgaagaggttcagcgtttgcatcaggaacagctgtcctccctgacacaggctcacgaggaagctctcagctccctcacttcttag

SEQ ID NO: 4653 - DNA, 423 bp, Artificial Sequence
  Description of Artificial Sequence: Synthetic coding sequence
atggcgcctacatggctctcggacattcccctcgtgcagccccctgggcaccaagatgtatccgagcgcaggctagacactcagaggccacaggtgacgatgtgggaaagggatgtgtcatcagacaggcaggagccaggacggaggggtcgatcgtggggacttgagggaagccaggctctgtcccaacaggccgaagttattgtgagacagctgcaagagctcagaagacttgaggaagaagtcagacttttacgagaaacaagcttgcagcagaaaatgcggttagaagcccaggccatggaattggaggccctggccagagcggaaaaagccggtcgggcagaggcagagggcttgcgggctgcactggcaggcgctgaagttgtgaggaagaacctggaagaaggctctcagcggtag

SEQ ID NO: 4654 - DNA, 480 bp, Artificial Sequence
  Description of Artificial Sequence: Synthetic coding sequence
atgttccctccatctgggtctactggactcattcccccttcccactttcaggctaggcccttatcaaccctgccccgaatggccccaacctggctgtctgacatccccttggtgcagccacccggacaccaggatgtgagcgagagaaggctcgacacacaaaggccccaagtcacgatgtgggagagagatgttagttccgacaggcaggaacccggtagacggggaagaagttggggcctggaagggtcgcaagctctcagtcagcaggcagaggtcattgttcgacagctacaggaattacggcgtctggaggaagaggtgcgcctgctgagagaaacttctcttcaacaaaagatgcggttggaagcccaggccatggaattagaagccctcgccagagcggagaaagctggaagggccgaagcggaagggctgcgcgctgccttggctggcgctgaggtcgtgcgtaagaactag

SEQ ID NO: 4655 - DNA, 3714 bp, Artificial Sequence
  Description of Artificial Sequence: Synthetic coding sequence
atgcggaaacaccgtcacttacctcttgtcgcggtcttttgtctcttcctgtccggttttccaactactcacgcccagcagcagcaggccgctcaggactctgctgacatcatcttcctgatagatggatctaacaacaccggaagtgttaattttgccgtcatcctcgattttctggtgaacctgctggagaagctaccaataggaacgcagcagattcgtgtaggagtggtgcagttttccgatgagcctagaaccatgttctccctggacacttactcaactaaagcacaagtgctgggagcagttaaggcattgggatttgccggaggtgagctggcaaatattgggcttgcgctggacttcgtcgtcgagaatcacttcaccagagcaggaggctctagggtcgaagagggggtgccccaggttcttgtcctgataagcgccggtccatcgagcgatgagattcgttacggtgtggtcgcactgaaacaggcgtctgtcttttccttcggactcggcgcacaggctgcctcgagagccgaactccagcacatagctaccgacgataacctagtgtttactgtcccagaattccgaagctttggggatctgcaggaaaagcttttgccatacatcgttggggtagctcagcgccatatcgtgctaaaaccaccaaccatcgttacgcaagtaatcgaggtaaataagcgagacattgtgtttctggtcgacggatcttccgccttggggttggccaattttaatgccatccgcgatttcatcgcgaaggttattcagcgactggaaattgggcaggacttgatccaggtggcagttgcacagtacgcagatactgtcaggcccgaattctatttcaatacacaccccacaaaaagggaggtcataaccgcggtccgcaagatgaaacccctggatgggagcgccctgtatacaggatcagccctggacttcgtgcgcaacaatctctttacaagtagtgcgggttaccgtgcagcagagggtattcccaaactgctggtgttgattactggcggaaaatccctcgacgaaatctctcagccagcccaggaactgaagaggtccagcattatggcattcgcgatcggcaacaagggtgctgaccaggcagaactcgaggaaattgcgttcgactcatccctggtgttcatccccgcagagtttagagcagctccgctccagggaatgcttcctggacttctcgccccattgcggactctgagcggaaccccagaggtccactctaacaaacgggatattatctttctgttggatggcagcgccaatgtggggaagaccaatttcccgtacgtgagagatttcgtcatgaatctggtcaatagcttggatatagggaacgacaatattagagtgggactcgtccagtttagcgacacacctgttacagaatttagcctcaacacatatcaaactaaatcagacatactggggcacctaaggcagctgcagctgcagggaggctccgggcttaacacaggaagcgcgctgtcttacgtgtatgcgaaccacttcacagaggctggagggtcccggatccgcgagcacgttccgcagctgctgttgttactaaccgcgggtcagagtgaggacagttacctgcaggccgctaatgctttaaccagagccggaatactaacgttctgcgtgggggcatcgcaggccaacaaggctgaactggagcaaatcgcttttaacccttccctggtgtacctgatggatgacttttccagtctcccagctctgccccaacagctgattcagccactgactacctatgtatcaggtggggtggaggaagtgccactggctcagccagaatctaagagagatatcctgtttcttttcgacggatccgctaacctcgtgggacagtttcccgttgtgcgggacttcctctataagattatcgacgagctgaacgtaaagcccgagggcactcgaattgccgtcgcacagtatagcgacgatgtcaaggtggagtcccggtttgatgagcaccagagcaaaccagaaatcctgaatttagtgaagagaatgaaaatcaagacaggaaaagccctaaacctcggctatgcccttgattacgctcagcggtacatctttgtcaaatcagccggatccagaatagaagatggcgtgctgcagtttctggtgctgctcgtcgctgggagaagctctgacagagtagacggcccagcaagcaacctgaaacagtccggggtcgtgccattcattttccaggccaagaacgcagatcctgctgagctcgagcagatcgtgctgtcccctgccttcatcctagcggctgagtccttgcctaaaatcggggaccttcacccccagatcgtgaatctgctgaaaagcgtgcacaatggagcccctgccccagtcagtggcgagaaagatgtagtattccttctggacggatcagagggagtgaggtccggcttcccgctcctgaaggaatttgtgcaaagggtcgttgaaagcctggacgtgggtcaggatcgtgtgcgggtggccgtggtgcagtattcagatcgcactcgtccagagttttacctgaattcctacatgaacaagcaggatgtggtcaacgcagtacgacagctgacgcttctcggtgggccaacccccaacacaggagctgccctggagtttgtgctaagaaacatcctggtgtcaagtgccggatctcgcataaccgagggagtaccacaactgctgatcgtgctcacagcggacagaagtggcgatgatgtgagaaacccaagcgttgtcgttaagcggggtggcgcagtccctatcggcatcgggattgggaatgcagatattactgagatgcaaaccattagctttattcctgattttgctgtggccattcctacattccggcagctgggaacagtgcaacaagttatctctgaacgtgttactcaactcactcgcgaggagctgtcacgtcttcaacccgtcctccagcccctgccttcgcccggagtagggggaaagcgagatgtggtctttcttatagatggatcccaaagcgccggtcccgaattccagtacgtgcggactttgatagagagactcgtggattatttggacgtgggctttgatacaactagggtggctgtgatacagttctccgatgaccctaaagtggagttcctactcaatgcacactcttccaaagatgaagttcagaacgctgtccagcgtctgaggccaaagggcggacgtcagataaatgtgggaaacgcactcgagtatgttagtagaaacattttcaagcgcccactagggtctagaatagaagagggcgttccacagttcttggtgctgatcagctcgggtaagagtgacgatgaagttgacgaccctgctgtggaattaaagcagttcggggtggcgccatttacaatagccagaaacgctgaccaagaggaactggtaaaaatatctctgtctcctgagtatgttttctctgtgagcaccttccgggagttacctagcctcgaacagaagctcctcacccccatcacgaccctgactagcgaacagatccagaagttgctggcttcgacccgctatcctcccccaggcgagatgggtgccagtgaagtgttgctgggggcatttagcatatag

SEQ ID NO: 4656 - DNA, 7712 bp, Artificial Sequence
  Description of Artificial Sequence: Synthetic coding sequence
atgcggaagcaccggcacctgccactggtggcggtgttttgcttgttcttaagcggttttcctaccactcacgcacagcagcagcaggccgtcattgaggttaataagcgcgacatcgtgtttctcgtggatggctcctccgcacttgggctggccaacttcaacgccattagagactttatcgccaaagtgatccagcgcctcgagatcgggcaggaccttatccaggtggcggtcgctcagtatgccgatacagtgaggcccgagttttattttaatacacaccccacaaaacgagaagtcatcactgccgtgagaaagatgaaacccttagatggaagcgcgctttacacagggtcagcactggactttgtgaggaataacctattcacgtcttcagccggttaccgcgcagccgaaggtattccgaagctgctggttttgataaccggaggtaaatccttggatgagatcagccagccagcgcaggagcttaaaaggagctctataatggcgtttgccatcggcaacaagggtgcagaccaggcggagctggaggagatagcattcgattcctccctggtgttcattccggctgaattccgagctgcccctctgcaaggtatgctgccgggtctgctggcccctctccgcaccctgagcggaacgcccgaggaatccaaacgggatatcctcttcctgtttgatggctctgccaatctggtagggcagttcccggtggtgagggacttcctgtataaaataatcgatgagctgaatgtgaagcccgagggcactcggattgccgtggcccagtattctgacgatgtgaaagttgagtctaggtttgacgagcaccagagcaaacccgagatactgaatcttgtcaagcggatgaagataaagacagggaaggctctgaatctgggttacgcccttgactatgcccagaggtacatattcgtgaagtctgctgggagccgcattgaggacggtgtgctccagtttctcgtcctgttagtcgcaggccgaagctccgatcgggttgacggccctgcctcaaatcttaaacaaagcggagtcgttccctttatattccaagcgaaaaatgccgacccagcagagttggagcagatcgtgctgtcccctgctttcattctggcagcagaaagcctcccaaagatcggagaccttcatccccaaattgttaaccttctaaagagtgtgcacaatggtgcacctgcacccgtcagcggggagaaagatgttgtgttccttctggacgggtctgagggggtcaggtcaggttttcccctgctgaaagagttcgtccagagggtggtcgaatcacttgatgtaggccaggaccgggtccgtgttgcagtcgtccagtacagtgatcggacgcgccctgagttctatctgaactcgtatatgaacaaacaagacgtggtgaatgctgtacgtcagctaaccttgttaggcggaccaaccccgaacacaggggctgctctggaattcgttttgaggaacattcttgtgtcttctgctggaagtaggatcacagagggcgttccacaactgttgatcgtgctgaccgccgaccgctctggtgatgacgtgcgcaatccaagtgtggtggtgaagcggggaggagccgtgccgatagggattggaatcggtaacgctgacattaccgaaatgcagactatcagctttatccccgatttcgctgtggccatacccactttccggcaactcgggaccgtgcagcaagtaatctctgaaagagtgacacagttaaccagagaagagctgtctcgcttgcagccggttcttcagccgttgccatctccaggggtcggtgggaagcgagatgtggtatttctgatcgacggcagccagagtgctgggccagaatttcaatacgtaaggacgctaatcgagaggctcgtggactatctggatgttggatttgacacaacacgagttgctgtaatacaattcagcgatgatccaaaagtagaatttctgctgaacgctcacagtagcaaggatgaagttcaaaacgcggtacagcgcctgaggcccaagggcggacggcagataaacgtcggaaatgcactcgagtacgtgagccgcaacatcttcaagcgtcctctgggcagcagaatagaggaaggcgtaccacagttccttgtgcttatttcgagcggcaaaagtgacgatgaggtggacgatccagccgtggagctcaagcaatttggagttgcacccttcaccatcgccagaaacgctgatcaggaggaactggttaaaatctctttatcccccgaatacgtctttagtgtcagtacttttcgcgagctgccctcgctagagcagaagctgcttactcctattaccactttgacttccgagcagatacaaaaactccttgccagtactaggtacccacctcctgccgtggaaagcgatgccgcagacatcgtgttcctcatcgacagctccgaaggggtacggcctgatgggttcgcccatatccgcgacttcgtgagccggattgttcggagattaaatattggaccctccaaggtgagagtgggcgttgtgcaatttagcaacgatgtgtttcccgagttttatcttaagacatatcggagtcaagctcccgtgctggacgccataagacgactgcgcctgcgcggagggtctccacttaacacaggtaaagctctggagttcgtggcaagaaacctgtttgtcaagtcagccggatctcgaattgaggacggggttcctcagcacctggttctagtgttgggcggaaaaagtcaggacgacgtaagccgattcgcccaggtgattcgaagtagtggcattgtatccctgggagtcggcgaccgcaacatagaccgtacggaacttcagaccataaccaacgacccccgtctggtgttcaccgtacgtgaattccgtgagctccccaatatcgaggagcggatcatgaactccttcggaccatccgccgcaacccctgccccaccaggcgtcgacacccctcctcctagcagacccgaaaaaaaaaaggcagatattgtgttcctgttggacggttccattaacttccggagggattcgttccaggaggttctgagatttgtgtccgaaattgtagacacggtatacgaagatggagactctatccaagtgggcctggttcagtacaacagtgatccaactgacgagtttttcctgaaggactttagcaccaaacgccagatcatcgatgccataaataaggtcgtgtacaaggggggaaggcacgcaaatacgaaggtagggttggaacacctgcgggttaatcactttgtccccgaggccggatccaggttggatcagcgcgtccctcagatcgccttcgtgatcaccgggggaaaatctgtcgaggacgctcaggacgtgtccctcgcgctgacacagcgcggtgtgaaggttttcgccgtgggcgttcggaacatagatagtgaagaagtgggcaagattgcctcaaactccgcaacagcctttcgggtgggtaatgttcaggaactttccgagttaagtgaacaggtgctcgagaccctgcatgatgctatgcatgaaacgctgtgccccggagtgactgacgccgctaaagcttgcaaccttgatgtaatacttgggttcgatggttcacgggaccagaatgtgttcgtggctcagaaaggattcgagtccaaggtggatgcaatccttaataggatctctcagatgcacagggtgtcttgttcgggtggcagatctccaacagtgagggtaagcgttgtagccaatacaccctctggaccagtggaggcttttgattttgatgagtatcaacctgagatgcttgagaagtttcgcaatatgagaagtcaacacccttatgtgcttacagaagacacgttgaaggtgtacttgaataagtttcgccagtcaagcccagacagcgtaaaagtcgtcatccactttacagatggagccgatggtgacttagcggatctgcaccgggcttctgaaaatctgcgccaagaaggagtccgggctctcattctggttggcctggagcgggtggtgaacctggagcggctgatgcaccttgaatttggaagaggcttcatgtatgacaggcctctccgcctgaacctactggacctggattacgaactcgcagaacagctcgataatatcgccgagaaagcttgttgtggggtcccatgcaagtgctccgggcagcgcggtgacagaggacccattggctcaattgggccaaaagggatccccggagaagatggatatcgagggtaccccggagacgaaggtggaccaggagagagaggacctccaggggtgaacggaacacagggattccaggggtgcccaggccaaaggggagttaaggggagtcgcggatttccaggcgagaagggagaggttggtgagatcggactcgacggcctggacggagaagacggcgacaaaggtctgccgggatctagcggggaaaagggcaacccagggcgtcggggtgacaagggccctcgaggcgaaaagggggaacgcggagatgtcgggatcagaggggaccctgggaaccccggacaggacagtcaggagcgaggacctaagggtgagacaggcgaccttggccctatgggagtccccggacgcgatggggtgcctggcggacctggggaaacagggaagaatggtgggttcggtcgcagaggcccacctggtgctaagggaaataaaggtggcccaggtcaacctggctttgagggtgaacagggcactcgcggtgcacagggacccgcaggcccagccggtcctcccggtctgatcggagaacaggggatctccggtcccagaggtagtggcggagccgcaggtgccccaggagagcggggacggacgggccctcttggacgcaagggcgaacctggtgagcctggacctaagggcggtatcggaaacagggggccaagaggggagacaggcgacgacgggagagacggcgtgggctcagaagggagacggggaaaaaaaggggagagaggtttcccaggctatcctgggcctaaagggaaccctggggagcctggcctgaatggaaccactggccctaagggaatcagggggcgtaggggcaattcaggacccccaggaatagtcggacagaaaggcgaccccggatatcccggtcctgccggtcctaagggaaataggggtgatagtatcgatcagtgtgctctcatccagtccattaaagacaaatgtccatgctgttatggccctctcgaatgccccgtctttccgacagagctggccttcgcattagacacgtcagaaggagttaaccaggacaccttcggaagaatgcgagatgtcgtgttgtccatcgtcaatgacctgactatcgccgagtctaattgccccaggggggcaagggtggccgttgttacttataataatgaagttacaacagaaattcggtttgccgacagtaagagaaaaagcgtgctgctggataagataaagaaccttcaggtcgcccttacatctaagcaacaatcgctggaaactgccatgtccttcgtcgccaggaatacattcaagcgggttaggaacggctttctgatgaggaaggtagccgtgttcttcagtaacacacccacccgggcaagcccccagttaagggaggcggttctgaagttaagcgacgctggaattaccccactcttcctgacacgccaggaggatcgccagctgatcaacgcgctccaaattaataacaccgccgtaggacatgctctggtgttaccagctggtcgcgatcttacagatttcctagaaaacgtgttgacatgccatgtctgcctggacatttgcaatattgacccctcatgcggcttcgggagttggcggccatcgttccgcgatcggagagcggcaggatcagacgtggatatcgatatggccttcatcttggatagcgcagagaccaccaccctgtttcagttcaatgaaatgaaaaagtacattgcgtacctggtgcggcaactggacatgtcaccagaccctaaggcgagccagcattttgccagggtagcggtggtgcagcatgcaccatctgagtctgtcgataacgcgagcatgcctccagtgaaagtggagttctctctgactgattacggttctaaggaaaaactcgtggattttctgagccgcggaatgacccaattgcagggcacacgggctctggggtcagcgattgagtacaccatagagaatgtgttcgagtctgcaccaaacccccgagatctaaagatcgtcgtgctgatgctgaccggcgaggtccctgagcagcagctggaagaggcccagcgagtaatcttacaggcaaagtgtaaaggctatttttttgttgttctgggcatcgggcgaaaggtgaatatcaaagaagtatatactttcgcctccgaaccaaatgatgtgtttttcaaactggtagataaaagcacagaactgaacgaggagcccctgatgcgcttcggccgtctgctgccttcgtttgtgagctccgaaaacgcgttctatctgtcacccgatattaggaaacagtgtgattggtttcagggcgaccagcctacaaagaacctggtaaagttcggtcataaacaggtgaatgtgcccaacaatgtgacgtccagtcccaccagtaacccagtgacgaccacgaagccagtcaccacgacgaaaccagtcaccactaccactaaacccgtgacgacaaccaccaaaccagtcacaattataaaccagccgtctgttaaaccagcagcggctaagcccgcacctgcaaaacccgtggccgctaagccggtggcaaccaagatggcaactgtgcgaccaccagttgccgtgaagccagctaccgcggctaagcccgtggctgccaaacctgcagccgtacggccaccagccgctgcagctgcaaaaccagtggccactaagcctgaggtacctagaccacaagcggctaaaccggctgcgaccaagccggcaaccacaaaaccaatggtgaagatgagtcgggaagtccaagtgtttgagattactgagaattcagcaaagctgcattgggagcgggctgaacctccaggtccttacttttatgacctgaccgtcactagtgcccacgaccaatcactggtgctgaagcagaacctgactgtgaccgaccgcgtcatcggcggtctgttagcaggacagacctaccatgttgccgttgtctgttacctgcggagtcaggtcagggcgacttaccatgggagcttttcaacaaaaaaaagtcagcctcctcccccacagccagcaaggtccgcctcctccagtactatcaatctcatggttagtaccgaacctttggctttgaccgagactgatatttgcaaactccccaaagatgaggggacttgccgcgatttcattttgaaatggtactacgatccaaatacaaaaagctgtgccaggttctggtatggaggctgcggaggtaatgagaacaaattcggcagtcaaaaagagtgtgaaaaagtttgtgcgcctgttctggcaaagccaggggtcatctccgttatgggcaccta

SEQ ID NO: 4657 - DNA, 1938 bp, Artificial Sequence
  Description of Artificial Sequence: Synthetic coding sequence
atgctccttaaaaaacacgctgggaaggggggtgggcgtgagccgcgaagcgaggacccaaccccagcggaacagcattgtgcaaggaccatgccgccatgcgctgttcttgcggctctcctgtcggtggtcgctgtggttagctgtctttacctgggcgtgaagactaatgacctccaggccagaattgccgctctggagtcagccaagggagctcctagcatccacttactgcctgataccctggaccacctcaaaacgatggttcaggaaaaggtggagcggctactcgcacaaaagagttacgaacacatggccaagatacggatcgccagagaggcgccttccgaatgtaattgtcccgctggccctccgggaaagagaggcaaacgcggtagacgaggtgaaagcgggcctccaggacagcccggtcctcagggaccgccagggcctaaaggcgacaagggtgagcagggcgaccagggacctcggggactgcctgggtttccaaccgttgcagcccttcactccaaccaaattctgactgtgaagggcgatcagggacaagccggacccccaggtccccctggccctccgggtcctcggggtccaccaggcgatacaggcaaggatggcccacgcggtatgccgggagtccccggagagcccggtaaaccaggcgaacagggattaatgggcccactgggtcctccaggccagaaaggttccataggagctcctggcatcccagggatgaatgggcaaaagggagaacctggactgccgggtgccgttggtcaaaatggtatccccggtcctaagggcgagccaggggagcagggtgagaagggggacgcaggcgaaaacggacctaaaggcgataccggcgagaagggggatcctggctcaagcgcagccggaattaaaggtgaacccggagagtcaggacgcccaggtcagaaaggcgagcccggactgcccggtctgccaggcctccctggcattaagggcgaaccaggctttatagggccacagggagagccgggattaccagggctgcccggaactaaaggcgaacgcggagaggccggaccccctggcaggggcgagcgcggagaaccaggagcacctggcccaaagggcgaccgtggcgagaagggagatagtggcgctcaaggacccagaggcccaccaggccagaagggagaccagggcgcaaccgagatcattgattataatggtaacttgcacgaagcacttcagggacctcctgggcctcccggaccccaagggctgcagggcccaaaaggtgagcagggatctccaggcattccaggaatggacggcgagcagggtctgaaagggagcaagggggatatgggagatcccggaatgacaggggaaaaggggggtataggtctccccggacttcccggagcaaacggcatgaagggggaaaagggagacagtggtatgcctggaccccagggaccctccatcattggcccacctggcccaccgggaccccatgggcctcccggtccgatgggccctcacggccttcctggccctaagggggagcctggcctaaacggagtcaaaggcctgaaaggtgaaccagggcaaaagggggatagaggaccgctgggcttgcctggggcttcaggactcgacggtaagcccggaagccgcggtaccgacggccctatggggccacacggacctgctggccctaagggggagcgaggcgagaaaggtgccatgggtgaacctgggccacgaggaccctatgggctccccggattccccggtcctaggggtgaaaaaggggaccttggcgagaagggcgagaaagtaacctcaccatctcagcatgtcccctgtttaatcctgctgcttctcagtgcattgctgttctccttgtgtgactctatctag

SEQ ID NO: 4658 - DNA, 1101 bp, Artificial Sequence
  Description of Artificial Sequence: Synthetic coding sequence
atggcagaactccagcagctccaagaattcgagattcctactgggagagaggcccttaggggtaatcattctgccttactcagagtggcagattattgtgaggataactatgttcaagcgaccgacaaacgtaaggccctcgaagaaacgatggctttcacaactcaggccctggcgtctgtggcttaccaagtgggcaatctcgccggacataccctcagaatgcttgacttgcagggcgcagccctgagacaggtcgaagcccgagtatctactctgggtcaaatggtgaacatgcatatggagaaggtggcccgaagggaaattggtaccttggctactgtacaaaggctgcccccaggccagaaggtgattgcacccgaaaatctccccccacttacaccatattgtaggcgtccattaaactttgggtgtctcgacgacattggtcatgggatcaaagacctttccacccaactgtcaagaacaggcactctgagccggaagtccatcaaggctcctgcgacgcccgcttcagccacacttggaaggcctccgaggatccctgagccagtgcatctccccgtggtaccagatggtagactttctgcagcctcaagcgcgttttctcttgctagtgccggatccgcagagggagtaggcggtgcccctacccccaagggacaagcggctccacccgctcctcctctgccaagcagtttagatccacctcccccaccagctgcagtcgaagtgttccaaaggccaccaacactcgaggagctgagtccacccccacctgacgaagagttgcctttgcccctggacctgccaccgccacctccattagacggggatgagctagggttgccaccaccgcctccaggatttggacccgacgaacctagctgggtgccagcgtcctacttggagaaagtggtcaccctttacccatatacttcccaaaaagataacgagctcagtttctcagaaggcaccgtgatctgtgttacacgacggtattcagacggatggtgcgaaggggtgtcatcggaggggacaggcttcttccccggtaattacgtagaaccctcctgttag

SEQ ID NO: 4659 - DNA, 4257 bp, Artificial Sequence
  Description of Artificial Sequence: Synthetic coding sequence
atgattcggctcggcgcacctcaaaccctggttctcctgactctgctcgtcgccgctgtgttgaggtgccaggggcaggacgtaagacagcctgggccaaaggggcaaaagggcgaaccgggagacatcaaggacatcgtggggccaaaaggtccacccggtccacagggtcccgcaggtgaacaaggcccaagaggtgacaggggcgataaaggggagaaaggagctcccggtccccgtggcagagacggagagccaggcacccccggtaatccaggccctccgggaccgcctggacctcccggtccacctggcttaggcggaaattttgccgctcagatggccggtggatttgatgaaaaggcgggtggagcccagctgggagtcatgcagggccctatgggtcccatgggccctagagggccacctggccctgcaggcgctccgggtccccagggattccagggcaaccccggagagcccggagagcctggggtctccggcccaatgggccctagagggcctccaggacccccaggcaaacctggagatgacggagaggccggaaagcctgggaaggccggtgagaggggccctcccggacctcagggagcaagaggttttccaggaactcccggattgcccggagtgaagggacatagaggctatcctggacttgatggcgctaagggagaggctggtgcacccggagtgaaaggggaaagtgggagtcctggggagaatgggtcccctggtccaatgggaccacgcggactgccaggagagcgcggaaggactggcccagctggggctgctggcgcaagaggcaacgatggccaacctgggccagcagggcctccaggtcccgtgggtccagccggtggcccaggtttccccggagcccctggggctaagggtgaagccggtcccacaggcgcaagaggccctgagggagctcaaggtccgcgaggagaacctggcacccctggatcaccaggccctgctggggctagcggcaaccctgggacagacggcatccccggtgcaaagggcagcgccggtgcccctggaatcgccggagcccctgggttcccgggacccagaggccctcctggccctcagggcgctaccggacccttgggccctaaaggacagactggggaacccggaattgcaggatttaaaggggagcaaggccctaaaggcgagccgggacccgctggcccacaaggagctcctggtcccgcaggtgaagagggcaagcgcggagcccgaggcgagccaggcggagtgggccctataggcccacctggagagcgaggagcgcctggcaatagaggcttccctggacaggatggactggctggacccaagggggctcccggtgagaggggaccctccgggctggctggcccaaagggcgcaaacggtgaccccggacggcctggggagcctggtctaccgggagcgaggggactaacggggaggcccggtgacgccggacctcagggcaaagtgggccctagcggagccccaggcgaagacggtcggccagggccacccggtccgcagggcgcaagaggacagcccggagtcatgggcttccccggtcctaaaggagctaacggggagcctgggaaagccggtgagaagggcctgcccggtgccccagggctacgcggattaccaggcaaagatggtgagactggggcagccggaccgcctggtcccgcaggcccagccggagagagaggagagcagggggcacccggacctagcggattccaaggccttcccggaccccctggtccacccggagagggcggtaaaccgggagaccagggagtgcccggagaagcaggggcaccaggactggtcgggcctcggggagaacggggatttcccggtgagagaggcagcccaggtgctcagggattgcagggacctagaggcttaccaggcacgcccggaacagatggccctaagggtgcttcaggacctgccggtccacctggggctcaggggccaccaggactgcagggaatgcctggggagcgcggtgcagctgggatcgctggcccaaaaggagaccgcggtgacgttggcgaaaagggcccagagggtgctcccggaaaggatggcggtcgcggtcttaccggccctataggtccccctgggcctgccggagccaatggtgagaagggcgaggtgggacccccaggacccgctgggtccgccggtgccagaggagcacccggtgagcgtggcgagactggacctccaggacccgctggatttgccggacccccaggtgcggacgggcaaccaggagcaaagggcgagcagggcgaagcgggacagaaaggcgacgcaggggctcctgggcctcaggggccatccggcgcacctgggccacaggggccaactggcgtgacaggaccaaagggagccaggggggctcagggccctcctggcgcaacaggattcccgggtgcagcaggacgtgtcgggcctccaggttctaacggaaacccaggcccacctggcccacctggcccaagcggaaaggacggacctaagggagccagaggagacagtggacccccagggagggccggagagccaggcctccaaggccctgcaggccctcctggtgagaagggcgaacccggtgacgatggacccagcggcgctgaggggcctcccggaccgcaaggtctagccggacaacggggaattgtgggactaccaggccagcgtggcgagaggggttttcctgggctgcctggcccatccggcgagcctggtaaacagggagctcctggcgcttctggggaccggggaccgcctgggccagtcggccctccaggtctcacaggccctgccggagaacccggtcgcgaaggttcgccaggagccgatggcccacctggccgagacggggcagccggagtgaaaggcgaccggggtgaaacaggggctgtcggcgcaccaggagccccaggtcccccaggttctccgggaccagctgggcctacaggcaagcagggggaccggggtgaggccggagcacagggaccaatgggcccttccggccctgccggtgccaggggaatccagggccctcagggaccaaggggggacaagggtgaggccggagagccaggagaaagaggtctcaaaggccatcgcggatttactgggctgcagggcctccccggtcctcccggtcctagcggagatcagggggcatccggtccggcaggccctagcggcccaaggggacctccaggccctgtagggccttccggaaaggatggcgcaaacggcattcctgggccaatcggtcctcctggtcctcgcggaagaagcggagaaacgggcccagccggacctccaggtaatcccggtcctccagggcctcccggtccccctggccctggcatcgatatgagtgctttcgctgggttagggcctcgcgagaagggacctgatcctctccagtacatgcgtgctgaccaggcagcagggggactcagacaacatgatgccgaggtggatgccacattgaagtcccttaataaccaaattgaatctattaggagccctgagggatcacggaaaaacccagccagaacctgcagggatctgaagctgtgtcaccctgaatggaaatcaggtgattattggatagaccccaatcagggttgtacactggatgcgatgaaggtgttctgcaacatggagaccggagagacatgcgtttatccaaatcctgccaacgtgcccaaaaaaaattggtggtcatccaaatctaaagaaaagaagcatatctggttcggagagacgattaacgggggattccatttttcttacggtgacgataatctggccccaaacaccgccaatgtgcaaatgactttcttgcgcctgttgtccacagaaggctctcagaatatcacttaccactgcaagaattccattgcatacctggacgaggcagccggaaatctcaagaaggctctgctcatccagggctctaatgatgttgagattcgggcagaggggaacagtaggtttacatacaccgccctcaaagacggctgtaccaaacacacagggaaatggggtaagacagtcatcgagtaccgctcccagaaaaccagccgcttgccaatcattgatatcgcaccaatggatattggcggtcccgaacaggagtttggtgtggatatcggcccagtctgctttctgtag

SEQ ID NO: 4660 - DNA, 4464 bp, Artificial Sequence
  Description of Artificial Sequence: Synthetic coding sequence
atgatcagactcggagcgccacagaccttagtattgctaacactccttgtggcagccgtcctacgttgtcagggacaggacgtgcaagaggcaggcagttgcgttcaagacggacagagatataacgacaaagatgtctggaagcctgaaccctgtcggatctgtgtgtgtgataccggcactgtcttatgcgacgatatcatctgcgaggacgtgaaagattgtttgagtccagagatccctttcggcgaatgctgccctatttgtcctactgacttggcgacagcctctggtcagcctggtccgaagggccagaaaggcgaacccggagatataaaagacatcgtcggcccaaagggtcctccgggaccccagggcccagccggtgagcagggacctcgtggagatcgaggggacaagggtgaaaagggtgctcctggtccgaggggaagggatggggagcccggtacccccggtaaccccggaccccctgggcctcctggtccacccggtcctcccggacttggcggtaatttcgctgcacagatggctggcggattcgatgagaaggccggaggggctcagctcggggtgatgcagggccctatggggcctatgggacctcgcggtccacccggaccagctggcgcaccgggacctcagggcttccagggaaacccaggggagcctggggaaccaggagtatctggccctatggggccaagaggtcctccgggaccaccaggcaaacctggcgatgatggggaggctggcaaacctggcaaagccggtgagcggggtccccctgggcctcaaggcgctaggggatttcccggaactccgggactcccaggggtgaaaggtcacaggggatatcccggactcgatggagctaaaggggaggccggtgctcctggcgtcaaaggcgaatcgggctcacccggtgagaacggtagcccagggcctatgggccctaggggcctgccgggagagcgcggtaggactgggcctgcgggtgccgctggcgcaagggggaacgatggccagcctggtcctgctggcccacccggacccgtcggccctgccggaggacccggttttcctggggcaccaggtgccaaaggggaggccggtccaacaggtgctcgcggtcccgaaggagcgcagggcccacggggagagcccggtacccctgggagtccagggcctgccggtgccagcggcaaccctggaacagatggtatcccaggcgcaaaaggatccgccggagcccctgggatagcgggtgccccaggatttcctggcccacggggtccccctggccctcagggagccacgggtccgctcggcccaaaggggcagacaggggaacctggcatcgctgggtttaagggcgaacagggaccaaaaggagaacctggaccagccggtccacagggcgcaccaggccctgccggtgaagagggcaagcggggagccaggggagagcccggaggggtgggaccaataggacccccaggggaaaggggtgcccctgggaatagggggtttccagggcaggatggtctggcaggaccaaagggggcacctggagaaaggggtccgtctgggctcgctggcccaaagggagccaacggagacccaggcagaccaggggagccagggctcccgggagcccgtggtctgaccggacgtccaggcgatgccggtccccaggggaaagtgggccctagcggtgcacccggtgaggacggaaggccaggccctccaggtccccaaggtgccagaggccagccgggagtgatggggttccccggtcctaagggcgcaaatggggaacccggtaaagccggagagaaaggcctcccaggcgctccgggtctaagaggcctgcccggaaaagatggcgagacaggggcagcaggacccccaggcccagctgggccagcgggtgaacgcggtgagcagggagctcctggaccctccggctttcaagggcttccaggccctcctggccctccaggagaagggggtaaacccggagaccaaggggtgccaggggaagcaggcgcaccgggactggtaggccctcgaggagagaggggcttcccaggagaacggggatcacctggagcccagggcctgcagggaccacgaggactccccggaactccaggtacggatggacccaaaggggcaagcggccctgcgggtcctcccggagcacaagggccacccggactccagggcatgcccggagagcgcggagctgccggaattgcagggcctaaaggtgatcgcggagacgtgggcgagaaggggcctgagggggcacccggaaaagacggagggcgaggcttgaccgggccaatcggacccccaggcccagcaggggctaatggggagaagggggaggtgggaccaccaggcccagccggatcagctggagcccgtggggctcccggtgagcggggagaaaccggtcccccaggcccagctggatttgccggaccacccggagccgacggtcaacccggtgcaaaaggagagcaaggcgaagccggtcagaaaggcgacgccggagctcctggaccccaaggtccatcaggtgctcctgggcctcagggccctacaggtgttacaggacccaaaggcgctcgtggagcccagggccctcccggagccacagggttccccggagcagcgggtagggttgggccaccaggatctaacggcaaccccggtcccccaggacctccgggacccagtggcaaggacggccctaagggggctcggggtgactcaggtcctcccggaagggcaggcgaacccggtctgcaaggccctgctgggcctcctggtgagaaaggggaaccaggggatgatgggccatctggtgccgaggggcctcccggacctcagggactggctggccagaggggaatcgtgggcctgcccggtcagcgtggcgagcggggatttcctggcctcccaggccctagcggcgagcccggtaaacagggagcccctggagcatccggtgacaggggtcccccaggacccgttggaccaccaggactcaccggccctgcgggagagccagggagggagggctcccctggcgcagacggaccgcctggaagggatggagcagctggggtcaagggcgatagaggagagacaggggcagttggggcaccaggcgctcctggtccccctggatctccgggacctgccggtcccacgggtaaacagggagaccgaggcgaggccggtgcccagggacccatgggtcctagcgggcctgccggagctcgaggcatccagggaccacagggtcccagaggcgataagggcgaggctggtgaacccggagagaggggactgaaagggcatcggggtttcactggcctacaaggcctgccaggtcccccaggcccatccggtgaccaaggtgcttccggaccagcagggccttccggtcctagggggccaccagggccagtcggcccaagcggaaaggacggcgcaaatggcattccgggacccatcggaccaccaggtccacgcggtagatccggcgagactggcccagccggaccaccgggaaacccaggtccccctgggccacccggacctcccggtcccggaatcgacatgtcggcgtttgccggtctgggccctcgtgaaaaagggccagatccactacagtatatgagagccgatcaggctgccggtggcctgcgtcagcatgacgccgaggtggacgccaccttaaaaagtcttaacaaccagatcgaaagcattcggagcccagagggctctcgcaaaaaccccgcaagaacctgtcgggacttgaaattgtgccatccagaatggaagagtggcgattattggatcgatccaaaccagggatgtacccttgatgccatgaaagtgttctgtaacatggaaacaggagagacttgcgtgtacccaaacccggcaaatgtgcccaagaaaaattggtggtcatcgaaaagcaaggaaaaaaagcatatttggtttggggaaactataaatgggggatttcacttcagttatggggatgataacttagctccaaacacggctaatgtacagatgacttttctccgcttgctctcaacagagggcagccaaaacataacttaccattgcaaaaactccattgcatacctggatgaggccgcaggcaatctcaagaaagcactgcttatccaaggatcaaacgatgttgagattcgggctgaaggaaactcccggtttacctacaccgcgctgaaggacggatgcactaagcataccggaaagtggggaaaaaccgtcatcgaatatcgcagccaaaagacatctcggcttcccattatagacatagctcctatggacatcggcggaccagagcaagagtttggtgtagatatcggtccggtatgcttcttgtag

SEQ ID NO: 4661 - DNA, 4257 bp, Artificial Sequence
  Description of Artificial Sequence: Synthetic coding sequence
atgattcgcctgggcgctcctcagacccttgtgctgctgacacttcttgtggcagcggtccttcgctgtcagggtcaggatgtgcggaagcctgcacccgcattggagccagctgcaccgggaagtttatcacagattgtaggcccaaaaggcccacctggtccacagggacccgctggcgaacaaggaccccgaggcgatcgaggcgataagggggagaagggagctcccggaccgaggggtcgcgacggggaacccggtacaccgggtaaccctggccctcctggaccgcctggtcccccagggcctccaggtctaggcggaaacttcgctgcacagatggcaggaggctttgacgaaaaggctggaggagcacagcttggcgtgatgcagggccctatgggcccaatgggcccacgcggtccacccggtccagctggcgcaccgggaccccagggcttccaaggcaatcctggagagcccggtgaacctggtgtgagtggacctatgggtccaagaggccctccaggtccccctgggaaaccaggggatgatggtgaggccggtaaaccgggaaaggccggtgagagagggcctcccggacctcagggagcacgaggattcccagggacccccggactcccaggggtgaaaggacaccgtgggtatcccggtctggacggcgctaagggtgaggcaggagcccctggagtgaaaggcgaaagcgggtcacccggagaaaacggctctcctggcccaatgggtcctcggggactgcccggtgaaaggggtcgcaccgggccagccggagcagcgggagccaggggtaatgacggccagcctggtccagctggcccacccggaccggtggggccagccggaggaccgggatttcctggtgccccaggggctaagggggaggctggaccaaccggagcacggggacccgagggcgctcaaggacctaggggtgagcctgggacacctggttctcctggaccagctggtgcatctgggaatcccggtaccgacggaattccgggagctaagggtagcgcaggagccccagggatcgcaggcgcaccgggattcccgggacccagagggccaccgggaccccagggcgcaaccggtcctctcgggccaaagggacagactggcgagccaggtattgccggatttaagggtgagcaaggtcctaaaggtgagccagggcctgctggaccgcaaggagcaccagggcctgccggagaagagggtaaacgtggtgccaggggcgagcctggtggcgtaggaccaattggccctcccggtgagcggggagcacccggaaatcgcggatttcccggacaggacggcctcgcgggaccaaaaggtgcccctggagagcgaggcccatccgggttagctggaccaaagggagccaacggcgatcccggacgcccaggcgagcctggcctcccaggagctcgcggactgacggggagacctggggacgccggaccgcagggcaaggtcggtcctagcggggcacccggagaggacgggcgtccaggtcccccagggcctcagggggcaagaggacagccaggcgtcatgggcttccccggtcctaagggcgcaaacggggaacctgggaaagccggtgagaaaggactgcccggtgctccaggcttgcgaggcctgccagggaaagatggggagaccggggctgccggacctccgggtcccgcaggtccggctggtgagagaggcgagcagggagccccaggacctagcggtttccagggcctccctgggcctcctggccctccaggcgaggggggtaaacctggcgatcagggtgtgcctggcgaagcaggggcacctggcttggtgggtccgaggggggaaagaggttttccaggcgagcggggatccccaggcgcacagggcttacaaggacctcggggtctgcccggaactccagggactgacggcccaaagggcgcatccgggccagcgggaccaccaggggctcagggcccacccggtctgcagggaatgcctggagagaggggcgctgctggcattgctggaccaaagggggaccgcggagacgtcggggagaaaggaccagagggcgctcccggaaaggatgggggacgtggtttgaccggccctatcgggccacccggtcccgctggcgcaaacggagagaaaggagaggtgggaccgccaggccctgccggttccgccggtgctaggggtgcccctggagagcgaggcgaaactggcccacccggtccagccggtttcgcaggaccccctggggctgacggccagccgggtgccaaaggcgagcagggcgaggccggtcagaaaggagatgcgggagcacccggaccgcagggcccatccggggctcctggtcctcagggccctaccggagtgactgggccaaaaggggcaaggggtgcgcagggtccccctggggcaacaggatttccaggcgcagccggtagagtgggaccacccggatcaaacggaaatcccggaccacctggaccaccaggacccagcggtaaggatggaccgaagggtgcgaggggagactccggccctcctggaagagctggagaaccgggtttacagggccctgccggtcctcccggtgagaagggagagccaggagacgatgggccaagtggggcagagggcccacctggtccccaagggctggccggtcagagaggcatcgtcggcctgccaggccagcggggagagagaggattcccgggtctcccagggccatccggggagccaggcaagcagggagcccctggcgctagtggcgaccggggacctcctggccctgtagggcctcccggactgaccgggcctgcaggcgagcctgggagagaagggagccctggcgcagacggtcctcccggaagggatggtgccgctggcgtgaaaggagataggggagaaacaggtgccgtaggggctcctggcgcacccggtccaccaggtagccctgggccagccggaccaaccggcaagcagggtgaccggggtgaagccggtgcccaaggtcccatgggcccttctggacccgctggcgcaaggggtatccaggggcctcagggccctaggggtgacaaaggcgaagccggtgaacccggtgagagggggttgaagggacatcggggatttacaggacttcagggtctaccaggaccgccaggccctagcggggaccagggggcatctggcccagccggtccctcagggcctcgtggcccacccggacctgtgggacctagtggcaaagacggtgccaatgggatcccaggcccaatcggtccacccggacccaggggacggtcaggagagaccggtcccgctggtcctcccggtaatcccggaccacccggacctcccggtccacctggcccaggaatagatatgtccgcctttgccggactgggccctcgtgaaaagggtcccgatccactgcagtacatgcgggctgaccaggccgcaggtggcctgcggcagcacgacgccgaggtggacgctaccctgaaatctttgaataaccaaattgaatctattcggtcacccgagggaagcagaaagaatcctgctcgtacctgccgggacttgaagctgtgccatcccgaatggaaatccggcgattactggatcgatccaaaccaggggtgcaccctagacgcaatgaaggttttctgtaacatggaaacaggagaaacttgtgtgtatcctaaccctgcgaacgtgcctaagaaaaactggtggtctagcaaatctaaagaaaaaaagcacatctggttcggagagaccatcaacgggggattccattttagctatggtgatgataacttagcccctaatactgctaacgtacagatgaccttcttgcggttgctgtccacggagggatcacagaacatcacttatcattgtaagaatagcatagcatacttggatgaggcagccggtaatcttaagaaggcccttcttattcaaggctccaatgacgtggagatacgcgctgaaggcaactccaggtttacttatactgccctgaaggatggatgcacaaaacacactgggaaatggggtaaaaccgtcatagagtaccggagccagaagacctctagattacctattattgatatcgcacccatggacatcgggggtcccgagcaggagtttggcgtagatataggaccggtgtgcttcttatag

SEQ ID NO: 4662 - DNA, 3939 bp, Artificial Sequence
  Description of Artificial Sequence: Synthetic coding sequence
atgggccctaggctgtcagtgtggctgcttttacttcccgctgccctgctgctccacgaggagcattcacgggcagcagccaagggagggtgtgcgggttctgggtgcgggaagtgtgattgtcacggagtgaagggacagaagggcgaacgcggactccctggtctgcagggcgtaatcgggtttccagggatgcagggccctgaggggcctcaaggtcccccaggccagaagggtgatacaggagagcctggacttccgggaacaaagggaacacgcggtccacctggagcttcagggtacccaggcaatcctggtctgccaggaatccccggtcaggatggccctccagggccacctggcattcctggttgcaatgggactaaaggagaacggggtccccttgggcctccgggactgccaggcttcgctgggaaccctggcgatcctggggagatcctgggccacgttccgggtatgctactgaagggggagcgcggtttccccggtataccaggtacacccggtccacctggactgccgggactccaagggcctgtaggtcctcccggatttaccggacctcccgtgagctttggcggatgcttatccgaatttgggcatggagggatctcttttccgctgaccaaacgacggcaaggggatcagggcgtgagcggcccacccggagtgccgggacaggcccaggtccaggaaaaaggtgatttcgcgactaagggggaaaaggggcaaaaaggcgagcctggattccagggtatgcctggggtcggggagaagggcgaacctggaaaacctggtcctaggggcaaacccggaaaagatggtgacaagggagagaaagggtcacctgggttcccaggcgaacccggatacccgggtctgattgggagacagggccctcaggtgaacgcaggaacaatcgcctatcccctccccccatgcccagtgattggcactggtcctctgggcgaaaaaggagagcgaggatacccaggaacacctggacccaggggtgagccagggcctaaagggtccttcctggccttttttcccccacccccaacacctccaccgttcgctggcctgccagtgccagggcaggcaggcgctcccggttttcctggcgaacgcggagagaaaggtgaccgcggattcccgggaactagcctgcccggaccctctgggcgagacggacttcctgggccacccggatcccccggaccccctggacagcccggatacaccaacggaattgttgaatgccagccaggtccaccaggagatcagggaccgcctggcatcccgggacagccgggatttataggggagatcggagaaaagggccagaagggcgaatcatgcctcatctgcgatatcgacggctacagaggcccacctggaccccaagggcctcccggagaaatcggctttcccggacagccaggcgctaagggcttgcctgggatcactgggcagtccggacttcctggtctccctggccaacaaggggcacctgggatccccggtttcccaggaagcaagggcgagatgggagtaatgggaacacctgggcaacccggaagtccaggacctgtcggcgctccagggttacccggtgaaaaaggcgaccacggcttcccgggtagcagtgggcctcgcggagacccaggcctgaaaggcgacaagggcgacgtcggactgcctggcaagccagggtcgatggacaaagtcgacatgggaagtatgaaaggacagaaaggagatcagggggagaaggggcagataggccctatcggcgaaaaaggctctaggggcgacccaggaacccctggcgtccctgggaaagatggtcaagccggtcagccaggtcaacctggcccaaagggtgacccaggcattagtggtactcccggagcaccaggcctgcccggacccaaaggatccgtgggaggcatgggtctaccgggtacccccggtgagaagggagtgcctggcattcctggacctcagggttcccctggacttcccggtgataagggcgctaaaggagagaagggacaagcaggcccaccaggcattggcatcccagggctgaggggtgagaaaggggaccagggaattgccggatttccagggtcacctggagagaaaggtgagaaaggtagcatcgggattccgggaatgcccggaagccctggactgaaggggtcccctgggtcagtgggatacccagggagtccaggcttgccgggagaaaagggagacaaggggcttcccggactggatggaattcctggtgtcaagggcgaggcagggctgcctggcacgccaggacccaccggcccagccggacagaagggagagccgggatcagacggcattcctgggtctgccggtgagaagggggagccaggattacccggacgcggtttccctggttttccaggcgctaaaggcgacaaaggaagcaagggggaggtgggctttcctgggctggccggttccccaggcattcctggtagtaaaggagagcagggtttcatgggaccccctggtcctcaggggcaaccaggcctacccggatctccagggcatgccaccgagggacccaagggggaccgaggcccacaggggcagcccggtctcccaggcttgcctggccctatgggcccacccggtctgcctggtattgatggggtcaaaggcgataagggaaacccgggttggcccggtgcacccggagtgcccggtcctaagggggaccccggattccagggcatgcccggaatcggaggctcccctggaatcactggctctaagggcgacatgggaccgcctggagtcccgggtttccagggtcctaaaggcttacctgggctgcaggggatcaagggtgatcagggcgaccagggcgtccctggggctaagggcttgccaggacccccagggccaccaggaccctacgacattattaagggagaaccgggtttgcccggacctgaggggccacctggacttaaaggcttgcaagggctgcctggacccaagggccagcagggtgtaaccggtctcgtgggcattccagggcctcctggtattccgggattcgatggtgcccctggccagaagggcgagatgggtcctgctggccctactggcccaagaggcttccctgggccacccggacccgacggcttgcctgggtccatgggcccacccggaacaccttccgtcgaccatggcttcctcgtaactagacattcgcagaccatcgatgatccacagtgtccatcaggcaccaagattttgtaccacggctattccctgctttacgtgcagggtaatgagagggcacatggccaggacctgggtacagccggttcctgcctgagaaaattctccaccatgccctttctgttctgtaacattaacaatgtctgtaatttcgcctcccggaacgattactcctactggttgtctaccccagaaccaatgcccatgagtatggcccctatcactggtgagaatattcgcccatttatctctcgctgcgcagtttgtgaggctcctgcgatggtgatggctgtgcattctcaaaccatccagatccccccatgtccaagtggctggtcaagcctctggatcggatatagcttcgtcatgcatacatctgccggagcggagggctcaggccaggcattggcctccccaggttcatgcctggaagagttcagatctgcccctttcattgaatgtcatgggagaggaacatgtaattactacgctaacgcatactcgttttggttggccaccattgagaggtccgaaatgtttaaaaagccaactccgagtaccctcaaggctggtgagctaagaacacacgtgagcaggtgtcaggtttgtatgagacggacttag

SEQ ID NO: 4663 - DNA, 5009 bp, Artificial Sequence
  Description of Artificial Sequence: Synthetic coding sequence
atggggccacgtctgtcagtttggctgctgttgctgccagcggcacttctgctgcatgaggagcatagccgggctgccgctaaagggggttgcgccggttcagggtgtggaaaatgtgattgccacggcgtgaagggacagaagggcgagagggggctgcctggacttcaaggcgttattgggtttcccggtatgcaaggccctgagggcccacagggcccacctggacaaaagggtgatacaggggaaccaggtcttcctggcaccaagggcactagaggtccccctggggcaagcggttatccaggaaaccccggattgcctggcattccagggcaggatggccctccaggcccaccaggcatccccggatgtaatggtaccaaaggggagcgaggacctctcggaccccctggactgcccggatttgctgggaacccaggaccaccaggcttgcccggtatgaaaggggacccgggagaaattctgggacatgtgcccggtatgctcttgaagggggagagaggcttccctggcattcccggtacccccggtccccctggtttaccaggcttgcaaggacctgttgggccaccaggattcaccggtcccccaggaccacccggtccccctggacccccaggagagaagggccagatgggcctgtccttccagggcccaaaaggcgataagggcgatcagggcgtgagcggccctccaggcgtacctggccaggctcaggtgcaggaaaaaggcgactttgcaactaaaggcgagaaaggacagaagggagagcctgggtttcaggggatgcccggagtcggagaaaagggcgagcctggaaagccaggtcccagggggaagcctggcaaggatggcgacaaaggcgagaagggtagtcccggattcccgggagagcccggatatccagggctgatcggacgtcagggtcctcagggcgaaaaaggcgaagccggacctcccggaccccctggcattgtgattggcaccggcccactaggcgagaagggtgagcgcggttacccgggaacccccggaccacgaggagaacccggtcccaagggcttccccggactaccagggcagccaggcccacctggattaccagtgcccggtcaggcaggagctccaggctttcctggggagcggggagagaagggggacagaggcttccctggcacttcgctgccaggccctagcggacgtgacgggctgccaggtcctcctgggagcccgggtccgcctggccagccaggctataccaatgggatcgtggagtgccaacccggtccaccaggggatcaaggccctcccggtatcccaggacaacctggtttcataggggaaattggagagaaaggccaaaagggagaatcttgtttaatttgtgacatcgatggctaccgcggaccccctgggccacaggggccacccggtgaaataggattccccggacaaccgggagcgaaaggcgaccgaggcttgcccggaagagatggagtggcaggtgtcccgggtccccaaggaactccaggtctcatcggccagccgggagcaaagggcgaacccggtgagttttacttcgacctcaggctaaagggagacaaaggggacccaggtttcccagggcagccagggatgactggaagagccggatcccctggcagggatggacaccctggtctcccgggtcctaagggatctccaggatctgtcggcctgaagggtgaacgtggtcccccagggggagtgggtttccccggatccagaggtgacaccggccctcctggcccacctggttacggtcccgcaggcccaatcggggacaaagggcaggctgggttcccaggaggacccggatctcctggcctgcccggacccaagggggaacctgggaaaatagtgccccttcccggtccccctggggcagaggggcttccaggatcaccaggctttcctggcccacagggcgatcgagggttcccaggtacgcctgggagacctggcctgccgggagagaaaggtgctgttggacagccaggaatagggtttcccggacctcccggaccaaagggagtagacgggctgcccggagatatgggccctccgggaacacccggtcggccaggctttaatgggctgcccggaaatcccggagtgcaaggccagaaaggggaacctggagtcggcctgcccggacttaagggactgcctggactccctggcattccaggcacacctggtgagaaaggctcgattggggtgccaggtgtgccgggtgagcatggcgcaatcggacctcctggattgcaaggcatccgcggtgagccgggtccccctggacttccaggatctgtgggcagccccggtgtaccaggtatcgggccacctggtgcgcgtgggccacccggagggcagggacctccaggtttatctggacctccgggaataaagggcgaaaagggcttcccgggttttccaggactggacatgcctgggcctaaaggcgataagggagctcagggcttgcctggaattaccgggcagtcaggtcttcctggtctgcccggtcagcagggcgcaccaggaataccaggcttccccggaagcaagggtgagatgggtgtaatgggaacaccaggccaacctggctctcccggacccgtgggagcccctgggttgccaggtgagaaaggcgatcacggctttccaggcagcagcggccctcgaggcgaccctggcctgaaaggggacaagggtgatgtgggactgcccggaaagccaggctcaatggataaagtagatatgggaagtatgaagggtcagaagggtgaccagggggaaaaggggcagatcggccctatcggggagaagggatcacgcggagatcccggtacaccaggggtccctggcaaggatgggcaggccggacagccgggtcaacccggtccaaagggggaccctggcattagtgggacacccggagcaccaggcctccctggcccaaagggctctgttggcggtatgggtctgcctggcaccccaggggaaaagggtgtgccgggaatcccgggaccacaggggagccctggacttcctggggataaaggcgctaagggcgaaaaaggtcaggcaggacccccaggtatcggcatccctgggctgagaggagaaaaaggagaccaaggcatcgcaggattcccaggctcacctggagaaaaaggcgagaaaggctctatcgggataccgggaatgcctggcagccccggtctgaagggctcacccggatcagttggctatcccggaagccccggtctaccaggggagaagggtgacaagggattaccgggactagacggcatcccaggggtgaagggcgaggcaggcctgccaggcacccctggaccaactggtccggcaggtcagaagggggaacctggatctgacggcatcccgggatcagccggtgagaaaggggagccagggctgccgggaaggggcttcccaggatttcctggggcaaagggcgacaagggaagcaaaggcgaagtcggattccctggcctggccggtagtcccggaattcctggatccaagggagagcagggctttatgggacctccaggtccccagggccagcccggactccccggttcccccggacatgccaccgagggacccaagggcgaccgaggaccacaaggacagcctgggctgccaggcctgcccggtcccatggggccacctgggttgcccggaatcgacggggtgaagggggacaagggcaatcccggatggccaggtgctcctggagtgcccggacctaaaggcgatcctggtttccaggggatgcccggtataggcggttcacccggaatcacgggctcaaaaggtgacatgggccctcccggagtgcccggttttcaggggcctaagggccttccaggcctgcagggtatcaagggagaccagggggatcagggcgttcctggggcaaagggcctccctggccctccaggtcccccaggcccatacgacatcataaaaggagagcccggattgccaggccctgaagggccacctgggctgaagggtctgcagggtctgccaggcccaaagggacagcaaggcgtcacgggcctggtgggtatccccggaccacccggaatccccggatttgatggcgctcccggtcagaagggagagatggggcctgccggaccaacaggtcccaggggtttccctggaccccctggtccagacggcctgccaggcagtatgggtccacccggtactccatcagtcgatcacggatttttggtcacaagacactcacagaccatagatgacccacagtgcccttcaggtaccaaaatcctgtaccacgggtactcccttttatatgtccaaggaaacgaaagagcccacggccaggatctcggcaccgcaggaagttgcctgcgaaagttcagcaccatgcctttcttattctgtaacatcaataatgtatgtaatttcgcgtcacgaaacgactactcgtattggctgtcaacaccggaaccaatgccaatgagtatggctccaattacaggagaaaacatcaggccattcatttctaggtgcgctgtgtgtgaggcacccgctatggtaatggccgtccacagtcagaccatccaaattcccccatgcccaagcgggtggtccagtctgtggatcggatacagcttcgtgatgcacaccagtgccggtgcagaagggagtggacaggcattggcaagccccggaagctgcctagaggaatttcgttcagccccattcatcgagtgccacggtcggggaacctgtaactattacgctaacgcatactccttctggctcgccactatagaacggtccgaaatgttcaagaaacctactccatctaccctcaaagctggagagctgagaacccacgtgagccgctgccaggtatgtatgcggagaaccta

SEQ ID NO: 4664 - DNA, 3957 bp, Artificial Sequence
  Description of Artificial Sequence: Synthetic coding sequence
atgggacctagactgtctgtgtggcttttgttgctgcctgcagccctattattgcatgaagagcactcgagagccgctgcaaagggcggatgcgcaggatccggatgcgggaaatgcgattgtcacggggttaaaggacagaagggcgaacgcggtctcccaggcctccaaggggtgattggcttcccgggaatgcaagggccagagggtccacaagggccacccggacaaaaaggggatactggtgagccaggcctgccgggaactaaaggtactcgcggtcccccaggcgcaagcgggtatccaggtaacccagggctgccgggaatacctggacaagatggaccacccggacctcctggcatccccggatgcaatggaactaagggggagcggggacccctggggccacccggtcttccgggatttgcaggcaatccaggacctccgggtctgccaggtatgaagggggatcccggtgagatcctcggacacgtgcccggtatgcttctcaagggagagcgtggatttcccggtattccaggtacgcctgggcctcctggactccctggccttcagggacctgtgggccctcccggttttaccggcccacccggtccccctggacctcctgggccacccggtgaaaagggacagatggggctgtcttttcagggccctaagggagacaagggagatcagggcgtgagcgggccacccggagtccccggacaggcccaggtgcaggagaagggggatttcgccaccaagggcgagaaaggccaaaagggggagccaggttttcaagggatgcccggagttggcgaaaaaggagagcccggaaagccaggcccacggggtaaaccgggaaaagacggcgacaagggtgagaagggatcccccggatttccaggagagcctgggtaccccggactgataggtaggcaaggcccacagggtgaaaagggcgaggctggacctcccggacccccagggatcgtaatcggaacaggcccattaggcgagaagggtgagcgcggataccccggtaccccaggtcccaggggagaaccagggcctaagggttttcccggactgcctgggcagcccggtcctccgggactaccagtacctgggcaggccggagctcctgggtttcccggagagcgtggggaaaagggggaccgtggctttcctggcactagtttacctgggccaagcggcagagatggtctcccaggccctcctggctcacccggtcctcccggacagcccggatacaccaatgggattgtggagtgtcagcccggtccgcctggcgaccaggggccacctggcatcccgggacagccagggtttataggtgaaatcggagagaaaggccagaaaggggaaagctgcctcatatgcgacatagatgggtaccggggacccccagggccacaaggcccacctggtgaaatcggctttccaggccaacccggtgccaaaggcctgccaggcatcaccggccagagcgggcttcccggactgcctgggcagcaaggagccccaggcatcccagggtttccgggatcaaagggggaaatgggagtcatgggaaccccaggccagccaggatcgccaggaccagttggagcccctggattaccaggagagaagggtgatcacgggtttcccggttcctctggccctaggggagacccgggtctgaaaggcgataaaggcgacgtggggctgcctgggaaacccggtagcatggataaggttgacatgggttcgatgaaaggtcagaaaggggatcagggagaaaaggggcaaattggccctatcggggaaaaagggtctaggggcgatcccggtacccctggtgttcccggaaaagacggccaggcagggcagcctggacaaccaggacctaagggtgacccaggcatcagtgggaccccaggggctcccggactgcctggcccaaagggcagcgttggcggtatgggattacctggcacgccaggagagaaaggcgtaccgggaatccctggccctcaggggtcccctgggcttcctggcgacaagggggcaaagggggaaaaaggacaggctggccctccgggaatcggcattcccggactccggggagaaaaaggagatcagggaattgctgggttccccggatcaccaggagagaagggggaaaaaggcagcattgggatccccggtatgcccggatcacccggtctaaagggttctccgggatccgttggctaccccggatccccaggcctgcccggagagaaaggcgacaaagggctccctggcctggacggtattccgggagtaaagggcgaggccggactccccggtacacccggacccaccggcccagcgggacagaaaggagagccaggcagtgacggtattcctggaagtgctggtgagaagggggagccaggactgcctgggaggggtttcccaggattccccggagccaagggggataaaggtagtaagggcgaggtgggattccccggactggcaggatcccctggcattccaggttccaagggagagcaggggttcatggggcctcctgggccacagggtcagcccggactccccggttcacctggacacgccaccgagggcccaaaaggggatcgcggaccccagggccagcctgggttgcccggtcttccagggccaatgggcccaccgggactccctgggatcgatggcgtgaaaggagacaaggggaaccccggatggccaggcgcaccaggtgtaccaggccctaaaggagaccctggctttcaggggatgccaggcatcggtggtagcccaggcataaccgggagtaagggcgatatgggccctcccggagtccctgggttccagggccctaaaggcctgcccggtctccagggcatcaagggagaccaaggagaccagggcgtgcctggagctaaaggcctgcccggtccacccggaccgcctggaccgtatgacatcattaagggtgagccaggtcttcctggccctgagggcccaccaggactgaagggacttcaagggcttcccggaccaaaaggccaacagggtgtcactgggcttgtgggaatacccggtcctcctgggatccccggatttgatggtgcacccggtcagaaaggagagatgggcccagctggacctacgggccctaggggtttcccaggtcctcctggacctgacggtttaccaggttcaatgggaccgcctggcacacctagcgtcgaccacgggtttctggttaccagacattctcagaccatagatgacccccaatgtccatccggcacaaaaatactgtatcacggttacagcctgctttacgttcagggcaacgaaagggcacacggccaggatctgggtacggctggttcctgcctccggaagttctcaaccatgccatttcttttttgcaacatcaataacgtatgtaacttcgcttctagaaacgattactcttattggctgtccacacctgaacccatgcccatgagcatggctcccataacaggggagaatatccgcccttttatttcccggtgcgcagtatgcgaggcaccggctatggtgatggccgtccacagtcagaccatccagattcccccttgtccctctggctggtcctcactgtggatcggctattccttcgtaatgcacacatccgcaggggctgagggcagtggccaagctctggcttcccccggttcttgcttagaagagttcagaagcgcgccattcatagagtgtcacggcaggggcacctgcaactactatgctaatgcctattctttctggctggcaactatcgagcggtccgagatgttcaaaaagccaactccaagcactctgaaagctggggaactgagaacccatgtgtcacggtgccaggtgtgtatgcggagaacctag

SEQ ID NO: 4665 - DNA, 1560 bp, Artificial Sequence
  Description of Artificial Sequence: Synthetic coding sequence
atgggaccgaggttatcagtttggctgctgctgttgccagccgcattgctgctgcacgaagagcactcccgggctgctgcaaaaggaggttgcgcagggtccggctgcggaaaatgcgactgccacggagtcaaaggccagaaaggtgaacgcggactgccaggcctacagggggtcatcgggtttccaggtatgcaggggccagaagggcctcaggggcctcctggccaaaaaggggatacaggtgaacctgggctccccggtacgaagggcacaagggggcctcccggagcttccggctacccaggcaatcccggtctgcctgggatccccggtcaggacggacccccaggaccccctggaattccaggctgtaacgggacaaagggggaaagaggcccattgggccctcccggactgccagggtttgcaggtaacccgggaccgcctggcctccctggcatgaaaggcgatccaggggagatcctgggacatgtgcccggaatgctcctgaagggggagagaggttttcctggtattccagggaccccgggaccacccggtcttcctggattgcagggtcccgttggaccaccaggattcactggtcctcctggcccacccggacccccaggcccacccggtgaaaaggggcagatgggcttatcattccagggtcccaaaggcgataagggggatcagggggtttccggccctcccggagtaccagggcaggctcaggtgcaggagaaaggtgacttcgctacaaagggcgagaaaggacagaagggagagccgggatttcaaggcatgccaggggtgggggagaaaggggagcctggcaaacccggaccaaggggaaagcccggaaaggatggcgataagggcgagaaggggagccctgggtttccgggtgagcccggataccctggactcattgggaggcaaggacctcagggagagaaaggtgaagctggtcccccaggaccccctgggattgtgattggcaccggaccattgggtgagaaaggggaacgaggctatcctgggactcctggcccacgtggagaacccggacccaaaggcttccccggactccctggccagccaggaccacctgggctgcccgtcccaggccaggccggtgcaccaggtttccccggagagcgaggagagaagggagatagaggcttccctgggacatcactacctgggccatccggacgagatggactccctggcccacctggatccccagggcctcccggtcagccgggatatacgaatggcattgtagaatgccaaccgggtccacccggtgatcagggccctcccggaattcccggacagcccggattcatcggcgaaatcggcgagaaagggcaaaagggggaatcttgcctgatttgcgatatagatggctatagggggcctcctggtccccagggcccacccggtgaaatcggattccccggacaaccgggagcaaaaggagatcggggtctccccggacgggacggggtggccggagtgccactgctgttccagattcacaagtag

SEQ ID NO: 4666 - DNA, 1797 bp, Artificial Sequence
  Description of Artificial Sequence: Synthetic coding sequence
atgagtgataaccagagctggaactcctccggatccgaggaagaccccgagaccgaaagcggtccccctgtagaacgctgtggagtgctctcaaagtggaccaattacatccacgggtggcaagataggtgggtggtgcttaaaaacaatgcactctcctactataagagtgaagatgagacagaatatggctgtagaggcagcatatgcctcagtaaagctgtgattactccccatgattttgacgagtgtagattcgacatctccgtgaacgactccgtctggtacttgcgggcacaggatcccgatcaccgccagcagtggatagatgccatcgagcaacataaaacggaatctggttatggcagtgaaagctccctcagacggcatggctccatggtatctctggtgagcggcgcttcaggctattcagctacctcaacctctagcttcaagaaaggccactcactcagagaaaagctagctgagatggaaacgtttcgcgacattctgtgccggcaggtcgatactttacagaaatattttgatgcatgcgcggatgcagtgagcaaggacgaactgcagagagacaaggtggtagaagatgatgaggacgacttcccaaccacaaggtcagacggggattttctgcactcaaccaatggaaacaaagagaagctgtttccacacgttacaccaaaggggattaacgggatcgacttcaagggcgaagccataaccttcaaagccaccaccgccggaatcctggcgacgctgtctcattgcatcgagctgatggtgaagagagaggattcctggcaaaaaaggctggataaggagaccgagaagaaaagacgcaccgaggaggcctacaaaaacgccatgactgaactgaaaaagaagtctcacttcggtggaccagattatgaggaagggcctaatagtctgatcaacgaagaagagtttttcgacgccgtggaagctgcgcttgacagacaggataaaatagaggaacaatcccagtcagaaaaagtgagactgcactggccaacaagcctcccaagcggggacgccttctctagcgtcgggacccaccggttcgtgcagaaggtcgaggagatggtgcaaaaccatatgacctacagcctgcaagatgtgggtggcgacgccaactggcagctggtggtagaggaaggagaaatgaaagtgtaccggcgtgaggtggaggagaatggtatcgtcttggatccactgaaggcgacccacgcagtcaagggagtgacagggcatgaggtctgtaactacttttggaatgtggatgtgagaaatgattgggagaccacaatcgagaatttccacgtagtggagaccctggccgataatgcaatcatcatctaccagacgcataagagagtatggcccgctagccagcgggatgtgttatacctgtccgtgattagaaaaattccagcactaacagaaaatgacccggagacatggatcgtttgtaacttttcagtggaccatgattcagcaccactcaacaatcgatgtgtgcgtgcaaagattaatgtcgcgatgatctgccagactctggtcagcccccctgaaggaaaccaggagatttctcgagacaacatactgtgcaaaatcacttatgtggccaacgttaatccaggaggatgggcacccgcatctgtgttacgcgcagttgctaagcgggagtacccaaagttcttgaagagattcaccagctatgttcaggagaagaccgccggaaaaccgatactgttctag

SEQ ID NO: 4667 - DNA, 690 bp, Artificial Sequence
  Description of Artificial Sequence: Synthetic coding sequence
aaggtggaggaaatggtgcaaaaccacatgacctactccctacaggatgtaggtggggatgctaactggcagttagtcgtggaagaaggtgagatgaaggtgtaccgacgggaagttgaagagaatgggatcgtactggaccctctgaaggcaacgcacgcagtgaagggggtgactgggcatgaggtgtgcaattatttttggaacgttgatgtccgaaatgactgggagactacaattgagaatttccacgtggtagagacacttgcggacaacgccatcattatctatcagacacacaagagagtgtggccggcatcacagcgggacgtgttgtacctgtctgtgatcaggaaaatcccagcgttaacagaaaatgaccctgagacgtggattgtgtgtaatttttctgtcgaccacgactcggcgcctcttaataacagatgcgtcagagccaagataaatgtggcaatgatttgtcagaccctggtatcgccacccgagggcaaccaggaaataagtagagacaacattctctgcaagatcacttacgttgcaaatgtcaacccaggcggatgggcccctgcgtccgtgctgagggcagtggctaagagggagtaccccaagttcctgaagcgtttcacctcctatgttcaggagaagaccgcgggtaagccaattctcttctag

SEQ ID NO: 4668 - DNA, 2259 bp, Artificial Sequence
  Description of Artificial Sequence: Synthetic coding sequence
atgcagcactcatgcattccgaccccaccctcccctttcagtgccccacctgcatttttgcccgtggtgactagggaaagcagaaggggactgtccagtggcggatccgccggtagaaacgcaggtgtgactgctaccgcagctgcagccgacggatggaagggcaggttgcccagtccgctggtacttcttcccagaagcgcacgctgccaggccaggcggaggcggggtgggagaacttccagcctgttactgcttcctcccacccctgaaagggcactgtttgccagtccctctcccgatccctcgccacgcggtcttggggcttcctccggggctgccgagggtgctggagctggtttgcttcttggatgtcgcgcttcaatgagcgataaccagagttggaattcttctgggtctgaggaagaccccgaaaccgaatcgggacccccagtcgagcggtgcggagtgttatccaaatggactaactatattcacggctggcaggatagatgggtggtgctgaaaaacaatgcactgagctattacaagagtgaggacgaaactgagtatggatgtaggggctcaatatgcctgagcaaagcagtgatcaccccgcatgactttgacgaatgccggtttgacatctcagtgaacgattccgtatggtacttgagggcgcaggaccccgaccatcggcagcagtggattgacgcaatcgaacaacacaaaacagaaagcggttatggatcagagagtagcctgcggcgtcatggaagtatggtgagcctcgtgagcggcgcttccgggtactcagccacctccacttcgtcattcaaaaaagggcacagcctaagggaaaagctagccgagatggaaacttttcgggacatcttatgtaggcaggtggatacgttgcagaagtatttcgatgcttgtgccgatgctgttagcaaggacgagcttcagagagataaggtggtggaggacgatgaggacgacttcccaaccacgcgcagtgatggcgactttctgcattcgactaatggcaacaaagagaaactgtttccccacgtcacccccaagggcattaatgggatcgatttcaaaggcgaagccattacctttaaagccacaacagccggtattctggctactctgtcacactgcattgagctgatggttaagagggaggattcatggcagaaaagattagacaaagagaccgaaaaaaagcggagaaccgaagaggcttacaaaaacgcgatgacagaactcaagaaaaagtcccactttggcggaccagattacgaagagggacctaacagccttataaacgaagaggaattttttgacgcggttgaggcagccctggataggcaggataagattgaggaacaaagtcagagcgaaaaggtgcggcttcattggccaacttccctgccatcaggcgatgcattcagttccgtggggacccacagattcgtgcagaagccctacagcagatctagcagtatgtccagcatcgacctggtgtctgcaagcgatgatgtgcaccgcttcagttcccaggtggaagagatggtccagaatcatatgacctactccttgcaggatgtcggcggtgacgcaaattggcaacttgtggtcgaggagggagagatgaaagtctatcgcagagaagtggaagagaatggcatagtgcttgatcccctgaaggccacccatgccgtgaagggggtcactggacatgaagtgtgtaactatttttggaacgttgacgtgcgcaatgattgggagacaaccatcgagaactttcacgtcgtcgagacactagcagataatgcaatcatcatctaccagacccacaagagagtgtggccagcctcacaacgggacgtcctctacctgtcagttattcgcaagatccccgcactgaccgaaaatgaccccgagacctggatcgtgtgcaattttagcgtggatcatgactctgcgccattgaataacaggtgcgtgcgggcaaagattaacgtcgccatgatttgccagaccctcgtgagcccaccagagggcaatcaagagatttcccgggacaatatcctctgcaaaattacgtacgtggctaatgtgaaccccggtggctgggcccctgctagcgtgttaagagccgtggccaaaagagagtatcccaagtttctgaagcgtttcacttcatacgtccaagagaagaccgcaggcaaaccaatccttttctag

SEQ ID NO: 4669 - DNA, 1875 bp, Artificial Sequence
  Description of Artificial Sequence: Synthetic coding sequence
atgtcagataatcagtcatggaattcctccgggtccgaggaggatcccgaaacagagagtggacctcccgtggaacgctgtggagtgctgtccaagtggacaaattacatccacggttggcaggaccgctgggtcgtgctcaagaataacgccctcagctattacaaatcggaggacgaaaccgaatatggctgtcgtggctcaatctgtcttagcaaagcagttatcaccccccacgattttgatgagtgtcgatttgatatatccgtgaacgatagcgtgtggtatcttcgcgctcaggatcccgaccaccggcagcaatggattgacgctattgagcagcacaagactgagtctggatatgggtcggagtcatctttaaggaggcacgggtccatggtgtccctggtgtccggagcctcaggatattctgcaactagcacgagctcctttaaaaagggacactcactgcgtgaaaaattagccgagatggagacattccgggatattctgtgccgacaagtggatacactgcagaagtacttcgacgcatgtgccgatgccgtgtcgaaggacgaactccagagggataaggtcgtggaggacgatgaagacgatttcccaacaaccagatccgatggggatttcctgcattcgaccaacgggaacaaggaaaagctgtttccacatgtgacccctaaaggcatcaacgggatcgacttcaaaggtgaagccataactttcaaggcaacaactgcaggaatcttggccacgttgtcccattgtatcgagctgatggtaaagagagaggatagttggcagaaaaggcttgataaagagacagaaaaaaagagacggaccgaggaggcatataaaaatgctatgacggaacttaagaaaaaaagtcatttcgggggtcccgattatgaggagggaccaaatagcctcattaacgaagaggagttttttgacgccgtcgaagcagctctcgacaggcaggacaagatcgaagagcaatcccaaagtgaaaaggtccgcctacactggcctacttcactgccttcgggtgacgccttcagttccgtcggaacccaccggtttgtacaaaagccttattcaagaagctccagcatgtcctccattgatctggtgagcgcatctgatgacgtccaccgcttttcctctcaggtggaggaaatggttcaaaaccatatgacttatagcctccaagacgttgggggtgacgcaaattggcagctggtggtggaggagggcgagatgaaggtgtataggcgggaagtcgaggaaaatggaatcgtcctggatcctctgaaggccacccacgccgtgaagggcgttactggtcacgaggtttgcaactatttttggaatgtcgacgtgcggaatgattgggaaactaccatagagaacttccatgtggttgagactctggcagataacgccatcatcatctaccagacacacaaaagggtgtggcctgcatctcagcgggacgtcttgtacttaagcgtcatccgcaaaatacctgcactaacggagaatgatcctgaaacatggattgtatgtaactttagtgtggatcacgatagcgccccactgaacaataggtgtgtacgcgcaaagattaacgtggcgatgatctgccagactttggtttcgcccccagagggtaaccaggaaatttcacgggacaatatcctgtgcaagattacatatgtcgcgaacgttaacccaggcggatgggcacctgccagcgtgctgagagccgtagccaagagagagtatcccaaattcctcaagcgatttacttcttatgtgcaggagaagacggctggaaaaccaatccttttttag

SEQ ID NO: 4670 - DNA, 381 bp, Artificial Sequence
  Description of Artificial Sequence: Synthetic coding sequence
tgaccggcttcccaaagggacgtgctgtacctatcagtgatccggaagattcccgcattgaccgaaaacgaccccgaaacttggatcgtttgcaacttctcagtggaccacgactctgccccactcaacaatcgatgcgtgagagcaaaaattaacgtcgccatgatttgccagacactcgtgtctccaccagaaggcaatcaggaaatttctcgagacaacatattgtgcaagatcacatatgtcgccaacgtcaacccgggaggatgggcccctgcaagtgtactgcgcgcagtggccaagcgtgaatatcccaaatttctgaagcgctttacttcctacgtgcaagagaaaacagcagggaagccaattctcttctag

SEQ ID NO: 4671 - DNA, 5064 bp, Artificial Sequence
  Description of Artificial Sequence: Synthetic coding sequence
atgtggtccctgcacatcgtccttatgaggtgtagcttccggcttaccaaaagtctggcgacaggcccatggagtcttattctgatcctcttttccgtccagtatgtttatggatcaggcaagaagtatattggcccatgcggtgggagagactgttccgtgtgtcattgcgtgcccgagaagggtagcagaggtccccctggccctccgggaccgcagggcccaataggtccattaggggcacccggacctattggactgtcaggagagaagggcatgcgcggagaccgcggacctccaggagcagcaggcgacaaaggtgacaaagggcctaccggcgtacccggtttccccggactggacggcatccccggacatcccggtccaccaggcccaagaggaaaaccagggatgtcaggacacaacggcagtaggggtgatcctggtttccctggcggacggggagcgctgggcccagggggaccgctcgggcaccctggggagaaaggcgaaaagggaaactcagtgtttattcttggagctgtaaaaggtattcagggcgatcgtggggaccctggcctacccggtctcccgggatcttggggggcaggcggtcctgccggtccaactggatatccgggtgaaccgggtcttgtagggcctcccggacaacccggaaggcctggactgaaagggaacccgggtgtcggagtcaaaggccagatgggggatcccggtgaggtaggacagcagggttcccctggacccacccttctggttgaaccacctgacttctgtctctataagggagagaagggcataaaaggcatccctgggatggttgggctgcccggaccgcctggtaggaaaggggagtcaggtattggcgctaagggtgagaagggtatcccgggtttccctggtcctcggggagaccccggatcctatggctcaccaggcttcccaggcttgaaaggagagttgggtctggtgggcgaccccggactgttcggtctgatcgggccaaagggcgatccgggtaataggggccacccaggaccgccaggtgtgttggtgaccccacccctgcccctgaaaggcccacccggagatccagggttccccggacgctacggggagaccggagacgtagggccacctggcccacctgggctgctcggcagaccgggagaagcttgcgcagggatgataggtccacccggaccacagggctttcccggattacccggtctgccaggggaagccggaatccctgggagacccgattctgcacctggaaaacccggtaaacccggatcgcccggtttgcccggtgcccctggacttcaggggttgcccggttccagcgtgatctactgctctgtaggtaatcccggaccccaaggaatcaaaggaaaagtcggtcctccgggaggaagaggaccaaagggcgagaagggtaacgagggcctgtgcgcttgtgagcccggacccatgggccctcccggtcccccagggctacccggaaggcagggatcaaagggagatcttgggctgccaggctggctggggacaaaaggggatccaggaccacctggggcagaaggcccacctggcttgcccggaaaacacggtgccagcgggcctcctggtaacaagggagcaaagggcgacatggtcgtgagccgcgtcaaagggcacaagggcgaacggggaccggacggccctcccggattccctggccagcccggtagtcacggacgcgacgggcatgctggcgagaagggagaccccggtccacccggagaccatgaagacgccacacccggtggtaaaggatttccaggaccactgggaccacctggcaaggcaggacctgtgggtccccctgggcttgggttccccggacctccaggtgaacggggtcatcccggtgtcccgggacatccaggagtccggggacctgatggattgaaaggacagaagggggataccatttcatgcaatgtgacatatcccggtaggcatggccctccgggatttgacggaccgccaggacctaagggtttcccaggcccacagggggcaccagggctcagtgggtccgatggccacaaaggacggccaggcacacctggaaccgctgagatccctggccctcctggttttaggggcgatatgggcgatccgggattcggaggtgagaaggggagctctccagtgggaccaccgggaccacctgggagccctggcgtaaatggtcagaagggtataccaggcgaccccgcatttggccatctcggaccccctggcaaaagaggattgtctggcgtccctgggattaaaggtccgaggggggaccctggttgccctggcgctgaaggtcccgctggaatacccggattcctaggtctcaaagggccaaagggaagagaggggcacgcaggctttcctggagtaccagggccaccaggacattcctgtgagcggggtgccccaggaatccctgggcaacccggtcttccaggatatccaggcagcccaggtgccccaggcggaaaagggcagcccggagacgtcggtcctccgggacccgcagggatgaagggtctccctggcctgcctggccgacctggtgctcacggcccacctggcttaccaggcataccgggaccctttggcgacgacgggttacctggtcccccaggtcctaaggggccacgtggactgccagggttcccaggcttccccggagagcgaggcaagcctggagcagaaggctgccccggtgcaaagggggaacctggcgaaaaggggatgtcaggcctacctggggatcgtgggttgaggggcgcaaagggagctattggccctcctggggatgaaggcgaaatggctataatatcccagaaggggactccaggtgaacccggtcctcccggtgatgatggtttcccgggagagaggggtgataaaggaacgccaggcatgcaaggcaggagaggagagcctggcagatatggacccccaggcttccacagaggcgagccaggggagaaaggacagcctggcccacctggccctccagggccacctggaagtaccgggctgcgaggcttcatagggtttcctgggcttccgggtgatcaaggggagccgggatcccctggacctccaggatttagcgggatcgatggagctcgtggcccaaagggaaacaaaggtgaccctgcatcgcacttcggtccacccggtcccaaaggcgagcccggaagccctggctgccccggtcattttggagccagtggcgagcagggactgccaggaattcagggacctcgcggatctcccggacgccctggaccccctggaagttcagggccaccaggatgtcctggggaccatgggatgcccggtctcaggggccagcccggagaaatgggggaccctggtcctaggggcctgcaaggagatccaggaataccaggacctccaggcatcaagggcccatccgggagtcccggtctgaacggactgcacggcctaaaggggcagaagggtacaaaaggagcctctggtctgcatgacgttggacctccagggccagttgggatccctggactcaaaggagaacggggagatcccggatcccccggaatatccccaccaggcccacgtggaaaaaagggaccaccaggtccccctggatcgagcgggccacccggaccggcaggcgctaccggtcgagctcctaaagatattcccgatccaggaccacccggtgatcaagggccacctggtcccgacggcccaagaggggcaccagggcctcctggcctacccggttctgtggatttgttgagaggagaacctggggactgcggtttacccggaccaccaggcccaccaggacctccaggaccacctggatataaaggattccctggctgtgacggcaaggatgggcagaagggcccagtggggtttcctggaccgcaagggcctcacggatttcctggaccacccggtgagaaaggactgcccggtcctccagggagaaagggcccaaccgggttacctggagaaccgggtcctccagccgatgtggatgactgcccccgaatccctggcctccccggagctcccggaatgcgcggacctgaaggcgctatggggctccctggcatgcgcggaccctctgggcctggatgcaagggcgaaccaggcttagatggacggaggggggtagatggagttccaggatcaccaggcccaccagggcgaaaaggcgataccggggaggacgggtatcccggaggtccaggacctccgggtccaattggcgaccctggaccaaaaggattcggcccaggttacctcgggggatttctgctcgtcctgcacagtcagactgatcaggaacccacttgcccactcgggatgcctaggctctggactgggtactccctcctttatttggaaggtcaggaaaaggcccacaaccaggacctgggacttgcaggttcgtgtctgccggttttctccactttgccttttgcttattgtaacatacaccaagtgtgccactacgcccaacgcaatgaccgctcctactggcttgcttccgccgctcccttacctatgatgcctctcagcgaggaagccataagaccttacgtttcgcgctgcgccgtatgcgaagcccctgcccaagcggtggcggtccattcgcaggatcagtccattcctccatgcccacaaacctggcgaagcctttggataggctatagtttcctcatgcacactggagctggcgaccaggggggtgggcaggctcttatgtcaccgggaagttgcctggaagactttcgggctgcaccatttctggagtgccagggaaggcagggtacgtgtcatttcttcgccaacaagtatagcttctggctgactacagtcaaggccgacttacagttctcttccgcaccagcgccagacaccctgaaggaaagccaagcacagcgccagaaaatatctcgatgccaagtttgtgtgaaatattcctag

SEQ ID NO: 4672 - DNA, 5072 bp, Artificial Sequence
  Description of Artificial Sequence: Synthetic coding sequence
atgtggagtctgcatatcgtgttaatgaggtgctcattcaggttaacaaaatccctggcgaccggaccctggtccctcattctgattctgttcagtgtgcagtacgtctatggttccggcaaaaagtatattgggccatgcggcggacgcgactgttctgtctgccactgtgtgccagaaaaaggatctcgcggacctccgggtcctccaggtccgcagggacctattggccctctcggtgccccaggtcccattggactttccggcgagaaaggcatgaggggtgacagaggtccccctggtgcggctggagacaagggggacaagggacccaccggcgttcccggattccccggactagacggcatccccggacaccccggtcccccaggccctcgcggtaaacctggaatgtctggtcacaacggcagccgaggcgacccaggattcccaggtggacgcggagcccttgggccagggggacccctgggccaccctggggaaaagggagaaaagggtaactcggtttttattctgggcgcagtgaagggaatacagggcgaccgaggggacccaggactccctggccttccagggtcatggggagcgggtgggccagctggcccaaccggctaccccggagagcctggcctcgtcggtccgccaggccaacccggaaggcccggtcttaaaggtaatccaggagtcggcgtaaaaggtcagatgggcgatccgggtgaggtgggacagcagggcagtcctgggccaacattactggtggagccacccgatttttgtctgtacaagggagaaaagggcatcaagggcatcccaggaatggtggggttgccaggccctcccggaagaaagggcgaatcggggatcggggctaaaggggaaaaaggcatacccggttttcctggaccacgcggagacccaggaagctatgggtctccaggatttccaggactcaagggcgaactgggtttggttggagatccaggcctctttggactcatcgggccaaagggggatcccggtaatcggggtcacccaggcccaccgggtgtgctcgtgacccctccgttgcccctcaaggggcctccaggcgacccaggtttcccgggacggtacggcgagaccggcgatgtgggaccacctggaccacctggtctgctcgggcgacccggagaagcatgcgccggaatgatcggaccacctggaccccaagggttcccgggactccctggcttgccaggggaggccggaattccaggaagaccagactctgctccaggcaaacccggaaaacctgggagcccaggtttaccgggtgctcccggattacaggggctgccaggcagctctgtaatctactgttcagttggaaatcccggaccacaagggatcaaaggaaaggttggtcccccagggggtcgcggacctaaaggagagaaagggaacgagggtctgtgcgcctgtgaaccagggccaatgggccctcccggtcctcccggattgccaggcaggcagggaagcaaaggggaccttggactcccaggctggctcggaacaaagggggaccccggtccacccggagcagaaggtcctccaggattgccgggaaagcacggtgccagcggaccaccaggaaataaaggcgctaagggggatatggtggtgtcccgcgtaaagggccacaagggcgagcgcggaccggatggtccaccagggtttccaggccagcccggttcacacggcagggacggtcatgctggtgagaagggcgaccccggacccccaggagatcacgaagacgctacccctggcggtaaagggttccccggtcctttgggacctcctgggaaggccggacctgtgggcccacccggtctcggttttcccggtcctcctggtgaacgcggtcatccaggagtgcccggacaccctggggtgcgagggcctgatggtctgaaaggtcagaaaggagacacgatctcttgtaacgtcacttaccccggaaggcacggacccccaggttttgacggcccacctgggcctaaagggtttccaggaccgcagggagcccctggtctgtccggcagcgatggccataaaggacggcctggcaccccaggcaccgctgagataccgggacctcccggttttagaggagacatgggagatcccggtttcggcggagagaaggggagcagtccagtgggcccacctggacctcccggttcccccggagtcaacggtcagaaggggattccgggagaccctgctttcggccacctcggccctcccggtaaacgtgggttatcaggcgttcctggtattaagggtccgcgtggcgatcccggttgtcccggagcagaaggcccagccggtattcccggtttcctgggtctgaagggcccaaagggtagggagggccacgctgggtttccaggtgtgccaggaccacctggccactcttgcgaacgcggtgcaccaggtatccccggacagcccggtctgcccggttatcccggttcacccggagccccagggggaaaaggtcaacctggagatgttgggccaccaggccctgcgggaatgaaaggcctacccggactgcctgggcgaccaggcgcacacggtcctcccggactgcctggcataccgggaccatttggagacgatggcctgcctggcccaccaggccctaaaggcccacggggactcccagggtttcccggattccctggagaaagaggcaaacctggcgcagagggctgccctggagctaagggagagcccggagaaaagggcatgagtggcttaccaggagatagaggcctgagaggggctaaaggggctatcggaccccctggcgatgaaggtgaaatggctatcatctcccagaagggcaccccaggcgaaccgggtcctcccggagatgatgggtttccgggagagcgaggagacaaagggaccccaggcatgcaaggccgacgtggagaaccgggaaggtacggacctccaggattccatagaggcgaacctggagagaagggccaaccagggccaccaggcccacctggaccaccaggatccaccggtcttcggggtttcataggctttcccggtctgcccggtgatcaaggggaaccaggatctccaggacctcccggtttctctggaatcgacggggctcggggtccaaagggtaataagggggatcccgcatcccactttggtccaccaggtcccaaaggagaaccaggcagccccggttgtcccggtcacttcggagcctcgggggagcagggcctgcccggaatccagggcccacggggttctccaggaaggcctggcccaccaggatctagtgggccaccaggatgcccaggagaccacggcatgcctggcctccgcggacagcctggcgaaatgggcgacccgggaccccgaggtctgcagggcgatcccggaatcccaggaccccctgggatcaaaggcccttctggatctccgggattgaatgggctccatgggctgaaaggtcagaagggaactaagggcgctagtggcctccatgatgtcgggccacccggtccagttggcatcccaggcctgaagggagagcgaggtgatccaggttccccgggaataagccctcctggccctcgcggtaaaaaaggtcccccaggaccccctggctctagcggaccgcctggccctgccggagcaaccgggcgtgccccaaaagacatacctgaccctgggccacccggagaccagggaccacctggtccagacggacctagaggcgctcccggtcctccagggctccccggaagcgtcgacctgttacggggtgagccaggcgactgcgggttgccaggtcccccaggacctcccggtccacccggaccaccaggttacaaaggtttccctggctgcgatggaaaggatggccagaaggggcctgtggggttcccaggtccccagggaccacatggattcccagggcctccaggtgaaaagggtctgccaggtccaccaggtcgcaagggccctactggtctaccaggccctcggggagagcccggacccccagctgacgtggatgactgccccaggatccccggactcccaggagcgcctgggatgcggggaccggaaggcgcaatgggcctgccgggaatgagagggccaagcggccctggctgtaaaggggagcctggtctcgacggtcgcagaggcgtcgacggagttcccggaagccctggacccccaggcaggaaaggtgataccggggaggacggctatccaggtggaccaggcccacctggaccaatcggtgatcctggtcccaagggttttggccctggttatctgggcggtttccttttagttctgcacagccagactgaccaggagcctacttgcccacttggcatgccgaggctctggacaggctacagcttgctgtatttggaaggccaggaaaaagctcataatcaggacctgggcttagccggaagctgtttaccagtattcagcactcttccctttgcctactgtaacatccaccaggtctgccattatgcgcagcggaacgatcgatcatactggctggcgagcgcggcaccactgcctatgatgcctctgtccgaagaggcgatccggccatacgtgtctaggtgtgccgtgtgtgaggctccagctcaagcagtggcagtccactcacaggaccagtccattccaccttgtccccaaacgtggagaagtttgtggatcgggtatagcttccttatgcacaccggcgctggtgatcaaggaggcggacaggccctaatgtctccgggatcttgcttggaggattttcgcgcagccccattccttgaatgccagggtcggcaaggaacctgccatttttttgccaacaaatatagcttctggctgactacagtgaaagcagacttgcagtttagcagtgcgccagctccagacacgctcaaagaatctcaggcccagcgccagaagatctccagatgtcaggtgtgtgttaagtactcata

SEQ ID NO: 4673 - DNA, 5075 bp, Artificial Sequence
  Description of Artificial Sequence: Synthetic coding sequence
atgaagcttaggggggtgtccctggccgcaggacttttcctgctcgcactatccctgtgggggcagccagcagaggctgcggcttgctacgggtgtagccccggttccaagtgcgactgcagcggaattaagggtgaaaaaggagagcggggtttccctgggttggagggacaccctggcttaccaggttttcccggtcccgagggaccacctggaccacggggacagaagggtgatgatggaattcccggacctcctgggccaaaaggtattcgtgggcctccaggtctgccagggtttcctgggacaccaggcctccccggaatgcccggtcacgacggggcaccgggtccacagggtattccagggtgcaatgggaccaagggagagcggggatttccagggtcacctgggttcccaggactgcagggccctcccggacctcccggtatcccaggcatgaaaggtgaaccaggtagtatcatcatgtcctctcttcctggaccaaaggggaatcctggatacccgggacccccaggaatacaggggttgccgggtccaacagggattcccggacctattggtccaccaggccctcctgggctgatgggccctcctggccctccaggcctccctggtcctaagggcaatatgggcttgaatttccagggccctaaaggcgaaaagggggaacaggggctgcagggccctccaggtcctccgggacagatctctgaacaaaagcgacctattgacgttgaatttcagaagggcgatcagggtttgccaggagatcgcggaccaccagggcctcctgggattcgcggaccacctgggccacctggcggtgaaaaaggggaaaaaggcgaacaaggagaacctggcaagaggggaaagcccggaaaagacggtgagaacggtcaaccaggcatcccgggattaccaggcgaccccggatatcccggagagcccggaagagacggtgagaagggacagaaaggcgacacgggaccacctgggcctccagggctggtcatccccaggccaggcaccgggatcactattggtgagaagggtaacatagggctgccgggactgcctggggagaaaggcgagagaggcttcccgggaatacagggccctcccggtcttccgggacctccaggggcagccgtgatgggcccaccaggaccaccagggttcccaggcgaaagagggcagaaaggagatgaaggtccccctggaatttcaatcccaggcccacctggactggacggccaacccggtgctcccggactaccaggacctccagggcctgcagggccacatatcccaccatcagacgagatctgtgaacccggaccacccggtcccccagggtctccgggagacaaaggcctgcaaggggagcagggggttaaaggcgataagggggacacttgcttcaattgtattgggacaggcatatctggacctccgggtcagccagggttaccgggactgccgggacccccaggctcccttgggttccctggccaaaagggtgagaaaggtcaggcaggagccactggcccaaaaggtcttccgggtatacctggggcacctggcgcacctggcttccctggatcaaaaggcgaacccggtgatattctcacgtttccgggaatgaaaggtgataaaggagagctgggctcccctggcgctccgggtctccccggtttaccaggtacccccggacaggatggtttgcctggactgcccggaccaaaaggtgagccagggggtattacattcaagggcgaacgcggtccccctggcaatcccggtctgccagggctgcctgggaacattggaccaatgggccctccgggattcggtccacctggccctgtcggtgaaaaaggtattcaaggcgtggccggtaaccctggtcagccgggtatcccaggaccgaaaggagacccagggcaaaccatcactcagcccggaaagccaggtctgcccggaaaccccggaagagatggagatgtgggcctgcctggggaccctggcctccctgggcagccgggattgcccggaataccagggtcaaaaggggagccaggcattcctgggataggcctccccggtcctccaggtcctaaaggatttcccggaatcccgggacctcccggagcaccgggtacccccggacggatcgggctcgaagggcctcccggtccacctggctttcccggacctaagggcgagcccggtttcgcgcttcccggtcctcccggtccccctgggttgccgggtttcaaaggcgcactcggccctaagggtgaccggggattccccggaccacccggaccccctggtaggactggattagacggcctgcccggaccgaaaggcgacgtcggacctaacggccagcccggtcccatgggccctcccggtctaccaggaattggggtgcagggccctccaggacccccagggatcccagggccaataggacagccgggtcttcatggcatccccggagaaaaaggggacccaggccctccaggactggacgtgcccggacctcccggtgaaaggggttctccaggtatccctggagctccgggaccaattgggcctccagggtcgcctggtctgcccggtaaagctggggcatctggttttcccggaacaaaaggtgaaatgggcatgatgggccctcccggtccccctggccctctgggtatccccggaaggtccggagtgcccggtctgaaaggcgacgacgggttgcagggacagcccggtctgcctgggccaactggggagaaagggagtaaaggggagccaggccttcctggacctccagggcctatggaccccaacttactgggcagcaagggtgagaaaggcgaaccaggtctgccaggaattccaggagtttccggacctaaaggctaccagggactgcctggagacccgggacaacccggactgagcggccagcctggactgcccggtcccccaggtcccaagggcaaccccggtctgcccggtcaacctggactcatcgggcctcccggactgaaaggaaccattggcgatatgggctttcctgggccacagggagtggagggccctccaggaccaagcggagtcccaggccagccaggttcccccggattaccagggcagaagggagacaaaggagacccgggaatctcgagtatcggcctaccaggcctgcccggtcctaagggtgaacctggactgcccggatacccagggaacccgggaataaagggctctgtgggtgatcctggcctccccggtctccccggaaccccaggagccaaaggacaacccggtctgccgggtttcccaggcacccccggacctcccggacccaaaggcatttctgggcctccaggcaaccccggacttcctggcgagcctggccctgtcggagggggagggcaccccggtcagcccggtccgccaggggagaaaggcaagccaggtcaggacggaataccgggacctgcgggacaaaaaggggagccgggtcaacccggatttgggaacccaggcccacctggtcttccaggactctccgggcagaaaggagatgggggacttcctggaatcccgggtaaccccggtcttcccggacctaaaggcgaaccaggatttcacggcttccccggtgtccaggggcctccgggaccacctgggagccccggaccggcactcgaaggcccaaaaggaaatcctgggccacagggccctcctggtagacctggacccacgggttttcaaggactcccaggccctgaaggccctccaggacttcctgggaatggcggtattaagggcgagaaggggaaccccggtcagcctggactaccgggtctacccggtttaaagggggaccagggtccacctgggctacagggaaacccgggtcggccaggccttaatggaatgaagggcgatcctggcctgccgggagtccctggcttcccaggtatgaaggggccatcaggggtgcccggttctgcgggtcccgagggcgaaccaggcttgatcggcccacccggaccacctggactgcccggacccagcggtcagtctattataataaaaggggatgcgggaccgccaggcatcccaggccagcccggtctgaaggggctccccggtccccaaggtccccagggcctccccggtcctactggccctccaggcgatcccggaaggaacggccttcctggatttgatggagcaggaggtcggaaaggtgacccaggactcccgggacagccgggaacgcgaggactcgacggccctcctggaccagacggcctgcaaggtccaccaggccctccaggcactagttctgtggctcatggtttccttatcacccggcattcacaaactacagacgcccctcagtgcccccaagggaccctccaggtctacgagggcttttcactgctctatgtgcagggaaataagcgggcacacggccaggacctggggacagcaggttcttgcttacgacgcttttccaccatgcccttcatgttttgtaacatcaataatgtctgcaattttgccagtagaaacgactatagttattggctatcgactccggagcccatgcctatgtctatgcagcctctcaagggtcagagcatccagccattcatctcgagatgcgccgtctgtgaagctcccgctgtggtgatcgccgtacacagtcagaccatacagatcccgcattgtccacaggggtgggactctctctggattggctatagcttcatgatgcatacaagcgccggtgccgaaggctctggtcaagcccttgcctcaccaggatcatgtcttgaggagttcagatctgcaccattcattgaatgtcacggcagaggcacctgcaattactatgcaaacagctactctttttggctggctacggtcgatgtgagcgacatgttcagtaagccacagagcgaaactctgaaggccggagacctgcggacccgcattagcaggtgccaagtttgtatgaaacgtacata

SEQ ID NO: 4674 - DNA, 5057 bp, Artificial Sequence
  Description of Artificial Sequence: Synthetic coding sequence
atgaagttgcgcggtgtgtctctggcagctggtttattcctactggcactaagtctatggggccagccagcagaggccgctgcctgctacgggtgtagccctggctccaaatgtgactgcagtggcattaagggcgagaagggtgagcgcggattccccggattggagggacaccctggattgcccggattccctgggccagagggtccaccgggaccacgaggccaaaaaggtgacgatgggattcctgggccacccggacctaagggcatacgcggacccccagggttacctggctttcccggtacaccaggcctccctgggatgcccggacatgacggggcacccggacctcagggaattcccggttgtaatggaactaaaggagagagaggcttccccggttcgcctgggttcccaggactgcagggaccccctggcccacctggaatccccggaatgaaaggggaaccagggagcattataatgagcagtctccctggaccaaagggcaaccctggatatcccggaccccctgggatccagggccttcccggacccaccggcattcccggtccaatcggtccacctggtccgccaggattgatgggcccacccggacccccaggtctccccggtccaaaaggaaacatgggcctgaactttcagggtcctaagggagaaaaaggcgaacaggggctgcaggggcctccaggcccacccggtcagatctccgaacagaaaagaccaatcgatgttgaattccagaagggagatcaaggtctgcctggcgacaggggccctcccggtcccccaggtattcggggaccccctggacctcctgggggagagaaaggagagaagggcgaacagggagaacctgggaagaggggtaagcctggaaaagacggcgaaaatggacagccaggaatccctggactgcccggtgatccgggttaccctggcgaaccaggtagagacggtgagaagggtcagaaaggcgataccggcccacccggtcctccgggtctggtgatcccacgccctggaacaggtattacaattggtgaaaaaggtaatatcgggctgcccggactccccggagagaaaggggaacggggtttccctggaattcaggggccaccgggtctccctggccctccgggtgccgctgtcatgggcccaccgggacctcctggatttcctggagagcgaggtcagaagggcgacgagggaccccctggcatctcaataccgggacctccgggactggacggccagcccggagcaccgggtctgccagggcctccgggaccagctggcccacacatccctccatccgacgagatatgcgaacctggcccacccggtcctcccggaagccctggagataagggactacagggggagcaaggagtcaaaggcgacaagggcgacacatgttttaattgtattggaacggggatcagcggtcccccaggccagcctgggctcccaggtttgcccggaccaccgggttccctgggattcccaggccagaaaggggagaaaggacaggccggtgcaaccggtcccaagggcctccccggtatacctggcgcacctggcgcaccaggtttccctggaagcaagggcgagccaggcgacatcttgacttttccaggaatgaaaggggacaaaggcgaactgggctccccgggagccccagggctccctggactgcccggtacacctggacaagacgggttgcccggactccctggacctaaaggagagcctggtggaatcacctttaagggcgagagagggccacctggcaatccaggcctgcccggactacctgggaacatcggccctatgggccctccagggtttggaccaccaggccctgtgggcgaaaaaggaatccagggcgtggccggtaaccccggtcagccgggaattccgggtcctaaaggtgaccccggacaaaccatcacccagccgggaaagcccggtttaccgggaaaccctggacgagacggggacgtgggactcccaggcgatcctgggctgccaggtcagcccggactgcccggaatccctggctcaaagggcgagcctgggattcccggaatcgggctgccaggccctcccggtcccaaggggttcccaggaataccaggcccacctggagcccctggtacacccggaaggattgggctggaaggcccaccaggcccacccggattccccggaccgaaaggagagccgggatttgcattaccaggccctccaggcccacccggattaccaggcttcaaaggggctttgggcccaaagggggacagaggattcccaggccctcccggtccccctggacgcacaggcctagatggtttaccagggcctaaaggcgatgtcggtccaaatggccagcctgggccaatgggaccccctggacttcctgggattggagtgcaaggtcctcctgggcctccaggcatacccggaccaataggccaacccggactccacggtatccctggtgagaagggtgatccgggacccccagggttagacgtgcccggacccccaggtgagcgtggtagccccggaatccctggggctccaggccctattggaccccctggcagccccggtcttccaggaaaggctggggcaagtggctttccgggaactaaaggtgagatgggcatgatgggtcccccagggccacctggacctctgggcatccccggaagatcaggagtcccagggctgaagggggacgacggcctgcagggccagcctggcctgccgggtccaaccggagaaaaagggtccaagggcgagcccggactgcccggtcctccaggacccatggatcctaatctgctgggatcaaagggcgaaaaaggggagcccggtctcccaggaatccccggagtgtcaggacctaagggttatcagggccttcccggagacccaggtcaaccgggtttatcaggccagcccggtctgccaggccctcccggtccgaagggcaaccctgggttgcccggacagcccggtctgattggcccaccaggcctcaaagggactataggagacatgggatttcctgggccacagggtgtcgaaggaccacccggtccatctggcgtccccggacaaccaggatcacctggcctgcccggacagaaaggtgacaaaggcgatcctggaatctcctctattggcctcccaggtcttcccggacccaagggtgaacccggactgccagggtacccaggcaacccaggtatcaaagggagcgtgggggacccaggactgcccggtcttccaggcactcctggggctaaaggacagcccggactgccagggtttcccggaacaccgggacccccaggcccaaagggcatctcaggcccacctggcaatccgggactcccaggagaaccgggacccgtcgggggaggcggtcaccccggacaaccgggacctccaggagagaagggcaaacccggacaagacggaattccaggacccgctggacagaagggagagcctggccaacctggtttcggcaaccctggcccaccaggtctacccggattgagcggccagaaaggggatggtgggctgccagggattcctggcaacccaggcctcccgggaccaaaaggcgagccagggttccacggttttcccggagtgcagggccctcctggccctccaggcagtcctggtcctgcacttgaagggcctaaaggcaatcccggaccacaggggcctcccggacgcccaggcctgcccggacccgaaggcccacctggcctgcccggaaacggtgggattaaaggggaaaagggcaacccagggcagcccggactccctggccttcctgggttaaagggcgaccagggcccaccaggactccagggcaatccaggtagacctggactgaatggtatgaagggggacccaggacttcctggcgttccgggttttcccggaatgaagggacctagcggcgttcctggctccgccggacccgagggagaacccggactgataggcccaccaggaccccctggactgcctggaccctccggccagagtataatcatcaagggagacgccggtccaccaggcattcccggacagccaggcctgaagggcctgcctggacctcagggaccccaggggctccctggtcctacagggcctcccggtgaccctggcagaaatggtcttccgggattcgacggtgccggtgggagaaaaggtgatcccggtctcccaggtcagcctgggactagaggtctggacggcccacctggcccagatggcctgcagggccctcctgggcctccaggaacatcttcagtagcccacggattcctgattaccagacacagccagacaactgacgccccacagtgcccacagggaacgctgcaggtctatgaaggattctcactgctctatgtgcagggaaataagcgagcccacggccaggatctgggcactgccggaagctgcttaaggcgcttctcaaccatgccatttatgttctgcaatataaacaatgtatgtaacttcgcctcacgaaacgattactcctattggttgtcaacccccgagccaatgcccatgagcatgcagcccctgaaagggcagagtatccaaccttttatttcccgttgcgccgtgtgtgaagccccagctgttgtgatagccgttcactcccagaccatccagattccccactgtcctcaggggtgggactcactctggatcggctatagctttatgatgcacacatctgccggagccgaaggaagtggacaagcccttgcctctcctgggagctgcctcgaggaattcaggtcggccccattcatcgaatgccacggacggggtacttgtaattactacgctaatagctattctttctggcttgcaacagtcgacgtgagcgacatgttttcaaaaccccagtcggaaactctgaaggcaggcgatttaaggacacggatctcccgctgccaggtctgcatgaagcggactta

SEQ ID NO: 4675 - DNA, 5076 bp, Artificial Sequence
  Description of Artificial Sequence: Synthetic coding sequence
atgaaactgaggggtgtgagcttagccgcaggactgttcctgctggctctttccctgtggggacaacctgctgaagctgccgcatgctacgggtgttcacctgggagcaaatgcgactgcagcggtataaagggggagaagggggaaagagggtttccagggctcgaggggcaccccggattaccgggtttccccggtcccgaaggccctccaggtcctcgcggtcagaaaggtgatgatggcattcccggaccaccgggtccaaaaggcatcagaggccctccaggactcccaggatttccgggaacccctggcctgcctgggatgcccggacacgacggggcaccagggccacagggaattcccggatgcaacggaacgaaaggtgagcgcggattccccggatccccaggtttccctgggttacaggggccaccaggcccaccagggatccctggaatgaaaggggaacctggcagtattataatgtcctccttgccaggcccaaagggaaaccccggttatcccggacccccaggaatccagggcctccccggacccaccggcattccgggaccaatcggaccccctgggcctcccggactgatgggacctccaggccctcctggcttacccggtcccaaggggaacatgggcctgaactttcagggaccgaaaggcgagaaaggagaacagggtcttcagggccctccgggaccacccggtcagataagcgaacagaagagacccattgacgttgaattccagaaaggagaccagggactgccaggagatcgaggcccacccggaccaccaggaatccgcggtccccctggtcctcccggtggtgaaaaaggtgagaaaggggaacagggagagccgggtaaaagaggaaaaccaggaaaagacggtgagaacggacaacccggtatccccggtctgccaggggaccctgggtatcccggagaaccgggtagagatggagaaaaaggccaaaaaggcgacacaggccctcccggtcccccaggcctcgtgattcctagacccggtactggtattaccattggagagaagggcaatattggactacctggcctccccggagaaaaaggggaaaggggcttcccaggaatccagggccctccaggtctgcccggacccccaggggctgctgtaatgggtccgcctggacctcccggatttcccggtgagcgcggacagaaaggagacgaggggcctcccggtatttctatccccggtcctcctggattggacggtcaacctggcgcaccaggcctcccagggcctccgggacctgctggccctcacatccccccttccgatgagatctgcgagccagggccacccggtcccccaggctccccgggagataaaggactccagggggagcagggcgtgaagggagataaaggggacacctgtttcaactgcataggtactggcatctctggccctcctggccagcccggattgcccggattacctggcccacctgggagtttgggcttcccaggccagaagggtgaaaagggacaggcgggtgctaccggtcccaagggtctgccaggtatcccaggcgcacctggcgcacccggattccctggatctaagggagaacccggagatatccttacctttcccggaatgaagggagataagggcgaattaggctcaccgggagcaccaggccttccaggccttccaggaacccctggccaagatggtctgccagggttgccaggacctaaaggggaacctggaggaatcacattcaaaggcgagaggggcccacctggaaatccgggactaccagggctccccggaaacatcggcccaatgggcccacccggtttcggccctcccggtccagtcggagagaaggggatccagggagtggccggaaaccccggacagcctggcatccctggtccaaaaggcgacccaggacaaacgatcacccaacctggcaagcccggactacccggtaatcctggacgcgacggcgacgtgggactccccggtgaccctggcctccccggacagcccggtttgcccggtattccagggtccaagggcgagccaggcataccaggaatcggtctcccgggacctcccggaccaaaaggattccctgggattccaggacccccaggggcacccggtactccaggcagaatcggccttgaagggccacctggaccaccgggatttcccggtcccaaaggggagccgggttttgccttgccagggccaccaggaccacctgggctacccggattcaagggcgctcttggcccaaaaggcgaccggggattcccaggaccacccggacctcctggaagaacaggcctggacgggttacctggtcctaaaggcgacgtcgggccaaatggacagcccggtcccatgggccctccgggtctgcctggtataggagtgcaggggcctcccggtccaccaggcatccctgggccaataggacagcccggactgcacggtatccccggagaaaagggtgatccaggaccaccaggtttggacgttccaggccctcctggcgaacgagggtctccaggaatcccaggtgcccctgggcctatagggcctcccggttcccccggactgcccggtaaggcgggtgcctctggcttccccggaaccaagggagagatggggatgatgggccctccgggacctccaggtccactcggaataccaggccgaagcggggtgcctgggctgaagggggacgatggcctgcagggccagccaggtctcccagggcctacgggggaaaaaggatccaagggagaacctggcctgccaggccctcccggaccaatggatccaaacctacttgggtccaagggtgagaagggagaacctggtttgcccggtatcccgggagtgtctggtcccaaggggtatcagggattgcctggcgaccctggacaaccgggactgtccggccagccaggactgccagggccaccaggacccaagggcaacccagggttacctggacagccaggacttatcggtcctccgggactgaaaggcaccattggtgatatgggctttccaggtccccagggtgtagaaggccctccagggccttctggcgttcccggacagcccggatcccctggtcttccaggtcagaaaggtgacaaaggagatcccggtatttcatctatcgggttgccaggtctgccaggacccaagggcgagcccggattacctggctatcctggaaatccgggtattaagggaagcgtgggggatccgggactgccaggactccccggaacaccaggagctaaggggcagcctggcctccccggattccccggtacacccggtcctcctggcccaaagggcatctcaggcccacccggaaatcccggactgccgggtgagccgggacctgtgggtggcggagggcaccccggacagcccggtcccccaggagagaaggggaagccaggtcaagacggcattcctgggcctgctggacagaaaggcgaacctgggcagccaggctttggcaatcctggacctcccggactccccggactttctggacagaaaggagatgggggacttcctggaataccaggcaacccaggactgcctggcccaaagggtgagcccggtttccacgggtttcctggagttcagggccctcccggaccgccaggaagccctggacccgctctcgagggaccgaaagggaatcctggacctcagggaccacctggcaggccaggtccaactgggtttcagtcccttccaggccctgagggacccccagggctgcctggtaacggcggaataaaaggagagaagggcaatccgggacagccaggcctacctggcctacctggactcaagggggaccagggccctcccggtctgcagggaaatcccggtcgccctggcttaaatggaatgaaaggcgaccctggtctccctggcgtgccaggatttcccggaatgaaagggccttctggtgtgcccggaagtgccggtccagaaggagaacctgggttgatcggtccacccggaccccctgggctgcctggcccttccggtcaaagtatcattataaaaggagacgccggaccacctggcattcctggtcagcccggacttaagggccttcctgggccacaaggcccacagggcctaccaggcccaacgggacccccaggcgatcccggaagaaatgggctccccggatttgacggcgcaggaggacggaaaggagaccctggcttgcccggacagccaggaactcggggacttgacggacctccaggacctgatggactgcagggccctcctggacccccaggcacaagtagcgtcgcccacggattcttgatcacccggcattctcagaccacagacgcccctcagtgtccacaaggaactctgcaggtctacgaagggttctctctattgtacgtccaggggaacaagagagcacatggccaggatctgggaacagcgggatcctgtctacgtcggttttcgacaatgccttttatgttttgcaatatcaataacgtgtgtaattttgcaagtcgtaacgactactcttattggctgtccactcccgagcccatgcccatgtccatgcagcccctgaaaggccagagtatccagcctttcatctcgagatgcgccgtgtgtgaggctcccgctgttgtgatcgccgtccattcacaaaccatccaaattcctcactgcccgcagggatgggactccctgtggattgggtatagctttatgatgcatacctccgccggtgctgaaggcagcggccaggcgctggcatctccaggtagctgtctggaggagttccgtagtgccccatttatcgagtgccacggacggggaacatgcaattactacgccaactcgtacagcttctggcttgccacagtcgatgtgtccgacatgttctcgaagccgcaatccgaaacactgaaagctggcgacctgaggactcgaatctcccgctgtcaggtttgcatgaaacggacttag

SEQ ID NO: 4676 - DNA, 5072 bp, Artificial Sequence
  Description of Artificial Sequence: Synthetic coding sequence
atgcatcctggcctttggctgttgctggtgacactgtgtttgaccgaggaacttgccgctgccggagaaaaatcctatgggaaaccatgcggaggtcaggactgctctggttcatgtcaatgtttccccgagaaaggagcgagaggacgccctggacccataggaattcaaggacccactgggccacagggcttcactggctccacggggttgtcaggcttaaagggagaacggggtttccccggtcttctggggccatatggtcccaaaggggataaagggcctatgggggtccctgggttcctggggattaatggcattccaggacatcctgggcaacccggtcctcggggaccccctggcctggatggctgtaacggaacccaaggcgctgtcgggtttccaggacctgacgggtatccaggcctgctcggcccacctggactccctggccagaagggctctaagggcgaccctgtgctcgctccaggctcctttaagggaatgaagggcgaccccggattgccaggactggacggcattaccggaccccagggagccccagggtttcctggagctgtgggcccagctggcccaccaggcctgcagggcccacccggaccccctggccctctcgggccagatggaaacatgggactgggttttcaaggcgagaaaggagtcaaaggggatgtgggcctgcctggacctgcaggacctcctccctctacaggagagcttgaattcatgggattccccaagggaaagaaggggagcaaaggcgaaccaggacccaaaggctttccaggtatatccgggccacccggattccccggacttgggactactggtgagaagggggagaaaggcgagaaaggtattccgggacttcccggaccgcgagggccaatggggagcgagggcgtccaggggcctccagggcagcagggcaagaagggaactttaggattcccaggcctgaacgggtttcagggcatcgaggggcaaaagggagatattggtctgccaggcccagacgtgttcatcgatattgacggcgcagtgatttctggcaacccaggcgatcctggggtaccgggtctccctggcctaaaaggcgacgagggtatccagggactacgtggtccttccggagtgcctggcctgccagctctgtcgggtgttccaggcgctcttggccctcagggtttccccggactaaagggagaccagggcaatcccggtcgaaccacaattggtgctgccggactgccaggccgagatggactacccggtcccccaggcccacccggaccgccttccccagagttcgagactgaaactctgcataataaggagtccggatttccaggcctgcgaggggaacagggaccaaagggcaatctgggcctgaagggcataaaaggggatagcggattctgcgcatgcgacgggggagtgcctaataccggccctcccggtgagcccggtccaccgggaccttggggcctgattgggttaccaggtctgaagggagctcgtggcgacagggggagtggaggggctcagggcccagcaggtgctcccggactggtaggccctctgggaccgtccggacccaaggggaaaaagggggaacctatcttgtcaacgattcagggaatgcctggagaccgcggagactcaggatcccagggcttccgcggagtaataggagagccaggaaaggatggagtacctgggcttcccggtttgccgggtcttcccggagatgggggacaggggttccccggagagaaagggctgcccggtcttccaggcgagaaaggacatcctggtccaccgggtctcccagggaatgggctgcctggtctgcccggaccgaggggcctgccgggtgataagggcaaagatggtttgccgggtcaacagggtcttccgggtagcaaagggatcacactgccttgtatcatcccaggctcctatggacctagcggctttcccggaaccccaggcttccctggccctaaggggtctagaggcctaccaggaacacctggtcagcctggctcatcaggcagtaagggggaaccaggatcacctggcctggtccatttgccagagctacccggattcccagggccaaggggcgagaagggccttccaggattcccgggtctgcctggcaaagacggtcttcctgggatgatagggtccccgggactgccaggaagcaaaggggcaaccggcgacatcttcggtgcagagaatggagctccgggagagcaggggctccagggactgaccggacataaaggtttcctgggggattccggcttgccgggactcaaaggggtgcacggtaagcccggtctgcttggacctaagggcgagagaggctcacctgggacacctggacaggtgggacagccaggaacgcctggatcgagtggcccatacggaatcaaaggcaaatccggcctccccggagcacccggattccctgggataagcggccaccctgggaaaaaagggactcgcggaaagaagggccctcccggatccattgtgaagaagggactgcctgggttgaaggggctgcctggcaatcctggccttgttgggttgaagggcagcccaggatcacccggagtggccggacttcctgcgctgagtggacctaagggagaaaagggctcggtagggtttgtgggatttcccggaatccctggattacctggaatcccaggcactcggggattgaaagggattcccggttcgaccggcaagatgggaccatctgggagagccggaacacccggagagaagggggaccgaggaaaccctggtcccgttggcatccctagcccgcgacgaccaatgagcaatctttggttaaaaggcgataaagggtcacaaggctctgctggctcgaatggatttcctggtccccgtggggataagggtgaagctggcaggcccggaccacccggactgccaggcgcaccgggactaccaggaataattaaaggagtctccgggaagcctggccctccgggtttcatgggaatcagaggcctccccggacttaaaggcagctctgggatcacgggatttcctggtatgccaggggagtctggtagccaggggatccgcggatctccaggccttccaggggctagtggcctgcctggtctcaaaggcgacaacggccaaacagttgaaatcagcgggtctcccggtccaaaaggccagcctggggagtccggcttcaagggtaccaagggtagggacggcctcattgggaatataggcttccccggaaataagggcgaggatggcaaggtcggtgtgagtggagacgtcggacttcctggggctccaggcttccctggagttgctgggatgaggggggagccagggctgccagggtcctccggccatcagggcgcaattggtcctctaggctcaccaggcctcattggtccaaagggttttccaggatttcctggcctgcatggtcttaacggtttacccggaactaaaggcacccacggcacgcccggaccaagcattactggagtgcctgggccagctggtctgcccggaccaaagggagaaaaagggtacccaggcataggtattggagctccagggaagccgggactgcggggacaaaagggcgacaggggctttcccggtttacagggcccagccggactcccaggggctccaggcatctctttgccgagtctaatcgccggtcagcctggagaccccggacgcccagggctggacggcgagcgtgggagacccggacccgctggacctcctggtcctcccggacctagcagtaatcagggggacaccggagatcctgggttccctgggattccgggacccaagggcccaaagggagatcagggcattcccggatttagcggcctccccggagagctgggactgaagggaatgaggggcgagccaggattcatgggtacccctggcaaggtcgggcctccaggcgaccccggtttccccggaatgaagggaaaggcaggtcctcgaggcagctctggactgcagggtgacccaggacagacccctaccgcagaagctgtgcaggtcccaccaggccctctgggtttgcctggaatcgatggaataccaggactgacaggcgacccaggcgctcagggaccagtagggcttcagggatcaaaaggtctgcccggtatccctggcaaagatggacctagtggtttgcccggaccaccaggcgctttaggggatccaggcctgcccggtctgcagggcccacctgggttcgaaggcgcaccaggtcagcaggggcctttcgggatgcccggaatgcccggacagagcatgagggtcgggtatacactggtaaagcattctcagagtgagcaagtgcctccatgtccaatcggcatgtcccagctgtgggtcggctactctctactcttcgtggaaggtcaggagaaggcgcataaccaggaccttggttttgccggatcatgtctgcctcggttctctaccatgcctttcatttactgcaatataaacgaggtgtgtcactacgccagacggaatgacaaatcctactggttgtccaccaccgcacctattccaatgatgccggtgagccagacacagatcccgcagtacataagccggtgcagcgtctgcgaggcaccatctcaggctattgcagtgcattcccaggacataaccatcccacagtgcccactgggctggcgtagcctctggatcggatacagtttcttaatgcacactgccgctggggcagaaggtggaggtcagagcctcgtgtctccagggagctgtttagaggactttagggccacacccttcatagaatgcagcggtgccaggggcacctgtcattactttgctaacaaatactcattctggcttacaaccgttgaggagaggcagcagttcggggagctccccgtgtctgaaactcttaaggccggtcagctgcacacacgcgttagtaggtgtcaggtgtgtatgaagagcctgta

SEQ ID NO: 4677 - DNA, 5075 bp, Artificial Sequence
  Description of Artificial Sequence: Synthetic coding sequence
atgctgatcaataagttgtggcttcttctggtcactttgtgcctgaccgaagagctcgccgctgccggtgagaaatcttatgggaagccttgcggaggacaggattgctctggaagctgccagtgcttcccggaaaaaggggcacgtgggaggccaggtccaatcggaatacaaggcccaacaggacctcaggggtttaccgggtccactggcctctcaggtctgaagggagaacgtggtttcccgggactcttggggccatacggcccaaaaggggacaaaggacccatgggcgtgcccggatttttggggatcaatggcatccccggtcatccaggccagcccggacctcgcggacccccaggcctggacggttgtaatggcacacagggcgctgtaggttttccaggcccagacggttacccaggactgttaggtccgccaggtctgcccggtcagaaggggagcaaaggagatccagtcctggccccagggtccttcaaaggcatgaagggagaccctggcctcccgggattggatggcatcacgggccctcagggggcaccgggattccccggagccgttggtccagccggacccccagggctgcaagggcctcctggcccaccaggtccacttgggcctgacggcaacatgggacttggctttcaaggagagaaaggcgtaaagggcgatgtcggtcttcctggcccagccggaccacccccttctacaggcgaactggagttcatgggattccctaaaggcaaaaagggttctaaaggcgaaccaggccctaagggcttcccaggtatatcaggccctcctggtttccccggtctcggcaccacaggtgaaaagggagagaagggcgaaaaaggaattccgggtttaccagggccacggggacccatgggcagtgaaggcgtccagggcccaccaggacagcaggggaaaaaggggacactgggctttcctggtctgaatggatttcaaggcattgagggtcaaaaaggagatattggcctcccaggtcccgacgtgtttatagacatagacggcgctgtaatatccggcaaccctggcgacccgggagtaccagggctccctggcttgaagggtgacgagggcatccaaggtctcaggggcccttccggagtccctggcttgccagcactctccggagttccaggcgctctgggtccccagggtttccctggcctcaaaggcgaccagggaaaccccggaaggactacaattggggctgcgggattgcctgggagagatgggctccccggtccacccggacctccaggcccacccagccctgagtttgaaacagaaactttgcataacaaagagagcggtttccccggactgaggggagaacagggcccaaaggggaacctgggactcaaaggaatcaaaggcgactccgggttttgtgcctgtgatggtggcgtgccaaatactggtccacccggagaaccaggccctcctggcccttggggactcatcggcctccctggcctgaagggtgctagaggcgatcggggttccggcggtgcgcaggggccagctggcgctccgggacttgtcggcccacttggtccgtctgggccaaaggggaaaaagggtgaacccatactgtctactatacaggggatgccaggggatcgaggcgacagtgggagtcagggtttccgaggtgttatcggagaacctggaaaggatggggtgcccggtttacctggactgcccggactgcctggagacggcggacagggatttcccggtgaaaaggggcttccaggcctgccaggcgaaaagggccaccctggacctcccggtcttccagggaacgggttgcccggactgcccggtcctcgaggcctgcctggagacaaaggaaaggacgggttgcctggccagcaaggcctgccaggctcaaaaggtattacccttccatgcatcattcctggtagctacggaccttccggcttccctgggacccccggttttcccggaccaaaggggtcccgtggcctgcccggaacacccggtcagccgggttcaagcggtagtaaaggagagccaggaagcccagggctcgttcatcttcccgagttgccaggatttcctggcccaagaggggagaaagggctgccaggattccccggactccctgggaaggacggtctccctggcatgatcggttctccaggacttccagggtcaaagggagccacaggcgatatcttcggcgctgaaaacggagctcctggggagcaaggcttacagggcctgacgggtcacaagggtttcctgggcgactccgggctgcctggactgaaaggcgtgcatggcaaaccgggactcctggggccaaagggtgagaggggcagtcctgggacccccggacaggttggccaacctggtactccaggaagtagtgggccttacggaatcaaaggcaaatcggggctcccaggagcaccaggcttccctggaatatctggccatcccggaaaaaagggcaccagaggtaagaagggacccccaggaagcatcgtgaaaaaaggccttcctggtctgaaggggctacccggaaaccctgggctggtgggccttaagggcagtccagggtctcctggcgtggcagggctccctgccctctcgggtccaaagggggaaaaagggtccgtagggtttgtcggattcccgggtatccccggtctgcccggtatccctggcactcggggattaaaagggattcccggttccaccggcaaaatgggcccaagtggaagagcagggactcctggcgagaagggggatcggggaaatccaggtccggtgggcattccctcgcctagacggcctatgagcaacctctggctcaaaggagacaagggaagccaaggttccgccggttctaacggattccctggacctaggggtgacaagggagaagccggacggcctgggcctccaggcctgccaggagcccctggtctgccaggaatcattaaaggcgtgtcagggaagcctggcccaccaggttttatgggaatccggggactccccggtttgaagggctcctctggaataactgggttccccggtatgcctggcgagagtggctcacagggcattcgcggatcaccgggtcttcccggtgcttcagggctgccaggactgaagggagacaacgggcagactgtcgagataagtggatcaccaggaccgaaagggcagcctggcgagtccggatttaagggaacgaagggtagggacgggcttattggcaatataggattccccggtaataagggggaggatgggaaagtcggcgtgtccggcgacgtcggcctgccgggagctcccggtttccccggagtggcaggaatgcgtggcgagcccggtctgccaggatccagcggtcatcagggtgcaatcggacctctgggatctcctggactgatcggccctaaaggctttccaggcttccctggcctacatggacttaacggattaccaggaaccaagggcacccacgggacacccggaccgtctattaccggcgtgcccggacctgctgggctccccggacctaagggggaaaaaggttacccaggtatcggcatcggtgcgcctggcaaacctgggctgcgtggacagaagggagatcggggttttcctggactccagggcccagctggtctgccaggcgctcctggtatctccctgccgagcttgattgcaggacagcctggagacccaggtaggccaggcctggatggggagcgaggcagacctgggccagccggaccgccagggccaccgggtccgagcagcaaccagggtgacaccggggatcccggatttccgggtatccccggtcctaaagggccaaagggggatcagggcattcctggcttctcggggttgccaggcgaacttgggcttaaaggcatgaggggggagcctggatttatgggaactccgggaaaagtaggcccaccaggggacccgggtttccccggtatgaaagggaaggcgggtccacgcggatcgtccggcttgcaaggggatcctggccagacacctacggctgaagcagtacaagtgcctcccggaccgcttggtctgccaggtatcgacggcatccctggtctgaccggagatccaggcgcacaaggtcccgtaggccttcagggatccaaaggcctgcctggaatccccggtaaggatggcccttctggactccctggcccacccggtgcactgggcgatccaggcctcccagggctccagggaccccctgggttcgaaggggctcctggccaacagggaccattcggcatgccagggatgcccggtcaaagtatgcgcgtcggttacacgctagtgaaacatagccagtcggagcaggtgcccccatgtcccatcggaatgtctcagttgtgggtcggatattccctgctgttcgtggagggacaggagaaggctcataaccaagatctcggatttgccggatcatgcctgccacgcttctcaacaatgccttttatttactgcaacatcaatgaagtgtgccattatgcacgcagaaatgacaaatcatattggctgagtaccacggcccctatccccatgatgccagtaagccagacacagatccctcagtatattagccggtgttccgtttgcgaagccccttcccaggctatcgccgtgcatagccaggatattactattccccagtgtcctctaggctggaggtccctctggatcggatactcttttcttatgcacaccgccgcaggagcagaggggggaggtcagagcctggtgagtccagggtcttgcttggaagacttccgcgctacccctttcatcgagtgttcgggcgcaagagggacatgccactatttcgctaacaagtatagcttctggctcacaaccgtggaggaaaggcaacagtttggggagttaccagtttcagaaacacttaaagccggtcagctccacaccagggtgagtcgttgccaggtttgcatgaaatccctgta

SEQ ID NO: 4678 - DNA, 5075 bp, Artificial Sequence
  Description of Artificial Sequence: Synthetic coding sequence
atgcacccagggttatggctacttctcgtcactttgtgtctcacggaagagctggcagccgcaggtgaaaagagttacggaaaaccgtgcggcggacaggattgcagcgggagctgtcagtgctttccagaaaagggagccaggggacggcctggacctataggaattcagggccctacgggaccccagggcttcaccggtagtaccggattgtcaggtctcaaaggagaaagaggctttccgggtttgctggggccttacggcccaaagggcgacaaaaaattcagcattcctgtactcctgatttacgattcccgcccagggcatccagggcagcctggtcccaggggtccccctggactcgatgggtgcaatggcacccaaggtgccgttgggttccctggtccggacgggtaccccggtctcttagggcctcccggattacctggacagaagggctcaaaaggtgaccccgtgctcgctccgggatccttcaaaggaatgaaagccttcatcccactgttcgagtcaatccgtggaccgcagggggcacctggatttccaggcgctgtgggacccgcaggccctccgggtttgcagcagggtcagcctccttttctcgaggtcctattccctcactggcacgagggggaggaggctaaagtcagagatagcctgtttggcgatgtgggattgccaggaccagcaggccctcccccaagcacaggcgagctcgaatttatgggcttccccaagggcaagaagggatctaagggcgagcctggaccaaagggcttccccggaatttcaggtcctccaggatttcctggcttggggaccaccggcgaaaaaggggaaaagggtgaaaaaggaatccctggactgcccggacccaggaccctcctgtgctcacataccttccatctggtcgttactatgtttctcagccagggaaagaaaggaaccctgggtttcccgggactgaacggcttccaaggcatcgaggggcagaagggtgacataggcctgcccggacctgacgtctttatcgacatagacggcgcagtgatctcgggtaatcccggtgaccccggtgtgcccggacttcctgggctaaaaggcgacgagggcatccaaggactgagagggccttccggcgtccccggtctgcccgctctgtcaggcgtccccggagcactgggaccccagggctttccagggctaaagggggaccaagggaatcctggcagaaccacaatcggagccgctggcctacccggtcgggacggactccccggacccccaggccctcctggcccaccaagtcctgagttcgagacagagacacttcataacaaggagagcggctttcccggtctccggggtgagcagggaccaaaggggaacctgggcctgaaaggcatcaaaggggacagcggcttctgcgcttgtgacggaggagttcccaatacaggccctcccggtgaaccaggccctccaggcccttggggcttgattggtctgcctggcctcaaaggagcacggggagatcgcggtagcgggggtgcccaagggccagcaggagcaccaggcttggtaggtccattaggaccttccggacccaaggggaagaagggtgaaccgattttaagcactatacaaggcatgcctggggacaggggggattctggttcccagggtttcaggggcgttatcggagagccaggtaaagatggcgtgccaggcctgccagggttgcccggactcccaggagatggcggacaaggcttccctggtgagaaaggtctgcccggactgcccggtgagaaagggcacccagggccaccagggctgcccggaaacggcctccccggattgcctggcccaagggggctcccaggagataaaggcaaggatgggctccctggtcagcaaggcctccccggttcaaaggggataacactgccatgtatcatcccagggagctatggaccttctggcttccctgggaccccaggttttcccggtcccaaaggaagtcgaggcctccctggtactccgggacaaccaggatcatctggttctaagggggagcctggatcacccggtttggtgcatctcccggagttacctggtttcccaggccctcggggtgaaaagggtctgcctggcttccccggtctgccaggaaaggacggcttgccagggatgattggaagccccggactgcctgggagcaagggagcgacgggagatattttcggggcagagaatggagccccaggcgaacagggactccagggtctcacgggccataagggattcctgggggactctggccttcccggtctgaagggagtccatggaaaaccaggactgttagggccaaaaggggaacggggatcccctggtacccccggacaggtgggacaacccggaactccgggaagttccggcccttatgggatcaagggaaagagcggccttcccggagccccaggcttccccggaatttctggtcaccccggtaaaaaaggcacccgtgggaagaagggaccgccaggctccatcgtgaagaagggcctgccaggattaaaggggctgcctggtaacccaggcctggtgggactaaaaggctctccagggtctcccggagtcgctggcctccccgcactgagcggtcctaaaggcgagaagggctcagtgggcttcgtgggcttcccagggattcctggattgccagggataccaggcactcggggactgaaggggatacctggatctacaggcaagatgggaccatcagggagggctgggactccaggcgagaagggcgatcgtggtaaccctggaccagtgggtattccatcaccgcgaaggcccatgtctaatctgtggcttaaaggggacaaaggttctcagggctctgccggatctaatggttttcctgggcctcgaggggataaaggcgaagctggacgaccagggcctcctggcctccctggtgctcccggtctgccaggcattatcaaaggggtgtctggaaaaccaggccctccagggtttatggggattcggggactgcctgggctcaagggctcctctggcattaccgggtttcctggaatgcccggtgaaagcgggagccaggggataaggggatctcctggcctgccgggagcctccggcctgcctgggttaaagggcgacaatggccaaaccgtcgaaatcagtggcagtcctggcccaaagggtcagcctggggagagcggattcaagggcacaaaaggcagagacggtctgattggcaatatcggcttccctggtaacaagggagaggacgggaaagtgggggtaagtggagatgtcggccttcctggggcaccaggctttcccggagttgctggaatgagaggagagccagggctacctggatcctctggccaccagggagctatcggacctttgggttctccaggactgattggtccaaaaggctttcctgggttccctggtcttcacgggttgaatggattgcccggaaccaagggcacacacggtaccccaggcccttccatcaccggggtcccaggtcctgcaggcctgccagggcctaagggcgagaaggggtaccctggcattgggataggtgcgcctggaaagcccggactcagaggtcagaagggagatcggggatttccagggctccaaggcccagctgggttgccaggggcaccgggaattagcctgcccagtctcatcgccggtcagcccggtgatccgggacgtcccggtttggatggcgaaaggggaagaccagggcctgccggacctcccggtcctccaggaccttcctctaatcagggggatacaggcgaccctggatttcccggtatcccgggacccaagggcccaaagggcgaccagggaattcctggtttcagcggcttaccaggcgaattaggcctgaaagggatgagaggagagcccggtttcatgggcacgccagggaaagttggccctcctggtgaccctggcttcccaggtatgaaaggaaaagccggaccaagaggaagttctggtctgcagggggatcccggtcagacccctacggctgaagcagtccaagtgccacctggtccactgggcctccctggcattgacgggatcccaggtctgacaggcgatcctggggcacagggacctgtcggtttgcagggctctaaagggctgccaggcattcctgggaaagacggcccttccgggctccctggacctcccggagcccttggggatcccggtctccctggccttcagggcccacctgggtttgagggtgcccctgggcagcagggccctttcgggatgcctggaatgcctggtcagagtatgcgagtcgggtacactctcgtcaaacattctcagagcgagcaggtgcccccatgcccaatcggtatgagtcagctatgggtaggatattcactgttgtttgtagaaggccaggaaaaagctcacaatcaggacttgggcttcgcgggttcgtgtttgcctaggttttctactatgccatttatttactgcaacatcaacgaggtctgccattatgcgaggaggaacgataaatcttactggctctcgacaacagctccgattcctatgatgccagtgagtcagacccagattccccaatacatcagcagatgcagcgtgtgtgaggcccctagccaagccatagccgttcattcacaagatattaccatccctcagtgcccgctcggctggagatcactgtggattggttacagttttctcatgcacaccgcagctggcgcagaggggggaggacagagccttgtgagtccgggaagttgcctggaagacttccgagcaaccccatttatcgagtgtagcggagctagagggacttgccactattttgctaataagtattcgttctggctgacaaccgtagaagaaagacagcagtttggcgaacttcccgtgtctgaaacgctgaaggccggacagctacacaccagagtgagtcggtgccaggtctgtatgaaaagcctgta

SEQ ID NO: 4679 - DNA, 783 bp, Artificial Sequence
  Description of Artificial Sequence: Synthetic coding sequence
atgttgcaggactggaaagagcgagcggcaagtgtctggtgtaaatggctcgacgtgaacccaaaccatcacttagttaaagcccctcaacccgacttaccttgcccttgtcccctctcactgttgcctggcttcgccggatcctgcctaccgaggttctctaccatgccttttatttactgtaacataaacgaagtgtgccattacgcaagacggaatgacaaaagctactggctatccaccacggcaccgatcccaatgatgcctgtatctcagacacaaattcctcagtatatcagtaggtgctccgtgtgcgaggctcccagccaggccattgcagttcatagtcaggatatcacgatcccgcagtgtcccctggggtggaggtctctgtggatcggttattccttcctgatgcacacagcagccggagccgaggggggtggacagtctcttgtgtccccgggaagctgcctcgaggattttcgcgctaccccctttatcgagtgttcaggagcaagggggacatgtcactattttgcaaacaagtacagtttctggctgacgaccgtcgaagagagacagcaatttggcgagctgcccgtgagcgaaactctgaaagccggtcagcttcatacacgagtgtccagatgtcagccaggctttacggggcctggcatcaaagagtggaagtggaaatggcatcatagccccagcgcccctgttatccatcaacagaacttctgcttcctgtttcccagacactatgtcttgctcgcctag

SEQ ID NO: 4680 - DNA, 4902 bp, Artificial Sequence
  Description of Artificial Sequence: Synthetic coding sequence
atgcaccctgggctttggctactgttagttaccctatgccttactgaggaactagccgctgccggtgagaagagctatgggaaaccctgcgggggacaggattgtagcggtagctgccagtgcttccctgagaaaggcgctcgtgggaggcctggccctattggtatccagggacctaccggcccacaaggatttacaggtagtaccgggctgtccggcctgaaaggggagcgcggatttcctgggttgctcggaccctatggtccaaaaggagacaagggaccgatgggagttccaggcttcctaggtattaacggcatccctggccaccctgggcagcccggtcccagaggccctcccggactggatggctgtaatggcacccagggcgctgtagggtttccgggaccggatggttacccgggattactgggaccccctggcctgccaggccagaaaggatccaaaggcgacccagtgcttgcccctggatccttcaaaggcatgaagggagatccaggtctccctggactggacggcattactgggcctcagggcgctccaggatttccaggtgcagtagggccagcgggacctcctggtctacaaggacctccagggcctccaggccctctgggccctgacggcaatatgggactcgggttccagggggagaaaggtgtgaaaggggacgtgggactgccagggcctgctggaccaccaccttccacaggggaactcgagttcatgggcttccctaagggaaagaaagggagcaagggcgagccgggaccaaaaggattccccggaatctccggccctcctggcttcccaggtctggggacgaccggggaaaaaggtgagaagggggagaaaggcattcctggtctgcccggacccagaggcccaatggggtccgaaggcgtccagggacctcctgggcagcaaggtaagaaggggacgctgggctttcctggtctgaacgggtttcagggtattgagggccagaagggcgatattgggctccccggacctgacgtgttcattgacatcgacggcgctgtgatatccgggaacccaggagacccaggggttccaggacttccaggacttaagggagacgaaggaattcaaggcttaaggggcccatccggggtccccggactgccagcgctaagcggcgtgccaggcgctcttggacctcagggttttcccggtttgaagggagaccagggtaaccctggaagaaccactatcggcgctgcaggcttacccggaagagacggcttgcctgggcctccaggcccacctggcccaccatctccagagtttgaaaccgaaactttacataacaaggagtccgggtttccaggactgcggggagaacagggacccaaagggaatctcggtctgaagggcatcaaaggtgactctggtttttgtgcatgcgatggcggagtgcctaatacgggcccaccaggagaacccggtcctcctggtccctgggggttgatcggattaccaggacttaagggggctcgaggcgaccggggatctggcggagcccaaggaccggctggcgctccagggctggttggcccactcgggccttctggcccaaagggtaagaaaggcgagccaatcctcagcacaatacaggggatgccaggtgataggggagattcaggaagtcaggggttccggggagtaattggtgagccaggcaaagacggggtgcccggtttgccaggcctccctggactgcccggtgatggtgggcagggttttcccggtgagaagggcttacccggtctccctggcgagaaaggtcaccccggtcctccaggcttgcctggtaacgggttgcccggactgccgggtcctcggggtttgcctggcgacaagggtaaggatggccttcctggtcagcagggcctgccaggcagcaaagggatcactctgccatgcatcatcccagggagttacggaccctctggttttcctggcacacctggattcccgggacctaaaggcagtcgcggtctgccgggaacaccgggtcaaccagggagtagcggcagtaagggcgaaccgggttcccctggccttgtgcacctgcctgagctgcccggttttcccggtccgagaggtgagaaggggctgccagggttccccggtctccctggaaaggacggactgccaggtatgatcggctcccctgggctgccgggatccaagggagccacaggagatatctttggcgctgagaacggtgcaccaggagaacagggactgcaggggctgacagggcacaagggcttccttggcgatagcgggctgcccggtctgaaaggggtccacggtaaaccagggctcctagggccaaagggtgagaggggctcacccggtaccccgggtcaggtcgggcagccaggcaccccaggctcttctggtccctatggcatcaaaggaaaatccggcttacctggggctccagggtttccaggtatctctgggcacccaggcaagaaaggtacaagaggaaaaaagggaccgcctggtagtatcgtcaaaaagggactaccaggactgaagggacttccaggaaaccccggactagtaggccttaagggctcccccggaagcccaggcgtggctggactgcctgccttatcaggtccaaaaggagagaagggctccgtaggcttcgtgggattcccagggatacccggacttccaggaatccccggtacacgcggactcaaggggatcccaggatctacgggcaagatgggcccttcgggcagggccggaacacccggtgagaagggagatcggggaaatccaggacccgtcggaatcccttcaccaagaaggccgatgtctaacctatggctgaagggagataaaggctcccaggggagtgctggctccaatgggttccctgggcctagaggagataagggggaagctgggagaccagggcctcccggtcttcctggcgcacctggcctgcctggtataatcaaaggcgtcagtgggaagccaggccctccgggtttcatggggattaggggactgccgggtcttaagggcagcagtgggatcacgggttttccagggatgcccggagaatccggatcgcagggtattaggggcagtcccggtctccctggcgctagcggccttccaggactcaaaggtgataatggacagaccgtggagatttccggcagtccagggcctaaaggacagcctggggagagcggattcaaaggcaccaagggacgggatggcctgattgggaacattgggttccctggaaataaaggagaagacggtaaagtgggcgtctcaggcgacgtcggactgcctggtgcccctggatttccaggtgtcgccggaatgcggggtgaaccgggactgcccggatcttctgggcatcaaggagctattggaccacttggttctccgggactcattggacccaagggcccatcaattaccggggtgccaggcccagctgggttgccaggtcccaaaggcgagaagggatatcctgggatcggaataggtgctcccggtaaaccagggttgcgcggacagaagggggatcgaggctttcccggtctgcaggggcctgccggattacccggtgcccctggaatcagcctgccaagtctgattgctggtcaaccaggagatccagggcgacccggactggacggggaaagaggacgacctggacccgctggcccacccggacctccaggcccttcatcaaatcagggggatacgggagaccctggatttcctggcataccgggtccaaagggacctaaaggtgaccagggaatacctggtttttccggactgccgggtgagctggggttgaaggggagctcggggcttcaaggagaccctggtcagacccccactgctgaagctgtccaggttccgccaggccctctagggctgcccggaattgacggaattccaggactcaccggcgatccgggagcccaggggccagtcggcttacaaggatcaaaaggactgccagggatccctggcaaagacgggccttcgggactgccaggacctcctggtgccttgggggatcccggtctgccaggattgcagggtccacccggatttgaaggggctcccggtcagcaagggccttttggaatgcccggtatgccgggacagagcatgcgggtcgggtacacgttagtaaaacactctcaatcagaacaggtgcccccatgtcccataggcatgtctcagttgtgggtgggttacagtctacttttcgtcgagggacaggagaaggcccataatcaggatctgggtttcgctggaagctgcttgcctcggtttagtaccatgccatttatctattgcaacataaacgaagtgtgtcattacgctcgcaggaacgacaagtcctattggctttcaaccacagctcctattccaatgatgcccgtctcccagacacagatcccacagtacatttctagatgctcggtgtgtgaagctccgagccaggctatcgccgtgcactcacaggacatcactatcccacagtgccctttaggctggcggagcctgtggattggatactctttcctaatgcacaccgcagccggagcagaaggtggaggccagagccttgtgtcaccaggttcttgcctggaggactttcgagccacaccgttcattgaatgctcgggggcaagaggtacgtgccactatttcgcaaataaatatagcttctggctgaccacagtggaagagaggcagcaatttggtgagctgcccgtgtcggagacattaaaagccggacagctccacactagggtctcaagatgtcaggtgtgtatgaaatccctgtag

SEQ ID NO: 4681 - DNA, 5000 bp, Artificial Sequence
  Description of Artificial Sequence: Synthetic coding sequence
atgcaccccggactgtggctactactagtgactctgtgtcttacggaggaattagctgcagccggagaaaaaagctacggaaaaccatgcggtggtcaggactgttccggctcatgtcaatgcttccccgaaaaaggcgcacggggaaggcctggacccatcggcatccagggtcccactggaccacaggggttcacggggtctactgggttatctggtctcaaaggagaacgcggatttcccggtctcttggggccttatggtcccaaaggtgataagggacctatgggagtaccaggatttttaggaatcaacggaattccagggcacccaggccagccagggccaagaggccctcctgggttagacggctgcaacggcacgcagggcgctgtaggtttccccggacccgatggctaccctgggttattggggccaccaggactgccaggccagaaaggcagtaaaggcgacccagtgctggccccaggttctttcaagggcatgaagggcgatcccggattgcccggtctggacgggatcactggaccacagggggctcctggattccctggagcagtgggacccgctgggccacctgggctgcaggggcctccaggccctccaggacctctgggccctgacgggaacatgggactgggattccagggggagaagggagtaaaaggagacgtggggctcccaggccctgcgggtccacccccatctacaggcgaattagagtttatgggcttccccaaaggaaagaaggggagcaaaggagaacccggtccaaagggttttccaggaatttcaggccctcctgggttcccaggcctgggcaccaccggcgagaaaggcgagaagggggagaaagggatccccggacttcccggacctcgcggacctatgggctcagagggcgtgcagggacccccaggccaacaaggcaagaaaggcaccttgggctttccgggactcaacggtttccagggaatcgagggacagaaaggtgacattggtctgccaggacccgacgtctttatcgatatagacggggctgtgatttcaggaaacccgggagatcccggtgtgccaggcctcccgggattaaaaggtgatgaggggatccagggattgcggggaccatctggggttcctggcttacccgcactgagtggtgtgccaggcgcacttggaccacagggttttcccggactaaagggcgatcaaggcaatccgggtaggactaccattggggctgcagggttaccaggtagagacggcctgcccggaccacccggaccacctggacccccttcacctgaatttgaaaccgagactctacataacaaggaatctggctttcccggactccggggagaacagggtccaaaaggaaacttgggactaaaaggtattaagggggacagtggtttctgcgcttgcgacggtggagttcctaacacgggccctcccggtgagcctggccctccagggccatggggactgatcggtctgccaggcctgaagggtgctcgaggagacagggggtctggaggcgcacagggccctgctggggctcctggcctggtggggccactgggtccgagcgggcctaaaggcaagaaaggggagcctatattgtcaaccattcagggtatgcccggtgaccgcggagacagtggctcacaggggtttcgcggtgtgattggcgagcccggtaaagacggcgtaccaggcctgcccggtctgcctggcctgcctggtgatggcggtcaggggtttcccggtgagaaagggttgcccggactgccaggagagaagggacaccctggcccacctggcttgccaggaaacgggctccctggactccccggacccaggggactcccaggcgataaaggcaaggacggcctgccgggtcagcaggggcttcccggtagtaaaggaatcaccttgccctgcattattcctggtagttatggcccatcaggattcccgggtacccccggatttcccggacccaaggggtcacgcggactccccggaacaccaggtcagccaggcagctctgggtcaaaaggagagccgggaagtccgggattagttcaccttcctgaactgcccggttttccaggccctcgcggagaaaaagggcttcccggttttccaggtctgcctggcaaggacggtctcccaggcatgattggatcgcccggactgcctggctccaagggagcaactggggatattttcggcgctgagaacggagctcctggagagcagggactgcagggtttgacaggccacaagggctttctcggagactcagggctgcctgggttgaagggcgttcacggtaagccgggacttctcggcccaaaaggagaaagaggttccccgggtacacctgggcaagtaggacaaccaggcactccgggatctagcggtccttatggtattaagggaaagtccggattgcctggggctccgggatttcctggtatttctgggcatccgggtaagaagggaactcgcggaaagaaagggccaccgggaagcatcgtgaagaaaggcctgcctgggctcaaagggctccccggtaaccccggactcgtcggcctcaagggcagtccaggtagccccggtgtggctggccttccggcattgtctggccctaagggtgagaaggggagcgtggggttcgtcggcttccctgggatccccggattaccaggaattcctggaactagaggcctcaagggtatcccaggctcaaccggaaagatgggcccatccggccgagccggaactcccggagagaaaggggacaggggcaatccagggccagtgggaatcccaagcccgaggagaccgatgagcaacctttggctcaaaggggacaagggttcacagggctcggctggctccaatggctttccaggccctagaggcgacaaaggagaagccggtaggcccggtcctccgggtcttcccggtgcccctgggctccctggaatcatcaagggggtgtcagggaagcccggtccccctggcttcatgggcatccgcggactgcctggactcaagggatcgagtggcataaccggcttccccggaatgccaggagaatctggctcacaaggaatacggggatctcctggactgcctggagcctccggactgcctggcctgaagggagacaacggccagacagtggaaatcagcggatcccctggacccaaggggcagccaggggagagcgggttcaaaggaactaaggggcgagacgggctgattggtaatatcggcttcccgggtaataagggcgaggatggtaaagtgggggtgagcggggatgtcggcttgccaggagcaccaggattcccgggagtcgccggaatgcgcggtgaacccggtcttcccggtagctctggccaccagggagctatcggccctctcgggtccccaggattaattggtccaaagggacctagtattaccggggtaccagggccagccggattacctggacctaagggcgagaaaggctacccaggtatcggaatcggagctccaggcaagcccggtctgcgtggacaaaaaggggacagaggatttccgggactgcaaggtccggcaggactgccaggggctcccggtattagcttaccttccttgatcgccggacagcccggtgatcccggtcggccaggtctggacggagagcgcggacgtccaggtcctgccggtcccccaggccctcccggaccttcaagtaatcagggtgatacgggggatcccggattcccgggtatcccaggccctaagggccctaagggtgaccagggaatccccggttttagtggactgcctggggaactcggcctgaagggaatgaggggggaacctggcttcatgggaacccctgggaaggtgggtcctcccggtgatccaggcttccctggtatgaaaggtaaggctgggccaagaggttcttccggcctgcaaggcgatccgggtcagacccccaccgccgaagctgtgcaggttcccccagggccactgggacttcctgggattgacgggatcccaggcctgactggcgatccgggagcacagggccctgtgggcctgcaaggatccaaaggccttcccggtattccagggaaagacggcccatctggtctaccaggtccacccggtgccctgggcgatcctgggttgcctggactccaagggccacccggttttgaaggtgcccctggccagcagggaccattcggtatgcccggtatgcccggtcagagtatgcgggtcgggtacacattggttaaacactctcagagtgagcaggtacctccttgtcccattggcatgtcccagctgtgggttggttactctctgttgttcgtcgaaggtcaggaaaaggcccacaatcaagatttggggttcgctgggtcttgcctaccccgtttcagtacaatgcctttcatttattgcaatattaatgaggtgtgtcattatgccaggcggaacgacaaatcctattggctctccactaccgctcctatccctatgatgccggtgagtcaaacccaaatcccccagtacatcagcagatgctcagtgtgtgaggctccatctcaggccatcgccgtgcactcacaggacattacgatacctcagtgccctctcgggtggaggtccctgtggatcggctatagtttcctcatgcatacagccgcaggcgctgaggggggaggtcagagtctagtgtcacctggctcatgcctagaggactttagggctacgcctttcatcgagtgctctggcgctagaggtacgtgccactattttgccaataagtacagcttttggttgacaactgtagaagaaagacagcagttcggagaactaccagtgtctgagaccctaaaggcaggccagctgcatactagagtttcacggtgtcaagtttgtatgaaatccttgta

SEQ ID NO: 4682 - DNA, 2037 bp, Artificial Sequence
  Description of Artificial Sequence: Synthetic coding sequence
atggcatggactgctagagataggggcgctttgggactcttgcttctcggcctgtgtctgtgcgctgcccaaagaggtcctcccggtgagcagggtccccctgggccacctggacccccaggagtcccgggaatcgatggtatcgacggggatcggggacccaagggtccacctgggcctcctgggcctgctggggaacctggtaagcctggagctcctggcaagcctggaactccaggtgctgacggcctgacgggccctgacggcagccccggttctatcggaagcaaggggcagaagggagagccaggagtgccaggctctaggggattccccggtagagggattcccggtcccccagggcctcctggtaccgctgggttgccgggagagcttgggagggtgggcccagtaggcgatccaggcaggaggggaccccctggccctccgggtcctccagggcctcgtgggacgattgggtttcacgacggagatccactttgtcctaatgcttgcccacctggacgatccggctatcccggattgcctggcatgcggggtcataagggggctaagggcgagataggagaacccggaaggcaaggacataaaggagaagaaggggatcagggggaattaggcgaagtcggcgctcagggcccaccaggagcccaggggttaagaggcatcacgggcatcgtcggcgacaaaggtgagaaaggcgctaggggtctcgacggcgagcctggacctcaggggcttccaggtgcacccggagatcaaggccaaagaggccctccgggtgaggcgggtccaaagggggaccgaggcgctgagggggctcgtgggatacccggactgccaggcccaaagggcgacaccggtttacccggagtcgacggtcgagacggaattcccggaatgccaggcaccaaaggagagcctgggaaaccaggcccacccggagatgcgggactgcaaggactgccgggagtgcccggaataccgggagcgaagggggtagccggtgaaaaggggagcacgggggctccgggtaagccgggtcagatgggtaactcaggaaaaccgggacaacagggaccgccaggcgaagtcggtccacggggaccccagggcctgccaggttccagaggggagctcggcccagtgggcagtccaggactccctgggaagcttggatcattaggctcgcccggacttcctggcctgcccggaccaccagggctccctggtatgaagggcgaccggggtgtcgtaggagagcctggacccaagggggagcagggtgcctccggggaagagggcgaggccggtgagcggggagagttaggggacataggtttgccagggcctaagggcagtgcagggaacccaggcgagcctggcctccggggaccagaagggagtagaggtctgccaggggtggagggccctaggggtccgccaggccctcgcggagtgcagggggagcagggcgctactggccttccaggagtgcagggccctcctggcagagcacccactgaccagcacatcaagcaggtgtgtatgcgcgtaattcaggagcacttcgccgaaatggcggcttctctgaaacgccctgactccggtgccacggggctgcctggcaggccaggacccccagggcctcccggtcccccaggggagaatgggtttcctggacaaatgggaatccgaggcctaccaggcatcaaggggccaccgggagccttgggtctgcggggacctaagggcgatcttggtgagaagggagagagaggaccaccgggtaggggtccaaatgggctaccaggggcaattggtctgcccggtgatcccggtcctgcatcttacggcagaaatggcagggacggcgagcgcggtccccctggagtggcaggcattccaggggtgcccggacctcctggacctcccggtttgccaggcttttgcgagcccgctagctgtacaatgcaggcaggccaacgggcattcaacaaagggcctgacccttag

SEQ ID NO: 4683 - DNA, 2766 bp, Artificial Sequence
  Description of Artificial Sequence: Synthetic coding sequence
atgaaaacttgttggaaaattcccgtctttttttttgtgtgttcattcctggagccctgggccagcgcagcggttaagagacggccacgtttccctgttaactccaatagtaatggtggcaacgagttgtgcccgaagataaggattggccaggatgatttgccagggtttgacctaattagtcagttccaagtagacaaggcagcatctaggcgcgctatccagagagtggttggatccgcaactcttcaggtggcctacaagctcgggaataatgtcgacttcaggatcccaaccaggaatctctatcctagcgggctacctgaagaatactcctttctgacaaccttccgaatgactggatctacactgaaaaaaaattggaatatctggcaaatccaagactcctcaggcaaagagcaagtgggcatcaaaatcaatggacagactcagagtgtcgtgttttcttacaaagggttagacggctccctccagaccgctgccttttccaacctgtccagcctgttcgactcgcagtggcacaagatcatgattggtgtggaaaggtcttccgcaaccctgttcgtcgactgcaataggattgaaagcttgcctattaagcccagaggtccaattgacatcgacggttttgctgtactgggcaaattggcagacaatcctcaagtttccgttcccttcgaactccagtggatgctgatccactgcgatccgctgagaccgagacgggagacgtgccacgagttacccgctaggattactcccagtcagactacggacgagcgagggcctcccggagagcaggggcctcccggaccccctggcccaccgggtgttccaggaatcgatggcatcgacggtgacaggggcccaaagggaccaccaggtccaccagggccagcaggtgaacctggcaagcctggagcccctggaaagcccggtactcccggtgccgacgggcttaccggccctgatggcagccctggctctattggatcaaagggacagaagggggagccaggcgttcctgggtcacgcggtttccccggacgcggaattccgggtccccctggacccccaggcacagctgggctaccaggagaacttggcagagtgggtccagtcggggaccctggccgacgagggccacccggtcccccagggccaccaggtcctagaggcactatcgggttccacgatggagatccgttgtgccctaatgcttgtcctcctgggagatccgggtacccagggctgcctggcatgcgcggacacaagggcgcaaagggggaaatcggcgagcccggacggcagggacataaaggagaagaaggcgaccagggtgagcttggagaggtgggcgctcagggcccacctggcgcacaggggctgcggggtattacaggcattgtgggagacaagggggagaagggtgcaagaggactggatggcgagcccggaccccagggcctgccaggagcacctggtgaccaggggcaaagaggacccccaggcgaggccggacccaagggggacagaggagcagagggcgctaggggtattcccggtctacctggaccaaaaggcgataccggactgcccggtgtggatggacgcgacggcatacccggaatgcctggcacaaaaggagagccaggtaaacccggacctcctggggacgctggcctccagggtctgcctggcgttcctggtattcctggtgcgaaaggcgtcgcaggtgagaagggaagtaccggggcacccggtaagccaggtcagatggggaatagtggtaaaccaggccagcagggcccacccggagaggtggggcctcggggaccgcagggcctaccgggttctcgaggcgaactgggtccagtcggctccccaggtttgcccggaaagcttggaagtcttggttcgccaggactgcccggtttaccaggcccacccggtctgcccggtatgaagggcgatcggggagtggtgggagagcctgggcctaaaggggaacaaggagccagcggtgaggaaggtgaggccggagagcgcggagaactcggcgatataggtctcccgggtccaaagggtagtgctgggaacccaggagagccaggcctgcgcggtcccgaagggtcaagaggactcccgggagtggaggggccacgtggcccacctgggccaagaggtgtccagggcgaacaaggagcgactggccttcccggtgtgcagggccctcccggaagggccccaacggaccagcacataaagcaagtgtgtatgcgcgtaatccaggaacactttgctgagatggcagccagcctcaaacgcccagactcaggcgcaaccggcctacctggcagaccaggtcccccaggccctcccggacctccaggtgagaacggcttccctggtcagatggggatacgcggtttgccaggcataaaagggccaccaggggcattaggtcttcggggtcccaagggcgatttgggagagaagggcgagcgcggtccgcctgggagggggcctaatgggctgcccggagctatcggactgcccggtgatcctggcccagcctcgtacggaagaaacgggagagacggagagcgaggtcctcccggagtggcgggtataccaggtgtccccggtcctccaggaccgccagggctacctggattctgcgaacctgcttcctgcaccatgcaggctggtcaacgcgctttcaataaaggacctgacccatag

SEQ ID NO: 4684 - DNA, 987 bp, Artificial Sequence
  Description of Artificial Sequence: Synthetic coding sequence
atgaaaacgtgctggaagattcctgtcttctttttcgtgtgttctttcctggagccatgggcttctgcggctgtgaagagacggcctcggttccctgtcaatagcaattccaacggaggaaacgagctttgccctaagattcgcattggtcaggatgatttgcccggttttgacttaatctctcagttccaggtagataaggccgcatccagacgtgccatacaaagggttgtgggttcagctactctccaggtggcatataaacttggcaacaacgtagacttccggattcctacaagaaacttataccctagcggacttccggaggaatattcttttctgaccacctttcgtatgaccggcagtacattgaaaaagaactggaacatctggcagatccaggactctagtggcaaggaacaggtcggcattaaaataaacggccaaacccagagcgtcgtcttttcatacaaaggcctggatggatcccttcagactgcggcatttagcaacttaagttccctgttcgacagccagtggcacaaaattatgatcggggtagagcgaagcagtgccaccctctttgtcgactgtaataggatcgagtcacttccaataaaaccccgtggccctatcgatattgacgggtttgcagtgctgggaaagctggcggataacccacaggtttccgtacccttcgagctccaatggatgctcatccactgtgatccactccgccctagaagagagacatgtcacgaattgcccgctaggataacaccatcacagacgacagacgaacggggtccaccaggggaacagggtccccctggaccacctggtccaccgggtgttcctggtatcgatggcatcgatggcgacagaggacccaaaggacctcctggaccaccaggcccagcgggagaaccaggtaagccaggcgctcctggaaagcccggtacccccggagccgacacgagtccttag

SEQ ID NO: 4685 - DNA, 2037 bp, Artificial Sequence
  Description of Artificial Sequence: Synthetic coding sequence
atggcttggaccgccagggaccgaggtgccctgggccttctcctcctcggtctttgtctctgtgccgcacagagagggcctcccggagagcagggtccccctggccctcccggaccacctggggtaccaggaatcgacggaatcgatggggacaggggacccaaaggacccccaggacccccaggccctgctggagagccaggaaagcccggagcacctgggaagcccggtacccctggggcagatggcctgacggggcctgatggaagcccgggatctattggcagcaaggggcaaaaaggcgagcctggggtccccggttctaggggcttccccggtaagatcctccccctgctgcagggcccacccggtacggccggtctgccaggggaactaggtagagtgggtcctgtgggcgaccctggacgcagaggccctcctggcccacctgggcctccagggccacgaggtaccatcggtttccatgatggagatcctctgtgtccgaatgcttgcccacctggaaggagcggctatcctggcctccccggaatgagaggccacaagggagctaagggcgagatcggagaacctggaaggcaaggccacaaaggcgaagaaggggaccagggtgagttaggagaggtaggggctcagggcccaccgggtgcacagggcctgaggggaatcaccgggattgttggagacaagggcgaaaagggcgcacgcggactggacggggagcccggtccacagggtttgccaggcgcaccaggcgatcaaggacagagaggcccacctggtgaggccggacccaagggtgacaggggggcagagggagcccgaggcataccgggtctccctgggcctaagggggacaccggcctcccaggtgtggatgggcgagacggaatccccggaatgcctgggacgaagggggaacccggaaagccaggcccacccggtgacgccggattacagggtctgccgggagtacccggaattccaggggcaaagggcgtcgctggcgaaaaaggttctaccggggcaccaggaaaacccggacaaatgggaaactcaggaaagcccggacagcaaggacctcccggtgaggttgggccacgaggccctcagggtcttcctggctcaagaggcgagctcggtccagttgggtctcccggactgcccggaaagttgggctctctgggctcgccaggcctgccaggcctgcctgggccacccggtctgcccggaatgaaaggggaccgcggtgtcgtaggcgaacccggaccaaaaggtgagcaaggggcttccggtgaggaaggcgaggcaggtgagcgcggtgaactgggagatattggactacctgggcctaagggctccgctgggaatcctggggaaccaggcctccgcggacctgaaggatccagagggttaccaggggtggaaggccctcgtggcccacccggtccgagaggcgtccagggggaacaaggtgccaccggcttgccgggtgttcaggggcctcctggcagagccccaactgatcagcacatcaaacaagtgtgtatgcgggtcatacaggagcacttcgcggagatggccgcatcccttaaaaggccagattcaggagccactggactgcctggccgacctggccctccaggacccccaggccctccaggggaaaacggtttccccggacaaatgggaatcaggggattgcccggaattaagggccctccaggagctctcggattgcgaggccctaaaggagacttaggagagaagggtgagagaggtcctcctggaaggggccctaatggcctccccggagcgatcggtctcccaggtgaccccggtcccgcttcttacggcaggaacgggcgtgatggtgaaagaggcccaccaggagtggccggtataccaggtgtccctgggcctcccggtcctcccggtcttccgggattttgcgaacccgcaagctgtacaatgcaggccggtcagagggcattcaataaagggcctgacccatag

SEQ ID NO: 4686 - DNA, 252 bp, Artificial Sequence
  Description of Artificial Sequence: Synthetic coding sequence
atggcagcagccacagcatccccacgcagcttgctcgtcctgcttcaggtggttgtgctggctttagcgcaaatcaggggccctccaggcgagagggggcctcctggaccccctggacctccaggagtccctggttcagacggtatagacggccctccgggacctgtcgggctgcctggagaaattggcatccgaggacctaagggcgacccaggccctgatgggcctagcggtccacctgggcctccctag

SEQ ID NO: 4687 - DNA, 2070 bp, Artificial Sequence
  Description of Artificial Sequence: Synthetic coding sequence
atggcagccgcaacggcctctcctcggtcactgctggttctgttgcaggtagtagtgctggccctggcgcagattagaggcccacctggggaacgaggacctccagggcctcctggccctcctggggtgccaggcagcgatgggattgacggcgataatggacccccaggaaaggctgggccacccggtcccaagggtgagcccggtaaggccggaccagatggtccagacggcaaacccggtattgacggcctcacaggagccaagggggagcctggacccatgggcattccaggtgtgaaggggcagcccggtttacctggcccacccggactcccaggcccaggatttgccggacctcccggacccccaggcccagtagggctgcctggtgagattggcattcgaggacccaaaggggaccctgggcctgatggcccttccggtcctcctggacctcctggcaagccaggcagacctggcaccattcagggtctggaaggcagtgccgatttcctttgtccaacaaactgtccgccaggcatgaagggtccccctggacttcagggcgtcaaaggacatgccggaaagaggggcatactgggtgatccaggccaccagggtaagcctggtcctaagggggatgtcggcgcatccggggagcaggggattcctggcccaccaggccctcagggaattaggggctacccaggcatggctggacccaagggcgaaaccggtcctcacggttataagggcatggttggcgcaatcggtgccaccggaccccctggcgaggagggtccacgtgggcctcctggcagggctggggaaaaaggcgacgaaggctctcccggaattcggggtcctcaaggaatcaccggtcctaaaggggctacggggccacccggtatcaacgggaaggatgggacccccggaacgccgggaatgaagggctccgccggacaggcgggacagcccggatctccaggccaccagggcctggcgggagtcccaggccagccaggcactaagggtggaccgggagatcagggcgaacctgggcctcagggacttcctggttttagcggcccacctggtaaggagggcgagcccggaccaagaggcgaaattggccctcaaggtattatgggccagaagggggaccagggggaaaggggccctgtgggccagcctggcccacagggaagacagggcccaaagggagagcaagggccaccaggaatccccggaccgcagggactccctggggtcaagggagataaaggctcccccggtaagactggcccacgcggtaaagttggcgatccaggggtcgccggtctaccgggagagaagggcgaaaaaggtgagtctggagaacctggtccgaagggacagcagggggtccgtggtgaacctggctacccgggacctagcggggatgcgggtgcaccaggagtccagggatatcccggacctccaggcccaaggggtctagcagggaataggggtgtgcctgggcagccaggtcgtcaaggggttgaaggaagggatgctacggaccagcacatcgtagatgtggctcttaagatgcttcaggaacagttggctgaagtggcagtttctgctaaacgtgaggctttgggggctgtcggaatgatggggcctcccggacctcccggacctccgggataccccggaaagcaagggccacacggccatccgggtccacgtggcgtgcctggtattgttggagctgtaggacagattggcaatactgggcctaagggaaaaagaggcgaaaagggggaccctggagaggtggggagaggtcacccgggaatgccgggtccgcctggcattcccggactgccaggaagacctgggcaggcaatcaacggcaaagacggagatagagggtcgccaggcgcaccaggagaggccggacggcctggcctgccaggcccagtcggtctcccaggcttttgcgagcccgctgcatgccttggtgcctctgcatacgcttctgccaggctgaccgagcccggatcaattaagggcccatag

SEQ ID NO: 4688 - DNA, 2055 bp, Artificial Sequence
  Description of Artificial Sequence: Synthetic coding sequence
atggcagggcctcgggcttgcgctcctctcttgcttcttcttctcctgggagaactcctggctgccgctggtgcccagcgagtcgggctgccaggccctccgggtccacccggaccacctgggaaacctggccaggacggcatagacggggaggctggcccacccggacttcccggaccacctgggcctaagggggcacccggaaagcccggaaaaccgggagaagctgggctgcccggtcttcccggtgtcgatgggcttaccgggcgagacgggccaccaggcccaaaaggtgctcccggagagcgtggaagcctggggcctcccggtcctccgggtctcggcggtaagggtctgccaggcccacccggagaggccggagttagcgggcctccaggagggattggacttagagggcctcctggtcctagcggtctgccgggattgcctggaccgcctggcccacctggacctcctggccatcccggtgtcctgccagaaggagccacggacctgcagtgtccatcaatctgcccccctgggcctccaggcccacctggaatgcccggatttaagggcccaaccggctataagggcgaacagggtgaagttggaaaggacggcgagaagggcgatccaggccctcctggtcctgccggactaccaggctctgtggggctgcagggcccaaggggacttcgaggtcttcccggaccacttggtcctccgggtgatcgagggccaattggtttccgcggtccaccgggaataccgggagcgcctggcaaagcaggcgatcgtggggaaagaggacctgaaggatttcgaggacctaagggtgacctgggcaggcccggtccgaagggcacccccggagtggctggaccttctggtgaacctgggatgcccggaaaagacggacagaacggtgtgccgggactcgacggtcagaagggtgaagctgggcgaaatggagctcccggagagaagggccctaacggactgcctgggctccctggcagagcaggtagcaaaggcgagaagggcgaaagaggaagggccggtgaactcggcgaggccggtccctcaggagagcccggagtcccgggagatgcagggatgccaggcgagagaggcgaagccggtcaccggggatcggcaggcgctctcggaccacaggggcctccaggcgctccaggagttcgcggatttcagggccaaaagggctctatgggggaccccggactaccaggtccccagggcctccggggtgacgttggagaccgcggtccgggtggagctgcaggcccaaagggagaccaggggattgccggttcggatggactgccgggagacaaaggggagcttggaccaagcggcctggtgggacccaagggagagtccggcagtagaggggaactggggcctaagggaactcaggggcctaatgggacttcaggagtccaaggagtgcctggaccccctggaccccttgggctgcagggggtacccggagttcctgggatcacaggcaaaccaggagtgcctggaaaagaagcttcagaacaacggatacgagagctgtgcgggggtatgatctccgagcagatcgctcagctagctgcacatttaagaaaacctctggcgccaggctccatcggccgaccaggacctgcaggtccacctggtcccccaggccctcctgggtccatcggccatccaggggcacgaggccctccagggtaccggggtccaacaggtgagctgggagacccaggtcctcgaggcaatcagggagaccgaggggataaaggggcagccggtgcagggctggatggcccagagggtgatcagggtcctcagggtccccagggagtgccgggaaccagcaaagacggtcaggatggagcccctggcgagccgggaccgccaggcgacccgggactgcctggggcaatcggagcccagggaacgccgggaatttgtgacactagtgcctgtcagggggcagtgctgggcggtgttggggagaagagcggttcccggagctcatag

SEQ ID NO: 4689 - DNA, 576 bp, Artificial Sequence
  Description of Artificial Sequence: Synthetic coding sequence
atgtggtggagtagcacccagaatgcaggaacagaaggggaggccggaccacctggcctaccagggcctcctggtccaaaaggagcccctggtaaaccaggcaaacccggagaagcaggactgcctggactgcctggagtcgacgggctgacagggagggacggacctcccggacctaagggagctcctggtgagaggggatccctcggcccaccgggacccccagggttgggaggtaaaggcctcccgggtccgcctggcgaggcaggagtgtcaggccctcctgggggaatagggctgcgcggaccacctggccctagtggtctgcctggattgcctggcccacctggccctcctggtccaccagggcacccaggggtgctcccagagggtgctacagacctacagtgcccttctatctgcccacctgggccaccaggccctcccggtatgcccggtttcaagggcccaactgggtacaaaggggagcaaggcgaggtgggcaaagacggcgagaagggcgaccctggccctccagggcctgcgggactgccaggtagtgtggggcttcagtag

SEQ ID NO: 4690 - DNA, 576 bp, Artificial Sequence
  Description of Artificial Sequence: Synthetic coding sequence
atgtggtggagttctacccagaacgccggaactgagggggaggcaggcccaccgggactgcccggacctcccggaccaaaaggggctcctggaaagccaggcaaaccaggggaagccggtttgcccggactgcccggtgtggacggactaacggggagggacgggcctcctggccctaagggtgctcccggtgagagaggctctctcgggccacccggacccccaggactgggtgggaaaggccttccaggaccgccaggagaggcgggagtgtctggcccaccaggcggaatcgggctaagaggcccacccggaccctcgggtctacctggcctgcccggaccacccggtcctcctgggcctccaggccacccgggagtacttcctgagggcgctacagatctgcagtgtccctctatatgtccccctggacctccaggccctcctgggatgcctggttttaaggggcctacaggatacaaaggggagcagggagaagtaggcaaggacggggagaaaggcgacccaggcccaccaggacctgccggtctccctgggtcagtgggcttacaatag

SEQ ID NO: 4691 - DNA, 1128 bp, Artificial Sequence
  Description of Artificial Sequence: Synthetic coding sequence
atggggccaccaggccttcccggtctgaaaggagactctggcccaaagggagagaaggggcaccctggcctcattgggctgattggcccacctggcgaacagggtgagaaaggcgatagaggcttacccggaccccagggtagctccggcccaaaaggggagcaggggataacaggcccatcgggcccaatcggaccacccggaccacctggtcttcctgggccaccaggtccgaagggcgctaaagggtcttcaggaccaactggaccaaagggtgaagctggccacccgggtcccccaggaccacctgggccaccaggcgaagtgattcagcctctgcccatccaggcatcgagaactaggagaaatatcgacgcctcccagctgctggatgacggcaatggcgagaactacgtcgactatgcagatggtatggaggaaatcttcgggtccctgaacagcctgaaactggagatcgaacagatgaagcgaccactggggacccagcagaatccagccagaacgtgcaaggacctgcaactttgtcatcctgatttcccagatggtgaatattgggtcgatccgaatcagggctgttccagggactccttcaaggtgtactgtaacttcacagcaggaggtagtacttgtgtgttccctgataaaaagtccgaggggtccaaaatggcacgctggcctaaagaacagccctctacatggtattcccagtacaaaagaggctcactattgtcatacgtagatgccgaagggaaccctgtgggcgtggtccagatgacttttcttcggctcctgtccgcttctgcccaccaaaatgtaacctatcattgctaccaaagcgtggcgtggcaggacgctgctaccgggagctatgataaggcattaagattcttagggtccaacgacgaggagatgtcgtatgataataacccatacattcgtgcgctggtggacgggtgcgccaccaaaaagggctatcagaaaaccgttctggaaatcgatacccccaaggtcgaacaggtccccatcgtggacattatgttcaacgactttggcgaggcctcacagaaattcggatttgaggttggaccggcatgttttatgggctag

SEQ ID NO: 4692 - DNA, 5517 bp, Artificial Sequence
  Description of Artificial Sequence: Synthetic coding sequence
atggatgtccatacccgctggaaggcgagatccgctcttaggcctggagcgccacttctgccaccattgctgctactgctattgtgggctccgcctcctagcagagctgcccaacctgcagaccttctgaaggtgttggactttcacaatctccccgatgggattacaaaaactacaggattttgtgcgacacgtcggagctccaagggtccagacgtggcctaccgagtgactaaggacgcacagttgagcgcacccacgaaacaactctacccggcatcagcgtttcctgaggatttctctatcctgacaaccgtcaaggctaagaagggatcccaagccttcctggtatcaatatataatgagcagggtatccaacagataggtctggagctcgggaggagccctgtttttctgtatgaagaccatactggaaaaccaggcccagaagactatccccttttccggggtatcaatttgtctgacggcaagtggcaccgcattgcgctcagcgtgcataaaaaaaacgtgacattgatcctagattgtaaaaagaaaacgaccaaattcttggatcggtcggatcacccaatgatcgacatcaacggcattattgtgtttggtacccgtattctggatgaggaggttttcgaaggtgacatccagcagctcctatttgtatcggatcacagggcagcttatgactattgcgaacactattcacccgactgtgacacagcggtcccggacactccccagagccaagaccccaatcccgacgagtattacactgaaggcgacggcgaaggagaaacttactactacgagtatccttattacgaagacccagaggatttagggaaagaacccacaccctccaagaagcccgtcgaggccgcaaaggagaccacggaggtgcctgaggaattgacccccacacccactgaggcggctcctatgcccgaaactagcgagggtgcaggaaaggaggaagacgtggggataggtgactacgactacgtcccctctgaagattactacaccccatccccctacgatgacctgacttatggagagggtgaggagaaccccgatcagccaacagatccaggggctggagcagagatccccaccagcacagccgacacatccaacagcagcaatccggctcctccgccaggcgagggggctgatgatcttgaaggcgagttcaccgaggaaacaatcaggaatctcgacgagaactactacgatccttattatgaccccacatccagcccgagcgaaattggccctggaatgcccgctaatcaagacaccatctatgaggggattgggggtcccagaggcgaaaagggccaaaagggtgagccagcaataatcgaacctgggatgctgatagagggtcctcccggaccggaaggacctgcgggtcttccaggcccacctggtaccatgggaccaactggccaggtgggggaccccggagaacgcggaccccctggccgtcctgggttgcctggcgcagatggccttcctggcccaccaggcaccatgctgatgctgccattcagattcggaggcggtggcgacgcaggatcaaaaggcccaatggtgtcagcccaggagtcacaggctcaagccatcctgcagcaagcaagacttgccttgcggggacccgcaggacctatgggattgaccggacgaccagggcctgtggggccaccaggctcggggggtttgaagggagaacctggggacgttggaccgcagggcccacgaggtgtgcagggacctccaggtccagccggaaagccaggaagaagaggtcgggcaggttctgacggagcgaggggcatgcccggacaaactggacctaagggcgatcggggatttgatggactggccggtctgcctggtgagaagggtcacagaggagatcctggtccctctggtccccctggaccacctggagatgatggcgagcgcggagacgacggcgaggtgggccctaggggccttcctggcgagccaggcccaagaggtttactggggcctaagggaccccctgggccaccgggtcctcctggagttacaggaatggacgggcaacctggtcctaaggggaacgtgggaccccagggggagcctggaccacctggacagcaggggaatcctggagcccaggggctgccaggtccacagggagccatcggcccacccggagaaaagggaccgttagggaaacccggactgcccggaatgccgggtgcagacggccctcccggacacccgggtaaagaaggacccccaggagaaaaggggggtcaaggaccccctgggcctcagggacccatcggatatcctggaccaagaggcgtcaagggcgcagatggtattaggggtctgaaggggactaaaggagagaaaggcgaagatgggttccctgggttcaaaggggacatgggtataaaaggagaccgtggcgaaatcgggccacccggaccacggggagaggacggaccagaggggccaaagggtcgaggagggccaaacggcgatcctggtccactgggaccccctggcgagaagggaaagctgggagttcccggattgcccggatatccgggaaggcagggcccaaagggcagcataggcttcccaggatttccaggagccaacggtgagaagggcggtcgtggaaccccaggaaaacccggaccccgtggccaacgaggaccgaccgggccacgaggggagcgagggcctcgcggaatcactggtaagcccggtcctaagggcaattcggggggtgacggccctgccggaccgccaggggagagaggcccaaatggaccccaaggccctaccggctttcctggccctaaaggccctcccggtcctccaggcaaagatgggttgccgggtcaccctggccaacgtggagaaaccggctttcagggaaagaccggaccaccagggccacccggtgtggtggggccacagggacctaccggcgagacaggtccgatgggcgagcgaggccatccagggccacccggtccacctggggaacagggcctgcctgggttggccggaaaagagggaacaaaaggagacccagggccagctggcttacccggtaaggatggccctcctgggctgagaggtttcccgggtgaccgtgggctgcctggacctgtcggggctttgggcctcaagggcaacgaaggccctccaggaccccctggcccagcgggttcaccaggggaacgcggacccgcaggggctgcaggccctatcggcatcccaggtagacctggacctcaaggacccccaggaccggcaggggaaaagggcgctcctggcgagaaaggcccacagggaccagctgggcgtgatgggctccaggggcctgtcggacttcccggtccggcaggcccagttggaccccctggcgaagatggagacaagggagaaataggagaaccaggacagaaaggctcaaaaggggacaaaggtgagcagggtcctcccggacctacgggcccacaggggcctattggccagccaggtccatccggggctgatggagagccaggccctcgtggacagcaggggctgtttgggcaaaagggcgacgagggacccagagggtttccgggtccgccaggtccagtcggtctacaaggactcccaggcccacctggcgaaaaaggggaaactggagatgtaggacagatgggcccacctgggcctcccggacccaggggtccatctggcgctccaggcgctgacgggcctcaggggccacccggtggcattggcaatcccggagctgtcggagaaaaaggcgagccgggagaagccggtgagccagggctccccggtgaagggggtcctccaggcccaaagggcgagcggggtgagaaaggggagtccggaccttcgggcgctgctgggccaccaggacctaaggggcctccgggtgatgatggaccaaagggaagtccaggtcccgtgggtttcccaggagaccctggtccacccggtgaacccggaccagcaggacaagacggaccgcctggtgataagggggacgatggcgaacctgggcagactggatcaccaggtcccaccggagagcctgggccttctggaccgcctgggaaaaggggcccacccggtccagctgggccagaaggcaggcagggggagaaaggtgccaaaggcgaagcaggattggaaggacccccaggcaagaccggaccgatcgggcctcagggagccccaggtaagcccggacctgatggcttgaggggaatcccgggacccgtgggagagcagggcctgcctggaagccctggccctgatgggccacctggccctatgggaccccctgggcttcccggtttgaaaggggactcaggacccaagggtgagaaagggcaccccggtttgatcggactgatcggccctccaggagaacaaggagagaagggggaccgcggtctgccaggtccccaagggtcttcggggccaaagggcgagcagggcattaccggaccttctggccctattggacccccaggtccgcctggcctgccaggacccccaggccctaagggtgctaagggctcatcaggacctaccggccctaagggcgaagccggtcacccagggccacctggcccaccaggaccccctggggaggtgatccaacccttacctatccaggctagcaggactcggaggaacatagacgccagtcaattgctggacgatgggaacggagagaattatgttgactatgccgatggtatggaagaaattttcggatctctaaacagcttgaaattggagattgaacagatgaagagaccgttaggaacccaacaaaatcccgctagaacatgcaaagacctgcagctgtgccatccagacttcccggacggggagtattgggtcgatcccaaccagggatgctctagagacagctttaaagtatattgcaattttactgcgggtggttctacctgtgtgtttcctgacaaaaagagcgagggagcgagaataacatcctggcccaaagagaacccagggagctggttctccgagttcaagcgtggaaaattactcagttacgtagacgccgagggcaatcctgttggggttgtgcaaatgacctttctgcgtttactgtccgccagcgcacaccaaaacgtgacctaccattgctaccagtctgtggcttggcaggatgcagccaccggatcatatgataaggctcttcgatttctcgggtctaacgacgaggaaatgagctatgataataatccctacattcgcgcactggtcgatgggtgtgccacaaagaagggctaccagaaaaccgtgctggaaatcgatacaccaaaggtcgaacaggtcccgatcgtggatatcatgttcaacgactttggagaggcctcccagaagttcggattcgaggttgggcctgcctgctttatgggctac

SEQ ID NO: 4693 - DNA, 633 bp, Artificial Sequence
  Description of Artificial Sequence: Synthetic coding sequence
taacgaaccagaagaaatatagacgccagtcagctactcgacgatggaaacggggagaactacgttgactatgccgatgggatggaggagatctttggttcactaaactctctgaagctggaaatcgaacaaatgaaacgccctttaggaactcaacagaatcccgctagaacatgtaaggatttacagctgtgccaccctgactttccagatggcgagtactgggtcgaccccaatcagggctgctccagggactcctttaaggtgtattgtaattttacagccggaggttctacctgcgtattccctgataaaaagtccgagggaagtaaaatggctcggtggcccaaggaacaacccagcacatggtactcccagtataagcgcggatcccttctctcctatgtagatgccgaggggaacccagtgggggtggtgcagatgactttcctacggctcctgtctgctagtgcgcaccagaacgtcacctatcattgttatcagtcagtcgcctggcaggacgccgctacaggaagctatgataaggctttgaggttcctgggtagtaatgacgaggaaatgtcatatgataataatccatatattcgtgcccttgtcgatggctgtgcttag

SEQ ID NO: 4694 - DNA, 5238 bp, Artificial Sequence
  Description of Artificial Sequence: Synthetic coding sequence
atggggaatagaagggacctgggccagcccagagccggactttgtctgttgttggccgcattgcagctgttgcccggaacgcaagcggatcctgttgatgtgctcaaggctctgggtgttcagggaggccaagcgggagtgcccgagggacctggtttttgcccgcagcgcacgcctgaaggagatagggcattccgaattggccaggctagcacgcttggtataccgacttgggagcttttcccagaaggacactttcctgaaaacttcagcctgctcattacgctcagggggcagccagccaaccagagtgtgctcttgagcatctacgacgagaggggtgccagacaacttggtttggctctgggtccggctttgggactgcttggagatcctttccgcccactaccgcagcaagttaacctgacggacggacgctggcaccgagtcgccgtgtccattgatggcgaaatggtaactctggtggcagactgtgaggcgcaaccgccagtcctcggacacgggccaagattcataagcatcgccggtcttactgtcctcggcacacaggaccttggggagaaaacattcgaaggcgacattcaggagctgctgatttcacccgatccccaggctgcttttcaggcctgcgagcggtacctccctgattgcgacaatctggcaccagcagctacagtcgcgcctcaaggcgaacctgagacccccagacctcgacgcaaggggaaggggaaaggacgaaagaagggccgtggcaggaagggaaaagggcgaaagaagaacaaggagatttggacaagttctcctccgcctgatagtgccgagaatcaaacttccaccgacatacctaaaaccgagacacctgccccaaatttgcccccaacacccacacctctggtcgtgacgtctaccgtcaccaccggcctgaacgcaacaattctggaacggtctctggacccagattcaggcaccgagctcggaacattggaaaccaaagccgcaagggaggatgaggagggggacgattcaaccatgggacctgatttccgggctgccgagtacccctccagaacccagtttcaaatctttccaggtgccggagaaaagggggctaaaggagagcctgccgtgatcgagaaggggcagcagttcgaagggcctcccggagccccagggccacagggcgtggtgggcccttctgggcctccgggtccgccagggttccccggagaccctggtccacccggtccagctggcctcccaggcattcccggtattgatggcataagggggcctcccggaacggttatcatgatgccatttcagttcgcaggcggttcattcaaaggccctcccgtgagttttcagcaggcgcaagcccaggctgtactgcagcagacacagctgtccatgaagggccctcccggtcctgtaggcctcaccggaaggcccggacctgtgggcttacccggtcatcccggtctgaagggagaagaaggggctgaagggcctcagggccctaggggactgcaggggcctcatggaccccctggccgagtgggaaagatgggaagaccaggcgcagatggggctagaggacttcccggagataccggcccaaaaggtgatagggggttcgatggcttgccaggcctacccggagagaaaggacaaaggggcgactttggccacgtgggacaacctggccctcctggagaggacggagaaaggggggctgagggacccccaggccctacgggacaggccggagaacctggccctcgagggttgttgggaccgcgtggatctccgggacccaccggtaggcccggtgtgacggggatcgacggggcaccaggtgctaaagggaacgtgggtccgccaggcgaaccgggtcccccaggacagcagggcaatcatggcagccagggcctgccaggccctcaaggcctcatagggacccctggcgagaaggggcctcccggaaacccaggaatcccaggcttgccagggtccgacggacctctaggacacccagggcacgagggacccaccggggagaagggagcccagggcccaccgggtagtgccggtccccctggctaccccggaccccgtggggtcaagggaaccagtggaaaccgcggtcttcagggggaaaagggggaaaaaggggaggacggattccccggattcaagggagacgtcggtctgaagggcgaccagggcaaaccaggcgcaccaggtcccaggggagaggatggcccagagggaccaaaaggtcaggccggacaagcaggcgaggagggtcccccaggatcagccggtgaaaagggaaagctgggcgttcccggtttgccaggctatccaggtcgcccagggccaaaggggtctattgggttccccggaccactcggacctattggagagaagggtaagagcgggaagacaggtcagcctggactcgaaggggagcgtgggcctcctggatctcggggtgaaagggggcagccaggggctacgggccagcccggtcctaagggagatgtggggcaggatggggctccagggatcccgggagagaaaggattaccaggactgcagggccctcctggatttccaggcccaaagggtccccctgggcaccagggaaaagacggacgccctggccaccctgggcagaggggagagctcggcttccaagggcagacaggccctccaggaccagcgggagtgctagggccacaggggaaaaccggcgaagtgggaccccttggagagaggggtcctccaggtcctccaggtccgcctggagagcaggggttgccgggtctggaggggagggagggcgctaagggggaactgggtcccccagggcctctgggaaaagaaggaccagccggactgagaggatttcccggacccaaaggcggtcccggagaccccggtcctaccgggctgaagggtgataaaggaccccctggcccagttggcgcaaatgggagtccaggcgagcgaggccctctcggcccagccggtggcataggcctacccggtcagtcgggctccgaaggccctgtagggccagccggaaagaagggatcgaggggagagaggggcccacctgggccaactgggaaggacggaatcccgggacccctaggccctctcggacctcccggagcggcaggcccatctggagaagaaggcgataagggggatgtcggggctcctggtcacaagggcagtaagggcgataagggcgacgctggcccacccggacaaccaggaatcagaggacccgcagggcacccaggaccccctggcgctgacggagcccagggtcgaagagggccaccgggtctgttcgggcagaagggagatgacggagtgcggggatttgtcggcgtgattggcccacccggactgcaagggttgccgggtccacctggggaaaagggcgaggtgggcgatgtggggagcatgggaccccacggagccccaggccctcgtgggccacagggcccaacgggatccgagggcactcccggacttccagggggagtaggccagcccggtgcagtgggagagaaaggcgaacgtggcgacgcaggcgatcctggcccaccgggagcaccaggtattccagggccaaagggggatattggggagaagggcgactccgggccatccggagccgcaggacctcctggtaagaagggccctccaggcgaagatggagccaaaggtagtgtgggcccaaccgggctacccggtgacctcggcccaccgggagacccaggtgtgagtggcatcgacggaagcccaggtgaaaagggggatcctggggatgtggggggtccgggacctcctggggcttctggtgagcctggggcacccggacctcctggtaaacggggtccttccggccatatgggtcgcgaggggagggagggcgaaaagggagctaagggggagcctggacctgatggccctccgggacgcacagggcctatgggcgctcgcggacccccaggaagagtgggcccagagggcctccgcggaataccgggacctgtcggggaacctggactgctaggggctcctggtcagatgggcccaccaggtccccttggtccgagcgggttacctggtttaaaaggagatactggtcctaagggcgaaaagggacatatcgggctgattggcctcattggccctcccggagaggcaggagaaaaaggtgatcagggtttacccggagtccagggaccaccaggccctaagggggacccgggtcccccaggacccatcgggagtctcggacacccaggaccacctggagtggccggacctttgggacaaaaggggagcaagggttccccgggttccatgggtcccagaggtgatactgggcctgccggaccacccggacctcccggagcacccgctgagctacacgggcttcggaggaggcggcgtttcgtacccgttccactccctgtagtggaaggcggtttggaggaagttctggcctccctaacttcattatcactggaattggagcagctgagaaggcctcccggaaccgccgagcgcccaggactagtgtgtcatgagctacacaggaatcatcctcacttaccagatggtgagtactggattgatccgaaccaaggatgtgccagagactcttttagggttttctgtaacttcacagcagggggtgaaacatgtctgtacccggacaagaagtttgaaattgtgaagctggcttcctggtccaaagagaaaccaggtggctggtatagcacttttaggcgaggcaagaaattcagctatgttgatgccgacggttctccagttaatgtcgtccagttgaactttttgaagctgctgagtgcaactgcacgccagaatttcacctacagctgccaaaatgcagcagcctggttagacgaagctacgggcgattacagtcattccgcccgtttcctcggaacaaatggagaagagctgtcttttaaccagaccacagctgccaccgtgagtgtcccccaggatgggtgtagattaagaaagggtcagacgaagactttgtttgagttttcatccagccgggctgggtttctgccactgtgggatgtggccgctaccgatttcgggcagaccaaccagaaattcgggttcgagctgggccctgtttgtttctcaagttag

SEQ ID NO: 4695 - DNA, 9534 bp, Artificial Sequence
  Description of Artificial Sequence: Synthetic coding sequence
atgcgaaagcaccgccacttaccgcttgtcgccgtcttttgcctgtttctctctggatttccgactacacacgcccaacagcagcaggccgacgtcaagaatggagctgccgcagatatcatttttctggtggacagttcctggaccataggtgaagaacattttcagctagtcagagaattcctatacgacgtggtcaaatctttggcagtaggtgagaatgattttcacttcgccttagtgcagttcaatggcaacccccacaccgagtttctgcttaacacctacaggacgaagcaggaggtcctgagccatatatctaacatgtcatatatcggaggcactaaccaaacaggcaagggtttggagtacatcatgcagagccacttaactaaggctgccggaagtagggctggggacggcgtgccccaagtgatcgtcgtgctgaccgacggacatagtaaagacggcctcgccctgcccagtgcagaactcaaatccgctgacgtgaacgtgttcgcaatcggcgtagaagacgcggacgaaggagcactgaaggagattgccagcgagcctctaaacatgcatatgtttaacctggaaaattttaccagcctgcacgacatcgttgggaacctcgtgagttgtgtacacagcagcgtgtcacccgagcgtgcaggagatacagagactctcaaagacatcacggctcaagactctgctgacatcatcttcctgatcgatggatctaacaacactggctcagtcaattttgcagtcatactggacttccttgttaatctcctagaaaagttacccattggaacgcagcagatcagagtgggagtcgttcagtttagcgacgaaccaagaaccatgttcagtctggacacttacagtaccaaggcacaagtgttgggtgccgtcaaagctctggggttcgcaggcggtgagctggcaaatataggtctggcgctggacttcgtggtggaaaatcactttactcgcgcagggggaagccgggtagaggagggagtgccacaggtgcttgtcctcatttccgcaggaccttcaagtgatgagataaggtacggcgtggtggctctgaagcaggcttcagtattttccttcggcctgggcgctcaagctgcctccagggccgagttacagcatatcgcaacagatgacaatctggtgttcacagtgcctgagtttagatccttcggtgatttacaggaaaagctgttgccttatatcgtgggagtggcccagaggcatatagtgctaaagcctcccaccatcgtgactcaggtgatcgaggtgaacaaacgggacatagtcttcctggtcgacgggtcttccgcacttggcttagctaactttaacgccatccgagactttatcgccaaagtcattcaacgcctggaaatcggccaagatcttatacaggtggctgtggcccagtacgctgacaccgtcagaccagagttttattttaatacacacccaaccaagagggaggttatcaccgctgttcggaaaatgaagccccttgatggttcagcgctatatacaggctccgctttggacttcgttcgcaataacctgtttacctctagcgctggctatagagccgctgagggcatcccaaaactgctcgtgctaatcacgggtgggaagagtctggacgagatctctcaaccggctcaagagttaaagcgaagcagtatcatggcctttgccattggcaataagggagcagatcaggccgagctggaagagatagccttcgattcatccctcgtgttcatcccagcggagttcagagccgcaccactccaaggtatgctgcctggattgctggcacccctcaggacactttccgggactccagaggttcacagtaacaaacgagacatcatatttctcctcgacgggtctgccaacgtcggaaagactaattttccttatgttcgtgactttgtcatgaatctggtgaattccctcgacatcggaaatgacaacattcgggtgggattagtgcagttctcagacacccctgtgaccgagttttccctgaacacctaccagaccaagtcagatatcttggggcacctccgtcagctgcaactgcagggcggaagcggtctcaacacaggcagtgcccttagctacgtgtatgcgaaccacttcaccgaggctggaggaagtcgcatcagagaacatgtaccacagctgctcctgctgcttacggcaggtcagagtgaagactcgtatctacaggctgccaacgctctcaccagagcaggaatccttactttctgcgtcggagcctctcaggccaataaagcagaattagagcagatcgccttcaatccctcactggtctacttaatggacgacttttccagcctgccagccctgccacagcagttaattcaaccccttacgacgtacgtctccggaggagtggaggaagtacctcttgcccagccagagagcaagcgcgatatcctgtttctattcgacggctccgctaaccttgtggggcagttcccggttgttcgtgacttcctgtacaagatcattgacgagcttaatgttaaaccagagggaactaggatcgcggtcgctcagtattcagacgatgtgaaagtagaatcgagatttgacgagcaccaaagtaaacctgagattctcaacctagtaaagcgcatgaaaattaagactggcaaggctcttaacttggggtatgcgttggactatgcacagaggtacatctttgtaaagagtgctgggtccagaatcgaggacggcgtgcttcaattcctcgttctcctcgtcgctggcaggagcagtgaccgcgttgacggcccagcttccaatctgaagcaatccggtgtcgtaccgtttatctttcaggccaagaatgcagatccagctgaacttgagcagattgtgctcagccccgcttttatcctcgccgcagagtcactgcctaagattggcgacctgcacccgcagatcgtgaatcttttgaaaagcgtgcacaatggagcccctgccccagtgtctggtgaaaaagatgtagtgtttctgctggacggaagcgagggagttaggtcgggctttccgctcttgaaagagttcgttcagcgggtcgtcgaaagccttgatgtcggccaggacagagtccgggtggcggtggtgcagtattcagacagaacccggcctgagttctatcttaactcttacatgaacaaacaagacgtggtgaacgctgtgcgacagctcacgctgctggggggtcctacacctaacacaggcgcagcactagagttcgttctcagaaatattttggtgtctagcgccggttcaagaatcacggagggagttccccagctgctgattgtgttgacagccgatcgctccggggacgacgtgaggaatccaagcgtcgtggtcaagcgtgggggtgctgtgcccatcggcattggcataggaaatgctgatatcaccgagatgcaaacaatttctttcatacctgattttgccgtggccatacctacattcaggcagctcgggaccgtacaacaggtgatttcggaacgggtaactcagcttactagggaggaattgtcaagactgcagccagtgctgcaacccctcccctcacctggggtcggtggcaaacgggatgtcgtctttctaatagatgggagccagtcggctgggccagagtttcagtacgttagaaccctcattgagaggctcgtagactacctggacgtgggtttcgacaccactagggtggcagtcattcagttctcagatgatcctaaggtcgagtttctactgaatgcacattcatccaaggacgaggtccagaatgcggtccagagactccgtcctaaagggggaaggcagattaatgtgggaaacgcactcgagtatgtttcccgaaacatctttaaacggccactgggcagccgcatcgaagaaggggttccacagttccttgtcttgattagctcaggtaagtctgatgacgaggtggacgatccagctgttgaactgaagcagttcggtgtggctccatttacgatcgctcgcaacgctgaccaggaagagctggtgaaaattagtctgtcgccagagtatgtgttcagtgtgtctacattccgagagctccccagtctagaacagaaactgctaactcctattaccactctgacatctgagcagattcagaagctcctcgcctccacaagataccccccacctgctgtggaaagcgatgcagcagacatcgtgttcctcatcgatagttccgaaggggtccggcctgacgggtttgcgcacataagagactttgtttcccgcatcgtgcgacggctgaatattgggccaagcaaggtgcgggtgggtgtggtgcagtttagcaacgacgtttttcctgaattctacctcaaaacctatcgctctcaagccccagtgctcgacgcaattaggcggctgaggctacgcggagggagtcccctgaataccggcaaggccctggagtttgtggcacgtaacctgtttgtaaagagcgccggttcacggatcgaagacggtgttcctcaacacctggtcctagtgctcggcggtaagtcgcaggacgatgtcagtcgctttgcacaggtgatcagatcaagtggcattgtgtctcttggggtcggggatcgcaatatcgatcgcactgagttgcaaactatcaccaacgatcccaggctggttttcaccgtgcgagagttccgtgagctacctaacatcgaagaaaggataatgaacagttttgggccaagcgcagccacccccgctcctccaggggttgataccccacctcctagtcgacccgaaaagaagaaggcagatattgtgttcctgctggacggatcaatcaatttcagacgagactcatttcaggaggtcctgcgtttcgtgtccgagattgttgataccgtatatgaagatggagattcaatccaggtggggctcgtccagtacaactctgatccaacagatgagtttttcttgaaagactttagcactaagagacagatcattgacgctatcaacaaggtggtgtacaaagggggacgacacgcaaacacaaaagtcggactggagcatctgcgtgtgaatcatttcgttcctgaagcgggatccagactagatcagcgcgtaccccagattgcttttgtcatcactggcggaaagagcgtcgaagatgctcaggatgtgagccttgcactgactcaacgcggagtcaaggtattcgctgtgggcgtgcgaaacattgactccgaagaggtaggcaagattgctagtaattctgcaaccgcctttagagtaggaaatgtccaggagctgtcagagctttctgagcaggtgcttgaaactctccacgatgctatgcacgagactctctgccctggagtgactgacgccgctaaggcttgtaacttagatgtgattttaggattcgacgggagccgggaccagaacgtgtttgtagcccagaagggatttgaaagcaaagtggacgccattctgaacagaatttctcaaatgcacagggtgtcttgttcaggcggtcgaagtcccacggtcagagtttccgtagttgccaatacacctagcggtcccgtagaggctttcgattttgatgaatatcagcccgagatgttagaaaaattccgtaatatgaggagccagcacccctacgttctgacagaggacacgcttaaggtatatctaaacaagttccggcagtcatcccctgatagtgtgaaggttgttatacacttcaccgacggggcagacggagacctggccgacctacatagagccagtgaaaacctaagacaggagggcgtccgtgcactgatcctcgtcggtctggagcgcgtggtcaacctggaacgtctgatgcaccttgagtttggtcggggatttatgtatgaccgacccctcaggctcaatctactcgacctagactacgagctggccgagcagctcgataacatagcggaaaaggcctgttgcggcgtgccgtgcaagtgtagcggtcagagaggcgaccgcggtcctatcggtagtattgggcctaaggggattcctggagaggatggataccggggttatcccggtgatgaggggggtccgggtgagcggggacctcccggagtcaacggcacgcagggatttcaggggtgccctggccaacgtggagtcaaaggatctagggggtttcccggagagaagggagaagtgggagaaatcggccttgatggcctggacggggaggacggagacaagggattacccggaagctctggagagaaaggcaatcctggtagaaggggagacaagggccctcgcggtgagaagggcgagcgcggagacgtaggcatccgaggggacccaggcaatcctggtcaggactcccaggagaggggccctaaaggggagacaggggacctggggccaatgggcgttcctggcagagatggcgtgccgggaggtcccggagagactgggaaaaacgggggatttgggaggagaggtccacctggagccaagggcaataaagggggacccggtcagcctggttttgaaggcgaacaagggactcggggtgcacaggggcctgccggtccagccggaccacctggcctgataggcgaacaggggattagcggcccacggggatccggaggggctgccggagccccaggagagagaggaaggacagggcctctgggacggaagggggagcctggcgagccgggtcccaaaggcggtattgggaatcgaggacctagaggcgagaccggagatgacggccgtgatggagtaggctccgaaggtagacgcggaaagaaaggggagcgtggatttcctgggtatccagggcctaagggtaaccccggagagccgggactgaatgggacaacaggtcccaagggaatcagggggagaaggggcaatagcggaccccctggcattgttgggcagaagggggacccgggttatcctgggcctgctggtccaaagggcaacaggggcgacagtatagaccagtgtgccctcattcaatctatcaaggacaaatgtccttgttgctatggccctctggagtgtcccgttttccccacagaattggcgtttgcattggatacttccgaaggcgtgaatcaagataccttcggacgaatgagggacgttgtgctgtccatcgtcaatgatctgaccattgccgaatcaaattgtcctcgcggtgccagagtagccgtggttacatacaacaacgaggttaccaccgaaatccgcttcgccgatagtaagcgtaaatctgttctcctggataagattaaaaacctgcaagtggctctgacgagcaaacaacagtcgttagagaccgccatgagtttcgttgcacgaaacacttttaagcgcgtgcgaaacggcttcctgatgcggaaggtggccgtgttcttctccaatacaccaactcgtgcgtccccccaactgcgcgaggccgtgctgaaactgtcagacgccggaattactccactctttctcactcgtcaggaggaccgacagctaatcaatgccctacaaattaacaatactgctgtcggtcacgccttagtgctgcctgccggacgtgatcttaccgattttctagagaacgtactgacctgccatgtatgcctggacatttgcaatatcgatccttcctgcggattcgggtcatggcggccttcttttcgggatcggagagcagcgggatctgacgtggatattgacatggctttcatcctcgatagtgccgaaactaccaccctgttccagttcaatgaaatgaaaaagtacatagcctatctcgtgcgacagcttgatatgagtccagatccaaaggcatcccagcacttcgcccgtgtggcagtagtccagcacgcaccttcagagagtgttgacaatgcgagtatgcccccagtgaaggttgagtttagtctgacagattatgggtcgaaagagaagctcgtggatttcctaagccgaggaatgacgcaactacagggaacccgggcactcggtagtgcgattgaatatactatcgaaaacgtcttcgaaagcgcgcctaatccccgtgacctgaagattgtggtgttgatgctcactggggaggttcccgaacaacagctcgaggaagcccagcgggttattctgcaggccaagtgtaaaggatatttctttgtcgtcctggggatcggcaggaaggtcaacatcaaagaagtgtatacatttgcatcagaacctaatgacgtattttttaagcttgttgacaagtccaccgagcttaacgaagagcccctcatgcgtttcgggagactgttgccttcatttgtgagcagcgagaatgccttctatttgtcgccagacattagaaaacagtgtgactggttccagggagaccagccgaccaaaaatctagtgaaattcgggcacaaacaagtaaatgtcccaaacaatgtgacatctagccccacctcgaaccccgtgacaactactaaaccagttaccaccactaagcccgtaacgactaccacaaagcccgtaacaaccaccactaagcctgttaccatcatcaatcagccttctgtcaagccagctgccgctaaaccagccccagctaaaccagttgccgctaaacccgtcgcaactaaaatggcaacagtacggccacctgtggccgttaagccggcaacagcggctaagcctgtcgccgctaaaccggctgcagtgaggccgcctgctgccgcagcagcgaaacccgtggccactaagcccgaggtgcccaggccccaggctgcaaagccagcggcaacaaaacccgcaacaacaaaaccaatggttaagatgagccgtgaagtgcaggtttttgagattacagaaaactccgctaaactccactgggaacgagctgagcctccaggaccttacttctatgatctcaccgtaacgagcgcccatgaccagagcttggtattaaagcagaacctgactgtgaccgaccgagtgatagggggtcttttagccggtcagacctaccatgtcgcggtggtctgttacctgcggtcacaggtgcgcgcaacataccatggaagcttcagcactaagaagagccagcctccacccccacaacctgcccgatccgcttcctcctccacaatcaacctcatggtatccactgagccactcgccttgaccgagaccgatatttgcaaactgccgaaggacgaaggcacgtgtcgcgactttattctgaagtggtactacgacccaaacactaagtcttgtgcacgcttctggtacggaggttgtgggggtaatgagaacaagttcgggtcgcagaaggagtgcgaaaaggtgtgcgcaccagtgctggccaaaccaggagttatatccgtcatggggacatac

SEQ ID NO: 4696 - DNA, 8934 bp, Artificial Sequence
  Description of Artificial Sequence: Synthetic coding sequence
atgcggaaacatcgccacctccccctggtggcagtgttctgtctgttcctgagcggcttcccaacgacacacgcgcagcagcagcaggctgatgtcaagaatggagctgctgccgacataatttttctggttgatagctcctggactattggggaggaacacttccaattagtcagggaatttctgtacgatgttgttaagtctttggccgttggtgaaaatgatttccatttcgcgcttgttcagttcaacggcaatccccataccgaatttcttctcaatacgtaccgcacaaaacaagaggtactttcccatatcagcaacatgtcgtatatcggcggtacgaatcagacggggaagggactggaatatatcatgcaaagccatctcaccaaagctgcgggaagtcgagccggagacggcgtgccccaagtgattgttgtccttactgatggacatagcaaagacggactggctctcccatcagccgaattgaagtccgcggacgtaaacgtgtttgccatcggagtggaagatgctgacgagggcgctctaaaggagatagcctctgagcctctgaatatgcacatgttcaacttagagaatttcacatctcttcatgatatcgtcggcaacctggtcagctgtgtccacagcagcgtgagccccgaaagagcaggcgatactgaaactcttaaggacattaccgcccaagatagcgccgatatcatctttcttattgacggatctaacaacacgggaagcgtgaattttgctgtcatccttgacttcctcgtcaatcttctggagaaattacctattggcacacagcaaatcagagtgggcgtggtgcagttctccgacgagcctcgcacaatgttctcactggatacctacagcaccaaggcacaggtgttgggtgctgttaaagccctgggttttgcaggtggggagctggccaatataggcttagccctggacttcgtcgttgaaaatcactttaccagggccggtggcagccgcgtggaggagggcgtgccgcaggtcctggtgctcatatccgctggcccatcttctgacgagatcaggtacggtgttgtggcgctgaagcaggctagcgtgttctcttttggactcggagcgcaggccgcttctagagccgaactgcagcacattgcgaccgatgacaacctcgtgttcacagtcccggagtttaggtcgtttggagatctgcaggagaagctgctgccgtatatcgtgggcgttgcccagagacatatcgtgctgaaaccccctacgatcgtgacgcaggtgatcgaagtgaacaagagggatatcgtgtttctggtagacggctctagtgccttgggattagctaacttcaacgcaatcagagactttatcgccaaggtgatacaacggctcgaaattggacaggacctcattcaagtcgctgtggcccaatacgcggacaccgtcaggcccgaattttatttcaatacacaccctaccaagcgcgaagtgatcacagctgtccgcaagatgaaacctctcgatggctcagcattatatactgggagcgcactcgacttcgtaagaaacaacctgttcacctcaagtgcaggctaccgagcagccgaaggtatacccaagctgctagtcctcataaccggaggcaagtccctagatgagatctcgcagcctgctcaagaactgaaacgatctagtatcatggcattcgcaatcggcaataagggcgcagatcaggcagagttggaagaaattgctttcgacagctctcttgtgtttatacctgctgagtttcgagcagcccctctacagggaatgctccccggattgcttgctcctctgcgcacgctgagtgggacaccagaagagagcaagagagacattctgttcctgttcgatggctcagccaatttagtaggccaatttccagttgttcgagacttcctttataaaatcattgatgaactcaatgtgaaacccgagggcacacgaattgctgtagcgcagtacagcgacgatgttaaagtggagagtcgcttcgatgaacatcagagtaaacctgagatcctgaatcttgtgaagcggatgaaaataaaaacaggaaaagcgctgaatctgggatacgcgctcgactacgcgcaacggtacatatttgtcaagtctgcgggatctagaatcgaagacggcgttttgcagttcctggtcctcctggtggctggcagatcgagcgatagagtagacgggcctgcctctaacttaaaacaatccggcgtggtgccatttatcttccaagcgaagaatgccgaccctgccgaacttgaacagatcgtattgagcccagcgttcatcttagccgcagaaagcctgcccaagattggtgatcttcatccccagatagtgaacttactcaaatccgtacacaacggcgcaccagccccagttagtggtgagaaagacgttgtcttcctcctggatggctcagagggtgtccgctcgggattccctcttctaaaagaattcgttcaacgcgtggttgaaagcctggacgttggccaggacagggtgcgagtcgcagtagtccagtacagcgacaggacaaggcctgagttctatctcaatagctatatgaacaaacaggacgtcgttaatgctgtgcggcagctaacccttcttggagggccaactcccaatactggtgccgctctcgagttcgtcctgagaaacatcctagtaagctctgcaggaagtaggatcaccgagggtgttccgcaactcttaatcgtgctgactgccgacaggtccggagacgatgtgagaaaccctagcgtagtagtgaagcggggtggggcagtccccatcggtataggcataggaaacgccgacataactgaaatgcaaaccattagctttatcccggatttcgctgttgcaatccccacatttagacagctggggactgtgcaacaagtaatctctgaacgcgtcacccagctcaccagagaggaattgtcccggctgcagccggttctgcaaccactgccatctccaggcgtgggcggtaaacgagacgtagttttcttaattgacgggtcccagtctgctggaccagaattccagtacgtgaggactctgatagagcggttggtagactacttagacgtgggattcgacaccacgcgcgtggcggtgatccaattctcagatgaccctaaggtggaattcttactgaacgcccactctagcaaggatgaggttcagaacgctgttcagcgccttagacccaaaggaggcaggcagatcaatgttgggaatgccctcgaatatgtctcaaggaacatctttaagaggcccttgggatctaggatcgaagagggtgtcccccagtttctggtgctgatctctagcggcaagtctgatgacgaagttgatgatcccgctgtcgaactgaaacaatttggtgtcgctcctttcacaatcgcacgtaatgctgatcaggaagaactggtcaaaatctctctttcccctgagtatgtgttttctgtttcaacattccgcgagctgccaagcctggagcaaaagctacttacacccattactaccttgacatccgagcagatacagaaactgttggcatccactaggtaccccccaccagccgtcgagagtgatgccgctgacatagtgtttctcattgattcaagtgagggcgttaggccagatggatttgcacacattcgggactttgtcagcagaattgttcgcagactgaacatagggccaagcaaagtgcgcgtgggcgtcgtgcagttctcaaacgacgtattccctgagttttatctgaagacatatcggtcacaggctcctgtgttggacgccattaggcgcctccgactgcggggaggctctcccctgaatacgggaaaggcccttgaattcgtggctcggaacctatttgtgaaatctgctggaagccgcatcgaggacggagtgcctcaacacctagtgctggtgctcggaggcaagtcccaggacgatgtgtctcgattcgcccaggttatccggtcctcaggcatcgtgtccctaggggttggtgatcgaaatattgaccggaccgagctgcaaacgatcactaacgaccctcgcctggtgtttactgtcagagaatttcgggagctccctaatatcgaggagagaataatgaattcttttggccctagcgcggctacccccgcacctcccggagtggacactcccccaccaagtcgacctgaaaaaaagaaggccgacatcgtctttctgctcgacggaagcattaacttcagaagggacagctttcaggaggtgctgaggttcgtatctgagatcgtggacaccgtgtacgaagatggagatagtattcaggtgggactggtgcagtacaactctgatcccaccgacgaatttttcctgaaggacttttctacaaaacgacaaatcatagacgctatcaacaaagtagtctataaaggaggcaggcacgcgaacactaaggtcggcttagaacacctgcgcgtgaaccacttcgttcccgaggctggctcacgccttgaccagcgagtgcctcagattgctttcgttattaccggcggaaagtcggttgaagatgcccaggacgtttcactcgccttaacacagcggggagtaaaagtgttcgctgtgggtgtgcgcaatatagactctgaggaggttggcaaaattgccagtaatagcgccacagcttttcgagtggggaatgtgcaagaattaagcgagctgtcggagcaggtcctggagaccctgcatgacgctatgcatgaaaccctctgtcccggagttactgacgctgccaaagcctgcaatttagacgtcattctaggcttcgatggttccagagaccagaatgtgttcgtagcccagaaaggatttgaatctaaggtggatgctattttgaatcgcattagccagatgcatcgcgtttcttgctccggcggtcgctcccctacggtccgagtgagtgtggtcgccaacactccatcgggcccagttgaagctttcgacttcgatgagtaccagccggaaatgttggaaaagtttcgcaatatgagatcccaacacccctatgtgctcacagaggatactctgaaggtatacttaaacaaatttaggcaatcctctccagactctgttaaggtggtgatacactttactgacggtgccgatggtgaccttgccgacttgcaccgggcttcagagaatctacgccaggagggagtgcgtgcgcttatactagtggggctggaaagggtcgtgaacctggagaggcttatgcacttggaattcggccgaggatttatgtacgacagacctcttcggctgaacctgttggatctcgactatgagctggccgaacagctggataacatcgcggaaaaagcctgctgtggcgttccttgtaagtgttcaggtcagaggggtgataggggtcccatcggctctattggacctaaaggcattcctggcgaggatggatatcgcggatatccaggggatgagggcggacccggagaacgcggtcctccaggagtcaatgggacacagggattccagggctgcccgggtcaaaggggagtcaagggaagccggggatttcctggcgaaaaaggcgaggtcggcgagatcggactggatggtctggatggcgaggacggagataaaggattacccggatcaagtggggagaaaggcaaccctggcaggcggggtgacaaaggtccccgtggcgaaaaaggcgaacgaggcgatgtggggataaggggagaccctggtaatcccggacaggacagccaggagcgcggtcctaagggggagaccggagacctagggcctatgggtgtgcctggccgagatggtgtgcccggtggacccggtgaaaccgggaaaaatggaggcttcggtaggcggggacccccaggggctaagggaaataaaggcggacctggtcagcctgggttcgaaggagagcaggggacgaggggggcacagggacctgcagggcctgccggaccacccggactaattggggagcagggtatttccggacctagaggctccggcggagccgcaggagcgcctggagagaggggcaggaccggaccattgggcaggaagggcgagccaggagagccaggcccaaagggcggtattgggaataggggtcccaggggggaaacaggagatgatggccgtgatggggtgggttccgaaggaagacgaggcaagaagggagaaagggggttccccggatacccaggacctaagggtaacccaggcgaaccaggactgaacggcaccaccgggcctaaagggattcgcggaagacgtgggaacagcgggccaccaggaatagtagggcagaagggggatcccggatacccgggtcctgcaggcccaaaaggcaataggggggactccatcgaccagtgcgccttgatccagtccatcaaagataagtgcccatgctgctatggtccgctcgagtgccctgttttccctaccgagctcgcattcgctctcgatacctcagagggagtgaaccaggataccttcggcaggatgcgtgacgtggtgctgtccatagtgaacgatctcacaattgctgaatcgaactgccctcggggagccagagtggcagtggttacatataacaacgaagttaccactgagattagattcgccgatagtaaacggaagagcgtgctgttagacaaaatcaagaacttacaggtggccctcacaagcaagcagcagtcgctggaaacagcaatgtcctttgtcgctcggaatacattcaaacgcgtaagaaatggctttctgatgaggaaggttgcagtgttctttagcaatacgccgaccagggcctccccacagctgcgcgaggcagttctgaaattgtctgacgctggaattacacctctgttcctgacccggcaggaggacaggcagctgattaacgcgctgcagataaacaacaccgctgtaggacatgcattggtgctgccagctggacgggatttgacggacttcctggaaaacgtcctgacatgccacgtgtgcttagacatttgtaacatagatccttcctgcggctttggaagttggaggccgagcttccgcgataggagggcagctggatctgacgtagacattgatatggctttcattctggactccgctgagacaactacattgttccagttcaatgagatgaagaagtacattgcctatcttgtccggcaacttgacatgagccccgatccaaaagcgagccagcatttcgcacgggtggcagttgtccagcacgcaccctccgagagcgtcgataacgccagcatgcctcccgtgaaggtcgaattttccctgacagattacggctcaaaggaaaaattggttgacttcctgagtagagggatgacacaactgcaagggacccgagccttaggcagtgctatcgagtatactattgaaaatgtcttcgagtctgctccaaatccccgagacctcaaaattgtcgtactgatgctgaccggggaagtgccggaacagcaactggaggaggcacagagagtaatcctccaggccaagtgtaaagggtacttctttgtagtgttggggatagggcgaaaggtgaatatcaaggaggtctacaccttcgctagtgagcctaatgatgtattcttcaagctggtcgataaatccactgaattgaacgaagaaccacttatgagatttggacggttactcccctcgttcgtatcttccgaaaatgcattttacctgtcccctgacatccggaaacagtgtgactggttccagggagaccaaccaacgaaaaacttggttaaatttgggcacaaacaagtgaatgtcccaaataacgttacgtcctcaccaactagtaacccagtcaccaccactaagcctgtgaccaccaccaaaccagtaaccaccaccaccaagcccgtgacaaccactacaaaacccgtgaccatcatcaatcagccatctgtaaagcccgctgcagctaaaccagcccctgcaaagccagtcgccgctaaaccagttgctaccaaaatggctacagtgaggcctcccgtggcagtaaaacccgcaacagcggctaagccagtggcagctaagccagccgcagtccgccctcccgctgccgctgccgctaagccagtcgccacaaagcccgaggtcccaagacctcaggccgcaaaaccagccgctaccaagccggcaacaacaaaacctatggtcaagatgtcccgggaagtgcaggtttttgagatcacagagaattccgctaaactgcattgggagcgggctgagcctcccggtccttatttctacgaccttacggtgacgtctgctcacgaccagtccctggttctcaagcagaatctgacagtcacagatcgcgtgattggcggtcttctggccggacagacttatcacgtggcagtagtgtgctacctgcgctcacaggtgagagccacctaccatggatcattctcaacaaagaaatcacaacctccgcctccccagcccgctagaagcgcaagtagctccaccatcaacctgatggtctccaccgagcccctggctttgacagaaactgatatctgcaaactcccgaaggacgagggaacctgtcgagatttcattctgaaatggtattacgaccccaacacaaagagttgcgctaggttctggtacggaggttgtggtggtaacgagaacaagtttggatcacagaaggagtgtgagaaggtttgtgctcccgtactggctaagccaggggtgatatcagtgatgggaacgtac

SEQ ID NO: 4697 - DNA, 8931 bp, Artificial Sequence
  Description of Artificial Sequence: Synthetic coding sequence
atgcgtaaacataggcacctccccctagtggccgtgttctgcctatttctgtcaggtttcccaacaacccatgctcagcaacagcaggctgacgtgaagaacggagctgccgctgacattatcttcttggttgactcatcatggaccatcggagaggagcacttccaactggtcagggaatttctgtacgatgtggtgaaaagtctggccgtgggtgagaacgattttcatttcgccctggtccagtttaacggcaacccccacaccgagtttttgctaaacacttacagaaccaaacaggaagtcttatcccatataagcaacatgagctacataggaggaactaaccagactggaaaggggctggagtacatcatgcagtctcacctcaccaaagccgctggcagccgcgctggagacggagtgcctcaggttattgttgtactcactgatggacacagcaaggacggcctggccttgccaagcgccgaactgaagagcgctgatgtgaacgtgttcgctatcggggttgaggacgcagacgagggggctctgaaggaaatcgcctccgagcctctgaatatgcacatgttcaatttggagaattttacgagccttcacgacatcgtaggtaatctggtcagctgtgtccactcttcggttagccccgagcgagccggagacaccgagacactgaaggacatcactgtcatcgaggtgaacaagcgggatatcgtattcttagtcgatggctcttccgctttagggctcgcaaactttaacgctattcgtgacttcatcgctaaggtgatccagcgtctggaaattggccaggacctcatccaggtcgctgtggcacagtacgccgacaccgtgcggccagagttctacttcaatactcatcccaccaaacgcgaggtgattacagccgttcggaagatgaaacctttagacggatccgcactctataccggctctgctctcgacttcgttcgaaataacctgttcacctcatcagctggctatagggccgctgaggggattccaaaacttttggttcttatcacggggggaaaatctctggatgagatttcgcagcccgcacaggaacttaagagaagctcgatcatggcattcgcaatcgggaacaagggcgctgaccaagctgaattggaggaaattgccttcgactccagccttgtgttcattcctgccgaatttcgcgctgccccacttcaggggatgctgccagggcttcttgctcctctgcggaccctaagcggcacccctgaggtgcactccaacaagcgagacattatattcttgttggatggttcggcaaatgtgggcaagaccaatttcccttacgtgagggactttgttatgaacctggtgaacagcctggatataggcaatgacaacatacgagtgggactcgtgcaattcagtgatactcccgttacagaattctcgctgaacacgtatcagacaaagagtgatattttgggtcaccttcgccaacttcagctgcagggcggaagcggccttaatacaggctcggcacttagttacgtgtatgcgaatcatttcacagaagctggcggttcaagaattcgggagcacgtgccgcagcttcttctcttgctgactgctgggcaatccgaagatagctatctgcaggccgcaaatgccttgacccgagctggtatactgacgttctgcgtcggggcaagtcaggccaacaaggcggagctcgaacagatagccttcaacccttccttggtttatctgatggatgacttcagcagcctgccggcactcccgcagcaactgattcagcctctgactacctatgtgagcgggggagtcgaagaagtgcctttagctcaaccagagagcaaaagagacattttgttcctgttcgacggcagcgccaatctggttggccagtttccggtcgtgcgagatttcctctacaagatcatagacgaacttaacgtgaagcctgaagggaccagaatcgccgtagcgcagtattccgatgatgtcaaagtggagtcacgtttcgatgagcatcagagtaagcctgagattctgaacttagtgaaacgaatgaagattaaaacaggaaaggctctcaatcttgggtacgcactcgattacgcccagcgttacatattcgttaagtccgctggcagccggattgaggacggcgtactccaatttctggtgctgctggttgccggtaggtcctccgaccgagtcgacgggcctgcaagcaacctaaagcagtcaggagttgtacctttcatctttcaggctaaaaatgccgaccccgctgagctggaacagatagtgttgtcccccgctttcattcttgcagcagagagcctgcccaaaatcggtgatctgcatccccagatcgtcaatttgcttaaatccgtccataacggcgctcctgctcctgtttctggtgagaaagatgtggtattcctgttggacggttccgaaggagtgcggtctggattcccgctgttgaaggagttcgtgcagcgagttgttgagagtttggacgttggtcaggatcgcgtgagagttgcggttgtacagtattccgataggacccgtccggaattttatctgaattcgtacatgaataagcaggatgtggtcaacgcagttaggcagctgacactactgggaggcccaactcctaacacaggagctgcactagagtttgttctgcgcaacatcttagtgtcctccgctggttcccggatcacagaaggtgtcccacagcttttaattgtattgaccgccgacaggtctggcgatgacgtgaggaacccgagcgtggtggttaagcggggaggggcagttcctataggcatagggatcgggaacgccgatatcacggagatgcagaccatttcgtttatacctgacttcgcagttgccatcccaacgtttcggcagttgggcactgtccagcaagtgatctccgagcgagttacccaattaaccagagaagagctttccaggctacagcccgtgctgcagcccctgccatcacccggagtcggcggtaagcgggacgtggtgttcctgatcgatggctcacagagcgctggacctgagttccaatacgtgagaacgttgatagaaagattagtcgattatctggatgtgggattcgacacgacccgcgtcgccgtcattcagttttccgatgatccaaaggtggagttcctccttaatgcacattcttcaaaagatgaggtacagaacgccgtgcagcgcctcaggcctaagggtgggaggcagattaacgtcggcaatgccttagagtatgtgagtagaaatatttttaagcggcctctgggcagccgtatcgaggagggtgtgccacaattccttgtgcttatatcctccggtaagagcgacgatgaagtggacgaccccgctgtggaactgaagcagttcggcgtggcgcctttcaccatcgccaggaacgcagatcaggaggaactcgtgaagatcagtttgtcgccagagtacgtttttagtgttagtacatttagggagttgccttccctggagcagaagctcctgactcctataacaacgctcacgagcgagcaaatccagaaattactggcctctacccgttaccccccaccagctgtggaatctgacgccgctgatattgtcttcttgatcgatagtagcgagggtgtcaggcccgacgggttcgcccacatacgcgattttgtgagccgtatcgtgagacggctgaatatcggtccatctaaagtgcgcgtaggcgtagtgcagttctcgaacgacgtgttccccgaattttacctgaagacatataggagtcaggcccctgtgctggacgccatcaggagactccggttgcgaggcggaagtcccctgaataccggcaaggcactggagttcgtggcccgtaacttattcgtgaagagcgcaggctcacggattgaagatggagtgccacaacatctggtgctagtgctgggaggcaagtcacaggacgatgtcagcagatttgcccaggtgattcgatctagcgggattgtctccctcggcgtgggcgatagaaacatcgaccgcaccgagctccagactattaccaatgatccaagactcgttttcacagtgagagagttcagagagctgccgaacattgaggaaagaattatgaattcttttgggccaagtgccgcaactcctgctccacccggagtcgataccccccctccttccaggcccgagaaaaagaaggcagacatcgtgttcctcttggatggctccataaacttcagaagagattctttccaggaggtgttgcggtttgtatctgagattgtggacacagtgtatgaagatggagactctatccaagtgggcttggtccagtataattcggatcctactgatgagttttttctcaaggatttttctactaaaaggcaaatcattgatgcaatcaataaagtagtgtataaagggggtagacatgcaaacaccaaagtcggactggaacacctgagggtcaatcattttgtcccagaggccggtagtcgtcttgaccagcgcgtgccccagatagcattcgttattaccgggggaaagtctgtggaagatgcacaagacgtatctctggcgctgacccagcggggagtgaaggtatttgcggtcggggtgcgaaatatcgactctgaggaggtggggaaaattgcatccaattccgccactgcctttcgcgtgggcaatgtgcaggaattgagtgagctgtccgaacaggtgctcgagaccttgcacgatgctatgcatgaaactctgtgccctggagtgacagacgcagccaaggcctgtaatctcgatgttatactcggcttcgatggaagcagagaccagaacgtgttcgtcgcccaaaaggggttcgagagtaaagtcgacgccattctaaatcgcatcagccagatgcatagagtcagctgttcagggggtcggagtcccacagttcgtgtgtctgttgtagcgaacaccccatccggacccgtggaagcattcgattttgacgagtaccagcccgagatgcttgagaagttccgcaatatgagaagccagcacccgtatgtcctgactgaagataccctaaaagtttatttgaataagtttcgccagtcctctccagacagtgtaaaagtggtgatacatttcacagacggggctgacggcgatctggccgacctgcatcgggcttccgagaacctgcggcaggaaggggtccgggctctcatccttgtgggcttggagcgtgtagtgaatctcgagaggctcatgcacctagaatttggacggggatttatgtacgatcgaccgctgagactcaatctcctggatctcgattatgagttagccgagcagctggataatattgccgagaaagcgtgttgtggcgtgccatgcaagtgtagcggccagagaggggacagagggccaatcgggtccattggccctaaggggatcccgggagaggatgggtacagggggtaccccggagacgaaggcggacctggagaacggggtccccctggcgtgaatggcacccaggggttccagggttgccctggccagcgtggagttaagggctcaaggggcttccccggagaaaagggggaagtgggtgagatcggtctggatggattggacggagaggatggggataagggtcttcccggaagctccggcgagaaaggaaaccccggaaggcgcggtgataagggaccaagaggcgagaaaggcgagaggggagacgtaggtattcggggagaccccggaaaccctggccaggattcccaggaaaggggacctaagggcgaaacaggagacctggggcctatgggcgtgcctggacgcgacggcgtacctgggggacctggcgaaaccggaaaaaacggagggtttggcagaagaggccctccaggtgctaagggaaataagggagggccagggcagcccggtttcgaaggggaacagggtacacgaggagctcagggacccgctggaccagcgggtcctcctggattgattggcgagcagggcatcagcgggcctcgaggtagcggcggagctgctggggcacctggggaacgcggaagaacaggaccactcggtagaaaaggggagcctggcgagcccggacccaagggtggtattggtaaccgaggaccacgaggcgagaccggcgacgacggtcgcgacggcgtgggcagcgaaggaaggcggggaaaaaagggcgaaagaggatttccaggctaccccggaccaaaagggaacccaggcgaacctggccttaatggaaccacaggaccgaagggaatccgtggccgtcggggtaatagcggccctcctggtatagtcggccaaaaaggggaccccggatatcctggcccagccggacccaagggcaaccggggtgactccatcgatcagtgcgccctaattcagagcattaaagataaatgtccgtgttgttatggcccacttgagtgtcctgtttttccaaccgagctggcttttgctctcgacacatccgaaggggttaaccaagatacctttggcagaatgcgggatgtcgtcctcagcattgtgaacgatctgacgattgccgagtccaattgcccacgtggcgctagggtcgcagttgtgacctacaacaacgaagtcactacggagatccgtttcgcagacagcaagcggaaaagcgtattactcgataaaattaaaaatctgcaggttgcactgacaagtaagcagcagtctttggagaccgccatgtcatttgttgctagaaataccttcaagagggtccggaacgggtttctgatgagaaaggtggccgtgttcttcagcaacactccgacgcgcgcatccccacaactgcgagaagccgtgctcaaactgagcgacgccggaattacccccctgtttctcacccggcaagaggaccgccaactcatcaacgcattgcagataaacaatacagcggtggggcatgcgctcgtgctgcccgcaggtcgggaccttacagatttccttgagaatgtgctgacctgccatgtgtgtctggacatatgcaatattgacccgtcttgtggtttcggtagctggcggcctagcttccgggatagacgggctgctggatccgacgtcgacattgacatggcctttattctcgattctgccgagaccacaacattgttccagtttaacgagatgaagaagtacatcgcttacctggtgcggcagctggatatgtctcctgacccgaaggcaagtcagcacttcgctagggtagctgtcgtgcagcatgccccttcggaatccgtcgacaacgcatcaatgcctcctgtgaaagttgagttttcactgaccgactatggatccaaagagaagctggttgattttctcagtcgtggcatgacacagctgcagggtacacgggctcttggaagcgctatcgagtacaccatcgaaaacgtgttcgagagcgcaccgaacccacgggatcttaaaatagtagtgctaatgctgacaggagaagtcccggaacaacagcttgaggaggctcagcgagtgattctacaggctaaatgcaaaggttacttttttgttgttctcgggattggacggaaagtgaacatcaaggaggtttatactttcgccagcgagcccaatgacgtgttctttaagcttgtcgataaaagcaccgagctgaatgaggaaccattgatgagattcgggagactgctccctagtttcgtgagcagcgagaatgccttttacctatccccagacatccggaagcaatgcgactggttccagggagatcagcctaccaaaaatttggtcaagtttggccacaaacaggtgaacgtaccaaataatgtgaccagctcacccacatcaaatcccgtgaccacaacgaaaccggtgaccacaaccaagcccgtaaccacaacaacaaagccagtcacaaccactaccaaaccagtgacaataatcaatcagccatccgtaaagccggctgcggctaaacctgcacctgctaagcccgtggccgctaagcctgtggccactaaaatggccactgtcagaccacccgtggccgtgaagccggctaccgccgcaaagcccgttgccgcaaagcctgccgctgtgaggcccccagctgccgcagctgcaaaacccgtcgcaaccaagcctgaagtgcccaggccgcaggcagccaagccagccgctacaaagccagccacaactaaaccaatggtgaaaatgtcaagagaagtccaggtgttcgagattaccgagaactctgctaaactgcactgggaaagggctgagccaccagggccatacttctacgacctgactgtcacctcagcccacgaccaatctctggtgctgaagcagaatcttacagttacagacagggtgatcggcggtcttctagcagggcagacctaccacgttgcagtagtctgttatctgcgaagccaggtgcgagcaacatatcatggaagcttttccaccaaaaaatcacagccgccacctcctcagccagcgcgaagcgcttcctcctctactatcaatcttatggtctccacagagcccctcgccctgactgaaaccgacatctgcaagctgcctaaagatgagggcacttgtcgggactttattctgaagtggtactatgacccgaatacaaagagctgcgccagattttggtatggcggttgcgggggtaatgagaacaagtttggctctcagaaggaatgtgaaaaggtttgtgcgcctgtgttggccaagcctggcgttatcagcgtgatgggcacctat

SEQ ID NO: 4698 - DNA, 8916 bp, Artificial Sequence
  Description of Artificial Sequence: Synthetic coding sequence
atgaggaaacacagacatctaccactcgtggcggtcttttgcctgttcctctctggctttcctactacccatgcccaacagcaacaagccgctcaggacagtgccgatattatcttccttattgacggcagcaataataccgggtccgtaaactttgccgtgatcttggacttcttggtgaacctgttggagaaacttcctattgggacccagcagattcgggtaggcgtggtccaattctcagatgagcccagaacaatgttttctttagatacatattctacaaaggctcaggtcctcggtgctgtgaaggctctcggattcgctgggggtgaactcgctaatatcgggctggcattagactttgtcgtggagaatcactttacccgggctggcggaagccgcgtcgaggaaggagttccacaagtgctggttctgattagtgctggtcctagcagtgacgaaatccggtatggtgtggttgccctcaagcaggcatctgtcttctcattcggcctgggcgctcaggcagcctctagggctgaactgcagcacatcgctactgatgataacctcgtgttcactgtcccggaattccggagcttcggagatcttcaagagaagttactgccgtatatcgtgggagtggctcagaggcacattgtgttgaaaccgccaaccatagtgactcaggtcatagaagtcaataagcgggatatagtctttctggtggatggatcctccgcccttggcctcgccaatttcaacgcaatccgggactttatcgctaaagtcatccagcgcttggaaatcgggcaggacctcattcaggtggctgtcgcgcagtatgcggatacagtgcggccagaattttacttcaatacgcacccaaccaaacgggaggtgatcacagccgtacgcaagatgaagccattggatggaagcgccttgtatacaggcagcgcacttgactttgttaggaataacctgtttacaagctcagccggatacagagctgcggaaggaattccaaaactgctcgtcctgatcacaggcggaaagtctttagatgaaattagccagcccgcacaggagcttaagagatcttctatcatggccttcgccattggaaataagggggcagaccaggcagagctggaggagatcgcttttgactcctcacttgtattcatcccggcagagtttcgcgctgcgcctcttcaaggcatgctgcctggtctgctggcacctctgcgaacgctgtcgggcactccagaggtgcattctaacaaaagggatatcatattcctgctagatggttcagcaaacgttgggaagacgaactttccatatgtcagggactttgttatgaatctggtcaactctctggacatcgggaatgacaatatccgtgtagggctggtgcagttttctgacactccggtgaccgagttcagtcttaatacttaccagaccaagagcgatattctgggtcacctgagacagcttcagcttcagggcggaagcggcctgaacactgggtcagccttgagctacgtgtatgctaatcactttaccgaggcaggcggatcacgcatacgagaacacgtgcctcaattgcttttgctgttgaccgccggacagagcgaggattcatacctacaggctgccaacgccctcactcgcgctggtatcctaaccttctgtgtgggtgcctcacaggcaaacaaagcagagctagaacaaatcgccttcaacccgagcttggtctaccttatggatgacttcagttccctgccagctctgccgcagcagttgatccaacctcttacaacatacgtctccgggggagtagaagaagttcctctggcacagcctgagagcaaaagagacattctgttcctgtttgacgggtccgccaaccttgtgggccaatttccggtcgtccgggatttcctgtataaaataatcgatgagctgaacgtcaagccagaagggactcgaattgcagtggcccagtattcagatgatgtgaaggtagaatcacggtttgacgagcatcagagtaaaccggagatattgaatctcgttaaaaggatgaagattaagaccggcaaggcgctcaatctgggttacgctctggattatgcccaacggtacatctttgttaagtccgcaggctcgcgaatcgaggacggggtgttacaatttctggttctacttgtggctggacgttcttcagatagagtggacgggccagcctcaaacctgaaacagagcggggttgtgcccttcatttttcaggcaaagaacgcggatcctgccgaactcgaacagatcgtgctatcaccagcgttcattctggctgcagaaagtctgcccaagattggcgacctgcatccccaaattgtgaacttgcttaagagcgttcataatggagctcccgcacctgtcagcggcgaaaaggacgtcgtcttcctactagacggaagtgaaggcgtccgtagcgggtttcccctgctgaaggaatttgtccaacgcgtggtggaatctctcgacgtcggtcaggatcgtgtgagggtcgccgtggttcagtactctgatcgtacccgccctgagttttacctgaactcatacatgaataaacaggatgtggtgaacgccgtcagacagttgactctccttggcggacccactccaaacactggagccgctttggagttcgtcttaagaaacatcctcgtgagctctgccggaagtcgcatcactgagggtgtaccccagctcctcattgttctgaccgcagacagaagtggagacgacgtacgcaacccatccgtggtggtgaagaggggtggtgcggtgccgattggtatcggaatcggtaatgctgatattacagagatgcagactatttcattcattccagactttgccgtggctattcctaccttccgacagctaggaactgtgcaacaggtcatttccgagcgggtgacacagctcactcgtgaggaactttccagactgcaaccagtcctgcagcccttgccatcccccggagtagggggaaaacgtgacgttgtgttcctgatcgacggctcccagtccgcgggacccgaatttcaatacgtccgcacacttatcgaacgtctagtcgactacttggacgtcggattcgatacaacaagagtcgccgtgatccaattctccgacgaccccaaggttgaattcttgctcaatgcacactcctctaaggatgaagtgcagaatgcagtgcagcgtttgagaccaaagggcggacggcaaataaacgttggaaatgcactggagtacgtcagcagaaatattttcaagcgtcccttgggcagccgcattgaggagggtgtgccccagttcctggtgctgatcagctcaggtaaatctgacgatgaagttgatgaccccgcagtcgaactgaaacagttcggcgtggcgccttttactatcgccagaaatgccgaccaggaagaactggtgaaaatcagtctcagtcccgaatacgttttcagtgtgagcacatttcgggagttgcctagcttagagcagaagttgctgacacccattacaacattgacctcagaacaaattcagaaactccttgccagtactcgctacccccctccggctgttgaatcagacgccgcagatattgtgttcttgatcgattccagcgaaggagtgaggccagatggattcgctcatatccgcgacttcgttagccgaattgtgcgcaggctaaacattggccctagcaaagtcagagtgggagtggtgcagtttagtaatgatgtcttcccggaattttacctcaaaacctacaggagccaggcacccgtgttggacgctattcgtaggttgcgtctacgcggaggctctccccttaacactggtaaggccctggagtttgtggccagaaatcttttcgtgaagtccgccggatctagaattgaagacggggtgccccagcacctagtactagtgttggggggaaagtctcaggatgacgtgagccgttttgctcaggttatccgttcttccggaatcgtttcactaggcgtgggagacagaaatatcgaccgcaccgagctgcagaccatcactaacgacccccgtttggtcttcactgtacgcgagttccgcgaactgccaaacattgaggaaagaattatgaattcatttggccctagtgccgctacccctgcccctccgggagttgacacccctcctcctagcaggcctgagaaaaagaaggcagatatcgtcttcttactggacgggagcatcaatttccggagggatagctttcaggaggtgctaagatttgtcagcgagatcgttgatacagtttatgaagatggcgattctatccaggttggtctggttcagtacaacagcgatccgacagatgaatttttccttaaggacttcagcacaaagcgccagataatagatgccatcaacaaagtcgtctacaaggggggaagacatgccaataccaaggtaggacttgagcacttgcgtgtgaatcactttgtgcccgaggccggttcccgcctggaccagcgggtcccccaaatcgcctttgttataaccggaggcaaatccgtagaagacgcccaagatgtgtccctggcactgacacaaaggggggtcaaggtttttgccgtcggcgttcgaaatatcgattctgaggaggtgggaaagatcgcatctaactccgcaaccgcatttagagtgggaaacgttcaggagcttagcgagctgtctgagcaggtactcgaaacactccatgacgctatgcatgaaacattatgccctggggtgactgatgccgctaaggcatgtaacctggacgtgatccttggctttgatgggtccagggaccagaacgtctttgtggcgcaaaagggctttgaaagcaaggtagacgctatcctgaaccggataagccagatgcacagggtttcctgtagtggagggcgtagccctactgtaagggtctctgttgttgcaaacacccccagcggcccagtagaggccttcgacttcgatgaataccagcccgagatgctagaaaagttccgaaatatgcgctcacagcacccttacgttctgacagaggatacactaaaagtgtaccttaataagttccgacagtctagtcccgatagtgtaaaggtggtcatccacttcaccgacggggctgacggggatctggcggacctgcacagggccagcgagaacctcagacaggagggcgttagagcactgatcctggtgggactcgagcgcgtggtcaatctagaacgactgatgcacctcgagttcggtcgagggttcatgtatgaccgcccactccgcctcaaccttctggaccttgactatgaactggcagagcaactggataacatcgctgagaaggcttgctgcggagtcccatgcaagtgctcgggtcagaggggggacaggggaccaatcggctccatcggccctaagggaattcccggtgaggatggttatcgagggtaccctggcgacgaagggggacccggagaaaggggcccaccgggtgtgaacggcactcaggggttccaaggttgtcctggccaaaggggtgtgaagggttcgcgaggattcccgggtgagaagggagaggtgggtgaaattgggctcgacgggctggatggagaggatggggacaagggccttcctggatcttctggagagaaggggaaccctggtaggcggggagataagggaccgagaggagagaagggtgagcgcggtgacgtaggaatccggggagacccagggaaccccggacaggatagccaggaacggggtcccaaaggcgaaacgggtgacctgggcccaatgggggtcccgggacgggatggagtaccgggtggcccaggcgagacagggaagaacggaggcttcggcaggagaggaccacccggagccaaggggaataaaggcggacctggacagccaggtttcgagggtgaacagggcactcggggtgcgcaaggacccgctggtccagccggtccacccggattgatcggggaacagggcatatccggtccccgagggagcggtggagcagcaggcgctcctggcgagagagggagaacgggaccattggggagaaagggggaaccaggcgagccaggaccgaaaggcggaattggcaacaggggccctaggggagaaacaggcgacgacgggcgagatggtgtgggttcggaaggacgcagaggaaagaaaggagagcgagggttccccggttatccgggaccaaaaggaaaccccggagaacccggactcaatgggacgaccggccctaaaggcatccgcggacgtagagggaatagcggtcctccgggtatcgttggacaaaagggagatccagggtatcctgggcctgcaggtccaaagggaaatcggggtgacagtattgatcaatgcgctctgatccagagtattaaagacaagtgtccctgttgctacggcccacttgaatgcccggtgtttcctacagagctggctttcgccctcgatacatcagaaggggtgaatcaagacacattcggcaggatgcgggatgttgtgctttcaatcgtgaatgacctgacaatcgcagagtccaactgtcctagaggagccagagttgccgtcgtgacctataataacgaggtcacaacagaaatccggttcgctgacagcaagcgcaaatccgtattactggataagatcaagaacctgcaggtcgcactgacatctaagcagcagagcctggagactgccatgagttttgtcgcacggaatacattcaagcgggtgcggaacggatttttaatgaggaaagtagccgtcttcttctctaataccccaactcgcgcatcgccccagttgagagaagccgtgttgaagctttctgatgccggaatcactccgctgttcctaaccaggcaggaagataggcagctgattaacgcccttcagatcaacaatactgccgtcgggcatgccctggtgctgcctgccggaagagacctgactgactttctggagaacgtgttgacgtgccatgtgtgcctggatatctgtaacattgaccctagctgtggctttggcagctggaggcccagtttccgggacagacgcgcagcaggctcagacgttgatatcgatatggcgttcattttagactctgctgagacaactactcttttccagtttaatgagatgaaaaaatacatagcctatttagtccggcagttggacatgtcccctgaccccaaggcgagccagcattttgctagagttgcggtggtccagcatgcgcctagcgagagcgtcgacaacgccagcatgccccctgtcaaagtagagttttctcttactgactacggaagcaaggagaagctcgtggattttctgtcaagaggaatgacccagctgcagggcactagggctctgggctccgctattgaatacactatcgaaaacgtgttcgagtctgccccaaaccctagagatctaaaaattgtcgtgctgatgttgacaggagaagtgcccgagcagcagctcgaggaagcccaaagggtaattctccaggccaaatgtaaggggtatttttttgtcgtgctgggtataggtagaaaggttaacattaaggaggtctacacctttgccagcgagccaaacgacgtcttttttaagctggttgataaaagtaccgaactgaatgaagaaccactgatgcggttcggtcgattgcttccttccttcgtcagctctgaaaatgccttctatctgagcccagatattcgcaaacagtgcgactggttccagggagaccaacccacaaaaaacttggtcaagtttggtcataagcaggtaaacgtaccgaataatgtaacttcatcgccaacttcaaacccggtgaccactacaaaaccggtgacgaccacgaaacctgttacaacgacgactaaacccgtgacaaccacaactaagcctgtgacaattattaatcagccttcagtgaaaccagccgctgctaagccggcaccagccaagccagtcgcagccaaacccgtggcaaccaaaatggctactgtccggcctcctgtcgcggtaaaaccggcaactgcggctaagccagtggccgcaaaaccagccgctgtccgaccacccgctgcagccgctgccaagccagtcgccacgaaacctgaggtcccacgcccacaggcagcaaagccagcggctaccaaacctgccactacaaaacccatggtaaaaatgtctcgcgaagtgcaggtgtttgaaataaccgagaactccgctaaattgcattgggagcgagcagaaccccctggaccatacttctacgacctgacggtcactagtgctcatgatcaatcccttgttctgaagcagaacctgacagttacagatagggtcattgggggtctgctagctggacagacataccacgtggctgtggtgtgttacctgagaagccaggtgagggcgacataccatggctcgttttctactaagaagtctcagccccctcctccccagcccgcacgtagtgcctcaagcagcaccattaaccttatggtaagcaccgagccactggcgctgactgagacagacatttgtaagctgccgaaagacgagggcacctgcagagatttcatactgaaatggtattacgatcccaatacaaaatcttgtgcaagattctggtacgggggttgcggcggaaatgagaacaaatttggcagccagaaggaatgcgagaaggtgtgcgcaccagtactcgccaaacccggagtgatcagcgtgatgggcacatag

SEQ ID NO: 4699 - DNA, 3111 bp, Artificial Sequence
  Description of Artificial Sequence: Synthetic coding sequence
atgagaaagcataggcaccttccactggtagcggtattttgccttttccttagcgggtttcctacgacacacgctcagcagcagcaggccgttatcgaggtcaataaaagagatattgtgttcctcgtcgatggaagtagtgctcttggtttagcgaatttcaatgccattcgggacttcatcgcaaaggtcatccagagactcgagatagggcaagatctaattcaggtggcagtcgctcagtacgcagacacggttcgtcccgaattttactttaacacccaccccactaagcgtgaggtcatcacagccgtccgtaagatgaagccgttggatgggtcagccttgtacaccggctcagcactcgacttcgtgcgcaacaatctgttcactagctcagctggctaccgagccgctgagggtatacctaaactcttagtccttatcacaggagggaaaagcttggatgagatctctcaaccggctcaggaacttaagcgttcaagcattatggccttcgccatcggaaataaaggtgcagaccaagctgagctcgaggagatcgcattcgattctagcttggtcttcatcccggctgagttccgagccgctccccttcaagggatgttacctgggttgcttgcacctctgagaacactgagtggcacacctgaagtccacagcaacaaaagagacattatatttctgcttgacggatctgcaaacgtcgggaagaccaactttccatacgttcgagatttcgtcatgaatctcgtcaacagcctggatatcgggaacgataatatccgggttggactcgtgcagttttcagacacccctgtgactgaattttcccttaacacttatcagacaaagtctgacattctggggcatctgcggcagcttcagctccagggcggatcaggactgaatactggatccgctctgagctatgtttatgcaaatcatttcacagaggccggaggctcccggattagggaacatgtgccacagttactgttgctgctgactgctggccagtccgaggacagctatctccaggccgcaaatgctctcacccgtgcgggtatacttactttctgcgttggcgctagccaggccaataaggccgagttggaacagatcgcctttaatccatctctcgtatatctgatggacgacttttcctctcttccagccctgccacagcaactgattcaacccttgacaacatacgtttcgggcggtgtcgaggaggtgcccttagcacagcctgaatcaaaaagggatattctgttcctctttgacgggagcgctaacctggtaggacagttccctgtggtccgggactttctttataaaatcatagacgaactcaatgtcaagccagagggaacccggattgccgtcgctcagtactccgatgacgtaaaggtggaatcccggttcgatgagcaccaaagcaaaccagagatcctaaacttagtaaagcggatgaagatcaaaacgggtaaggctctgaacctgggctacgccctggactacgctcagaggtatatctttgtgaagagtgctgggtctcgcatcgaagacggtgtgcttcaattcctggtcctgctggtggctggacgaagctccgatcgggtggatggtcctgcttctaatttgaaacagtctggtgttgttccctttatcttccaagccaagaacgcagacccagccgaactggaacaaatcgtgctgtctcctgccttcatcttggctgccgagtctctgcccaaaatcggggacctgcatccacagattgttaatctgcttaagagtgtgcataatggagccccagcacctgttagtggcgagaaggacgtcgtgttcttactggacggcagcgaaggagtacgcagtgggttcccactcctgaaggagttcgtacagcgggttgtcgagtcactggatgtgggccaggatagagttcgggtggccgtggtacaatatagtgacaggactcggccagaattttatctaaacagctatatgaacaagcaggatgtggttaatgccgtgcgacagctgacactactcggcggtccgaccccgaatacaggtgctgctttggagttcgtcttgcgaaacatcctggttagctctgccggtagccgcattaccgaaggtgtccctcaactgttgatcgtcttgaccgcagaccggtctggtgacgatgtacgcaatcccagcgtcgtcgtgaagaggggaggcgcagtgccaattggaatcgggattggaaatgcagacattacggagatgcagaccattagcttcatccccgattttgctgtagccattcctacattcagacagctcgggactgtgcaacaggtgatctcagagagggtgacacagcttacacgcgaggaactgtctagactgcaacctgtgctgcagcccctaccgagcccaggcgtaggcggtaagcgtgatgtcgtattcctgatcgacggttcacaatctgcgggtcctgaatttcaatacgttaggactctcatagaacgccttgttgactacctggacgtgggattcgacaccacgagagtcgcggtaatacagttctccgatgatcctaaggtggaatttctcttaaacgctcattcctccaaagatgaggtccaaaacgccgtccaacggctgcgccctaaagggggtcggcagatcaacgtgggaaacgccctcgaatatgtatcgaggaatatatttaaacgaccgctaggaagtaggattgaggaaggagtcccccaatttctcgtgttaatcagctcaggcaagagtgacgacgaggtggatgatcccgctgtcgagctgaagcagtttggagtggctccctttacaattgccagaaacgccgaccaagaggagctggtcaaaattagcctgtctcctgagtatgtatttagtgtctctacattccgggagctcccatctctggagcagaagctccttacccccataacaacgctcacctccgagcagatacagaagctgctggcctctacgagatacccccctccaggcgagatgggtgcgagtgaagtgctgctgggcgcatttagtatatag

SEQ ID NO: 4700 - DNA, 8916 bp, Artificial Sequence
  Description of Artificial Sequence: Synthetic coding sequence
atgcgtaagcaccgacatctgcccctggtggctgttttttgtctgttcttgtctggtttccctactactcatgcacagcagcagcaggccgcacaggatagtgccgacataatttttctaatcgacggctctaataatactgggtctgtgaattttgccgtaatccttgatttcttggtcaacctcctagagaagctgccgatcgggacccagcaaatcagagtgggcgtcgtgcagtttagcgacgagccacgtacgatgttctccctggacacttacagcacaaaggcgcaggtgctgggtgcagtgaaggccctgggattcgcgggaggtgaactggctaatatcggattagctctggactttgtcgtggaaaatcattttacccgagctgggggaagcagggttgaagaaggagttcctcaggtgctcgtgttaatcagtgcagggccttcatcggatgagattcgttatggtgttgtggccctaaaacaggcctcagtcttttccttcggtctgggagctcaggccgcatctagggctgaactgcagcacattgctactgatgataacctagtattcactgtgccagaattccgatcgtttggtgacctccaggaaaagctgttgccatacatcgtaggcgtcgcccagcggcacatcgtgttaaagcctcccacgatcgtgactcaggtaatcgaagtgaacaagagggatattgtatttttggtggatggttcttctgcactggggcttgctaacttcaatgccatcagggattttattgcaaaggttatccagcgactggagatcggacaagacttaatccaagtggccgtggcacagtacgccgacaccgtgaggcctgaattctacttcaacacacacccaactaagagggaggtgattactgccgtgcgaaaaatgaagccactggacggttctgcactgtataccggcagtgcattggacttcgtccgaaacaatctcttcaccagttccgccggataccgcgctgcagaaggcattccaaagctgctggtcctgattaccggcggtaaatcgctcgacgaaatctcccagccggctcaagagcttaagcgatcatcaatcatggctttcgcaattgggaataagggagccgatcaggcagaactggaggagatagcattcgacagtagcctggtcttcattcccgcagaatttagggctgctcccctgcagggaatgctcccagggctccttgccccacttcgaaccctttcaggcacgccagaggtgcattccaataaacgagacattatttttttgctcgatgggagcgcaaatgtgggaaagactaactttccatatgttcgtgacttcgtgatgaatctggtgaactcactcgacattggcaatgataacatacgagtgggcctggtgcaattcagtgacaccccagtaacagagttctcactgaatacctatcagactaagagtgacatactaggccacttaaggcagttacaactgcagggtggttccggactcaacaccggatccgccctgtcctacgtgtatgccaatcatttcaccgaggctggaggaagtcggattagagaacatgtccctcaacttctcttgctgctcaccgcgggacaatccgaagatagctatctgcaggctgccaacgccttaacccgagctggaatactgaccttttgcgttggagcaagccaggcaaacaaggccgagttagagcagatcgcctttaatccgagtctggtgtatctgatggatgatttcagttccttgcccgcactgccgcagcagttaattcagcccctcaccacatatgtgagcggaggtgtagaagaggttcccctcgctcaaccagaatctaagcgggacattctctttctttttgacggatcagcaaacctcgtcggacagttccccgtcgttcgagattttctgtataaaattatcgatgaactaaacgttaagcccgaggggactaggatcgccgtagcacagtacagcgacgacgtgaaagtcgagtccagatttgatgagcaccaatcaaagccggagatcctgaatctggtcaagcggatgaaaattaaaaccggcaaagccctgaatcttggttatgcgctggactatgcacaacggtacatctttgtcaagagtgctggaagcaggattgaggacggcgtgctgcaatttttggtcctgctggtggcaggacggtccagcgaccgggtagacggccctgcctctaatctaaagcagagtggagtggtgcccttcattttccaggcaaagaacgctgatcccgctgagcttgaacagattgttctctcgccagcattcattctcgccgctgaatcactgcctaaaattggtgatctgcacccccaaatcgtcaacctattaaagtcagtacacaatggagctcctgcccctgttagcggcgagaaggatgtggtgtttctgctcgacggatccgaaggggtaaggtccggattcccactgcttaaagagttcgtgcagcgcgtcgtggaaagcctcgatgtgggccaggatagggttagagtggctgtggtccagtatagcgatcgcaccaggcctgagttctacctgaattcctatatgaacaagcaggatgtggtgaacgctgtcaggcagctcactttactggggggaccgaccccgaataccggagctgctctagaattcgtattgcgcaacatcttagtgagttcagcaggctcccgcatcacagaaggggtcccccagttgttaatcgtcctgacagcagatagaagtggtgacgacgtgcggaatcctagcgtggtggtgaaaaggggaggcgctgtacccattgggattggtataggaaacgccgatatcaccgaaatgcagactattagttttatccccgatttcgccgtcgctatacctactttcagacagctgggaactgtccagcaggtgatctcagagcgggttacacaactcacgcgcgaggagctgagcagactccagccagtgttacaacctctgccttcgcctggcgtcgggggaaagagggatgtagtttttctcatagacgggtcgcaatctgccggacccgagtttcaatacgtccgaacgctgatagagcgcctggtagattatcttgacgtaggattcgacactacccgggtggctgtgattcaattttccgatgatccgaaggttgagttcctcctgaacgcccactcctccaaagatgaagtccaaaatgctgtgcagaggctgcggccaaaagggggaaggcagatcaatgttgggaatgccctcgagtatgtgagtagaaacatcttcaaaagacctctggggtcacgcatcgaagagggcgtccctcagtttcttgtgctgatcagcagcggaaagagcgacgacgaagtggacgatccagccgtcgagcttaagcagttcggggtggccccatttaccattgcccgtaatgccgaccaggaggagctagttaagatctctctttctccagagtatgtgttcagcgttagtactttcagggagttgccatctctggagcaaaaactgctaacaccaatcacaactttgacctccgagcagatacagaagcttctagcgtctacccgttatcccccacccgctgtggaatctgatgcagccgacatcgtgtttttaattgacagcagtgagggagtacgacctgatgggtttgcccacatccgtgatttcgtatcccggatcgtgaggcgccttaatattggcccatcaaaggtgcgggtgggggtggtccagttttcaaacgatgtgttcccagaattctacctgaaaacctataggagtcaggcacccgtcctggacgctattaggaggcttaggctgcgaggcggatctcccttgaacacggggaaagctctcgaatttgtcgcacggaatctgttcgttaagagcgcaggttcacggattgaagatggagtgccccagcacttggtcctggttttggggggtaagagtcaagacgacgtgagcaggtttgcccaagtgatccggtcctcaggcatcgtgtccctgggggtgggcgacagaaatatcgaccgaactgaacttcagacaataaccaacgatccgcgacttgtgtttaccgtccgcgagtttagggagttgcccaatatcgaagagagaatcatgaatagttttggccctagcgccgctaccccggctcctccaggcgtggatacacctcctccttctcgccctgaaaagaaaaaggcggacatagtgttcctgttggatggaagtatcaacttcagaagggacagcttccaggaagtcttacggtttgtttccgagattgtggataccgtgtacgaagatggcgattcgatacaagttggacttgtccagtataactctgacccaactgatgagtttttcctgaaggatttctccacaaaaagacaaatcatcgacgctatcaacaaggtagtgtataagggaggccgacatgccaacacaaaggtgggcctcgagcacctccgcgtcaaccattttgtgccggaggcaggttcccggctcgatcagcgggtaccacagattgcatttgtgataactggtggaaaatcagttgaggacgcccaggacgttagcctcgcccttactcagaggggagtgaaagtctttgccgtcggggtccggaacatagattcagaggaagtaggcaagattgcaagcaactccgccacggccttccgggtggggaacgttcaggaactgagtgagctgtctgaacaggttttggaaaccttgcacgacgctatgcacgaaactctctgcccgggagtaaccgacgctgcaaaggcctgtaacctggatgttatacttggcttcgacggctcacgtgatcaaaatgtgtttgtggcccagaagggattcgaaagcaaagtagatgcaattctaaatagaatttctcagatgcacagagtgtcatgtagcgggggaaggtcacccactgtgcgagtgagcgtcgtggctaatactccttccggacctgttgaggcattcgatttcgatgaataccagcctgagatgctcgaaaagttcaggaacatgcgctctcagcacccctatgttttgacggaggatactttgaaagtctacctaaataagtttcggcagtcctcgccagatagcgtgaaggtggtgatccactttacggacggagccgacggcgacctcgccgatttacatcgggcaagcgagaacctcagacaggaaggggtcagagcgctaatcctggtgggcctcgagcgcgtggtcaatttagagcgcctgatgcacctcgagttcggacgaggatttatgtacgaccggcctctccgactgaatctgttagaccttgattacgaactagccgaacagctggacaacatagccgagaaagcttgctgcggggtaccatgcaaatgcagtgggcagcgcggtgatcgcggacccatcggttcaatcggcccaaagggcattcccggagaggatgggtatagaggctacccgggagacgaaggtggaccaggcgaacgaggtcctcccggagtaaacggcactcagggattccaaggatgccccggacaacgaggcgttaaaggcagcaggggcttccctggggagaagggtgaagtcggagaaattggtctggatggcctcgacggcgaggacggggataaggggctgcctggctccagcggtgagaaggggaatcccggtcgcaggggggacaagggacctcgcggtgaaaagggcgagagaggagacgttggtatcagaggcgatcccggtaaccccggacaggatagtcaggagcgcggtcctaagggcgagactggagacctgggcccaatgggggttcccggtagggacggcgtgcccggagggccaggggagactggcaagaatgggggtttcggtaggcgcggacctcccggagcgaaggggaataaaggagggcctgggcagccgggttttgagggagaacaggggacgagaggtgctcagggtccagccggtccagccggtcctccaggcctgataggggagcagggcatatctggtcccagggggtcaggtggtgctgcaggtgccccaggggagagggggagaaccggccctttgggcaggaagggagagccaggtgaacctggacctaaagggggtatcggaaacagaggtccccgtggagaaaccggggacgacggacgcgacggggtggggtctgagggtaggcgcggtaaaaagggcgagcgcggattcccgggttaccctggaccaaaaggcaaccctggagaacctggtctgaatggtaccaccggacccaaggggatacggggacgtaggggaaatagtggccctcccggaatcgttggacagaagggggatcccggttaccctggtcctgctgggccaaaagggaataggggagactctattgatcaatgcgctctgattcagtccataaaagacaaatgcccgtgctgctacgggccacttgaatgtccggtgtttcccaccgagttggcctttgcacttgataccagcgaaggagtcaaccaagatactttcggacgtatgcgcgatgttgtgttgagcatcgtgaacgatctaaccatcgccgagtccaactgccccaggggggcacgggtggccgtagtgacctataataacgaagtgaccaccgagatccggttcgctgacagcaaacgtaaaagcgttcttttagacaagatcaagaacctgcaagttgccctgacaagtaagcagcagtccttggagactgctatgagttttgtggctcgcaacacatttaaacgagtgcggaatgggttcttaatgaggaaggtggccgtgttttttagcaacacccccacccgcgctagcccccagctaagagaagctgtgttgaagctgtccgatgccggaattacacccctgtttctcacacgacaggaggatcgccaattaatcaatgcattgcaaataaacaacacagccgtgggccatgcactggtcctgccagccggacgggatctgacggacttcttggagaacgttctgacgtgtcatgtttgtctcgatatctgcaacatcgatccctcgtgtggctttggcagctggcgtccgtctttccgtgaccgtcgggcagccggttctgatgtggacattgatatggcattcatcctggattcagcagagacgaccactctgtttcagtttaatgaaatgaagaagtatatcgcatatctcgtgagacaactggatatgtctccagaccccaaagcctcgcaacactttgccagagtcgctgtagtccaacacgctccctcagaaagtgtagacaatgcctcaatgccaccagttaaagtggaattttccttgactgattatggctcaaaggaaaagttggttgatttcctgagccgtgggatgacccagctgcagggcactcgtgcgcttggctctgcaatagagtatacaatagagaatgtgtttgaaagcgcacccaacccgagggatttgaaaatcgtcgtgcttatgctaaccggagaggtaccagagcaacagctggaagaggcccagcgagtgatacttcaggctaaatgcaagggttatttcttcgttgtcctgggtattggtagaaaagtgaatattaaagaagtttacaccttcgcctccgagccaaatgatgtcttctttaaactggtcgataagtcaaccgaactgaatgaagagcctctaatgcgtttcggacgcttgttaccatcattcgtgagctccgagaatgcgttttatctttcccccgacattcgaaaacagtgcgactggtttcaaggggatcagcctacaaaaaacttggttaaattcgggcacaagcaagttaatgttcctaataacgtcaccagttcccccacttctaatcccgttactaccactaaaccagtcactactactaagccagttactactaccaccaaaccagtgacgactacaaccaagcctgtcacaattattaatcaaccttcagttaaacccgctgccgctaagcctgcacctgcaaagcccgtggctgctaagcccgtagctaccaaaatggccaccgtcaggcccccagttgcggttaagcccgctaccgccgcaaagccagtcgccgctaagccggcagctgtgcgcccacccgctgcagccgctgctaagcctgtcgccaccaagcccgaggtgcctaggcctcaagcagccaagcctgctgccactaagccggctacgactaagcccatggtgaagatgtcgagggaggttcaagtcttcgaaatcacagaaaattctgcaaagctccactgggaaagggccgagcccccaggaccctacttttacgacctgaccgtgacctccgcccacgaccagtctttggttctcaaacagaatttgacagtaacagacagagtcattggagggctgttggccggtcagacataccatgtcgctgtggtatgctacctcagatcacaggttagggctacatatcacggatcatttagcaccaagaaatcccagccgcctcctcctcagcctgccaggagtgccagcagctctacaattaacctgatggtttctaccgagcccctggccctcacagaaacagacatttgcaaattacccaaggacgagggcacctgcagggactttattttaaagtggtattacgatccaaatacaaaatcttgtgctcgcttctggtacggtggttgtgggggtaacgagaacaaatttggatcccagaaagagtgcgagaaagtatgcgccccagtcctcgccaaaccaggcgtcatatcagtgatgggtacctat

SEQ ID NO: 4701 - DNA, 7847 bp, Artificial Sequence
  Description of Artificial Sequence: Synthetic coding sequence
atgaagatcctgctgataattttcgtgctgattatttggacagaaacactggcagaccagagccctggacctggcccagtgtacgcagacgtcgtctttctggtggacagcagcgaccatttgggcccaaaatcttttccctttgtaaagacctttatcaacaaaatgattaattccctgcccatcgaagccaataagtacagagtggcactagcccagtacagtgacgaatttcacagtgagttccacctttccacattcaagggccgatcacccatgttgaaccacctcaaaaaaaacttccagttcattggtggaagcctacagatcggcaaggcccttcaggaggcccaccgaacatacttttctgcaccaattaatgggcgtgatagaaaacagttccctcctatcctggttgttttggcaagcgctgaatcagaggacgaggtagaggaggctagcaaggcactccagaaagatggggtgaagatcatctctgtcggggtacagaaagcaagcgaagagaacttgaaggcgatggccaccagccacttccactttaatctgaggactattagggacctgagcacattctcccagaacatgacccagataattaaagacgtcaccaaatataaggagggagcagttgacgcagacatgcaggtgcactttccgatctcatgccagaaggattccttggctgacttggtctttttggtggatgaatcactgggtaccgggggaaatctgcgccacctgcagactttcttggaaaatataacatctagcatggatgtaaaagagaattgcatgaggctgggactgatgtcatacagcaacagtgccaaaacgatcagtttccttaagtcatcaactacccagagcgaattccaacaacagattaagaatctctctattcaggtggggaaatcaaacaccggggcagccattgaccagatgagacgggacggcttcagtgagtcctacgggtctaggcgggctcagggcgtccctcagatagctgttctggtcacccaccgcccatcagacgacgaagtgcatgacgccgcactcaatttacgcctcgaagacgttaacgtgtttgccctcagcatccagggagctaacaatacacagctggaggagatcgtctcatacccacctgagcagactatcagtaccttgaagagctatgccgatctggagacatacagcacgaagtttttgaaaaaactccagaacgaaatctggtcacagatctctacctacgctgagcagcggaacctcgacaagactggttgcgtagatacaaaagaggcggatatacattttttgattgatggcagtagtagcattcaggaaaaacaatttgagcagattaagcgatttatgctggaggtcacggagatgttctcaatcgggccagacaaggtgcgggtgggagttgttcagtactcagatgacaccgaagtggaattttacattaccgactattccaatgacatcgacttgcgcaaagccatatttaatattaagcagctgactggtggaacatacaccggtaaagctctggactacattttgcaaatcataaaaaacgggatgaaggaccggatgagcaaggttccctgttatctgatagttcttacagacggtatgagtacagatcgagtggtggaacctgcgaaacgcctgagggcggagcagataactgtgcacgcagtaggtatcggcgctgctaacaaaattgaattgcaagaaatagccggtaaggaagagcgcgtttcttttggccagaatttcgacgccctaaagtctattaaaaacgaggtggtgcgagaaatctgtgctgaaaaaggttgtgaagacatgaaggccgatatcatgttcctggtcgattcctcgtggagcattggtaacgagaattttcgaaagatgaagatttttatgaaaaacctcctcacaaaaatacagatcggtgccgacaagacgcagatcggcgttgtgcagttttctgacaagacaaaagaagaattccaactcaacagatacttcacacagcaagagattagtgatgccatcgaccggatgagtctgattaatgagggaacactcacaggtaaggccttgaattttgtcggtcagtactttacacactcaaaaggtgcaagactgggcgctaagaagttcttaatactcattaccgatggcgtagcccaagatgatgtacgagaccccgctaggattctacggggtaaggacgttaccatctttagtgtgggcgtgtataatgccaatcgcagccaattggaggagatttcaggggatagctccctagtttttcacgtggagaacttcgatcatctgaaggcactggagagaaagctgatctttagggtatgcgctctccacgattgtaaaaggattacactgttggatgtcgtcttcgttctcgatcactctggctccattaagaagcaataccaggatcacatgattaatttgacaatccacttggtcaagaaagcagacgttggtcgcgaccgtgtgcaattcggagcactcaaatatagtgaccaaccaaacattcttttctatctcaacacctacagcaatcggtcagctataatcgaaaacctccgcaaaaggagggataccgggggtaatacttacactgccaaggccttgaaacatgccaatgccctgttcaccgaggagcacgggagccgcattaagcagaacgtgaaacagatgctgatcgtcatcactgacggagagtcacacgaccacgaccaacttaatgacacagcccttgagttacgcaacaaaggaattacgatttttgcagtgggagtggggaaggccaaccaaaaggaactcgagggaatggctgggaacaagaataataccatttacgttgacaacttcgacaagcttaaggatgtattcactcttgtccaagagcgaatgtgcactgaagccccagaggtgtgccacctccaagaagccgacgtgatttttctctgcgatggttcggatagagtgtccaattctgatttcgtcactatgaccacatttctttcagacctcatcgacaattttgacatccagtcacagagaatgaagataggcatggcgcagttcggcagcaattaccaaagcataattgagctgaaaaacagcctcaccaaaactcagtggaaaactcagatccaaaacgtttccaagtccgggggttttccacgcatcgactttgctctcaagaaagtgagcaacatgttcaatctccatgctggtgggagaagaaacgctggtgtaccacagactcttgtagtgattacatccggcgaccccagatacgacgttgctgacgccgtcaaaacccttaaggatctaggaatctgtgtacttgttttgggtatcggcgatgtgtataaggagcacctcttgcccatcaccgggaacagcgaaaagataattacgttccaagacttcgataagctgaaaaacgttgacgtcaagaaacggataattcgagagatctgccagtcctgcggcaaaactaactgctttatggacattgtcgtgggatttgacatttcaactcacgtgcagggacagcctctgtttcagggccaccctcaactggaatcctatctaccgggtattcttgaagacatcagctccattaagggtgtgtcatgcggagccggaacagaagcgcaagtgagtttggctttcaaggtcaacagcgaccaaggattccccgctaagtttcagatatatcagaaggcagtgtttgattccctcctgcaggtgaacgttagtggccctacccacctgaatgctcagttcctcagatctctgtgggacaccttcaaggataaaagcgcttcaaggggacaagttctgctgattttctctgatgggctccagagcgaaagcaatataatgctggaaaatcagtccgatcggcttcgggaagctgggttagacgcgcttttggtggttagtctgaatacgacagctcatcacgagttctcctcatttgaattcgggaagcggttcgactatagaacccaccttaccatcggcatgcgcgaactgggcaaaaagctgtcacagtacctggggaatatagctgaaagaacgtgctgctgcacgttctgcaaatgtcccggaatcccaggaccacacggaacgcgcggtctacaggcgatgaaaggaagccagggcctcaaagggtccaggggacacaggggcgaagatggcaacccaggggtgcgaggcgacactggtccccaaggtgataaggggatcgcgggatgtcctggggcatggggccagaagggcttaaaaggtttcagcgggccaaaagggggtcacggtgatgatgggattgatggactggacggcgaggagggatgccatgggtttcctggtataaagggggaaaaaggtgaccctggctctcaaggatctcccggaagccggggtgcccctggccagtatggcgaaaagggatttcccggtgatcctggcaatccaggccagaataataatattaagggccagaaaggttccaaaggggagcagggcaggcagggtaggtccggccagaagggtgtgcaaggaagtccatcaagcagaggatcgcgaggcagagaaggccagcgcggactcagaggagtgtccggcgagcctggtaatcccggtccaaccggcactctaggcgcagaaggcttgcaaggcccacagggctcccagggaaatccaggccgaaagggtgaaaagggatcccagggccagaaagggccacagggttctccagggctgatgggcgctaaaggctcaacaggaaggcccggtctgctggggaaaaaaggggagcctgggctgccaggggacctcggacccgtgggacagactggccagcggggtaggcagggggacagcggaatcccgggttacggacagatgggcaggaagggagttaaagggcctagaggtttcccaggcgatgccggacagaagggtgacattggtaaccctggcattccagggggtcctggcccaaagggcttccgtggactggcacttactgtgggactcaaaggggaggagggtagcagaggactgcctggacctcccggacagaggggaatcaaagggatggctgggcaaccagtgtactctcaatgtgaccttattagattcctccgtgagcattcactatgttcacttgagaaatgtcccgcttatcccactgagctggttttcgccttggataacagttacgatgtgacagaggagtccttcaataaaacacgtgacattatcacaagcattgtcaacgacctgaatatacgagaaaacaactgccccgtgggggcaagagtagccatggtctcttataattcgggcacctcctatctgattagatggtctgactataaccgcaagaagcagctcttacagcagctctctcaaattaaatatcaggataccacggagcctagagacgttgggaacgctatgcgcttcgtaacacggaacgtgttcaaaagaacctatgccggagccaatgtaagacgtgtggctgtgtttttctccaacggccaaacagcatccaggtcaagtattatcacagccacaatggaattctcggcacttgatatcagtccgacggtttttgccttcgatgagcgagttttcctggaggcctttggcttcgacaatacaggaacattccaggtcattccggttccacccaacggtgagaaccaaactctcgaaaggttaagacgctgtgctctttgttacgacaaatgttttccaaatgcttgcatcagagaagctttcttaccggaagatagttatatggatgtggtcttcctgatcgacaatagtcgaaacattgctaaggacgagtttaaagctgtaaaggctcttgtttcctccgtaattgacaattttaatatagcaagcgacccactgatctctgacagcggagatcgcatagcgctcctctcttactctccctgggaaagctccaggcggaagatggggacagtgaaaacagaatttgattttattacctacgataatcagctgctgatgaaaaaccacatacagaccagctttcaacagctgaacggtgaggccactatagggagggccctgctgtggacaaccgaaaacctctttcctgagactccctacttgcggaagcacaaggtcattttcgttgtgagcgccggtgagaattatgaaaggaaggaattcgttaagatgatggccctgcgtgccaagtgccaaggttacgtgattttcgttatttcactggggtccaccagaaaagatgacatggaggagcttgcctcctacccattggaccagcacctgatccaattaggaaggatccacaagccagacctgaactacattgcaaagttccttaagccttttctctactcagtgagacggggttttaaccagtaccctccaccgatgctggaggatgcatgccgcttgattaatctggggggagaaaatatacagaacgatggctttcagtttgtgacagaactgcaggaggattttctgggtgggaatggtttcatcggtcaggagcttaattccggacgggagtcaccttttgttaaaaccgaagacaacggttctgattatctcgtctatcttccatcacagatgtttgagccacagaagttaatgatcaattacgagaaagatcaaaaatcagctgaaatagcctccctcaccagtggccatgaaaattatggtcgaaaggaggagcctgatcatacctacgaaccaggtgacgttagccttcaggagtactacatggatgtggcattccttattgacgcttctcagagggtgggtagcgatgagtttaaggaggtaaaggcatttataacgtccgtgttagactatttccacattgctccaactccacttacttccacgttgggcgatcgagtggccgtattgagttactcccctcccggttatatgccaaacactgaggagtgccccgtgtatctagagtttgacttggtaacctacaatagtatccaccaaatgaagcaccatctgcaggatagccagcagctgaatggtgatgttttcatcggacacgccctccagtggaccatcgacaacgtgttcgtggggacccccaacctgcgcaagaataaagtgatctttgtgatctccgccggtgagaccaacagcctcgataaagacgttcttaggaacgtgtccctccgcgctaaatgccaggggtacagcatttttgtgttctctttcggaccgaagcataacgacaaggaactagaggagctggcctctcacccgctggatcatcacttggttcagctgggcagaacgcataaaccggactggaactacattatcaagttcgtgaagccattcgtgcacctaatcaggcgagccatcaataaatatcctacggaagacatgaaagccacctgcgtgaatatgacctctccaaatcctgagaatgggggaaccgaaaatacagtcctcctgctgccgggtatttacgagataaagacagaaaacggcgacctctttgatgaattcgacagccaagctcagcacctcttggtcctgggaaacaaccattcttccggctctgaaactgctaccgacctaatgcagaagctctatttactcttcagtaccgagaaactagccatgaaagataaagagaaggcccatttggaagagatctcagctctggtcgttgacaagcaacaggagaaggaggataaggagatggaggcaaccgacatcta

SEQ ID NO: 4702 - DNA, 7848 bp, Artificial Sequence
  Description of Artificial Sequence: Synthetic coding sequence
atgaagattctgctgatcatcttcgtcttaatcatctggactgaaacactggctgatcaaagcccagggccaggtccagtgtacgccgacgtggttttcctggttgattcttctgaccacctgggccctaaatccttccccttcgtgaaaacctttattaataaaatgatcaattccctccccatcgaggcaaataaatatagagtcgctttggcacaatatagcgatgagtttcattccgaattccacctgagtacttttaagggtcgctctcccatgctcaaccacctcaagaagaattttcagtttattggcggaagcctacagatcggcaaggctctgcaggaagcccatcgcacatatttctccgctcccatcaacggccgagatcgcaagcaattccctccgatcttggtggtcctcgctagcgccgagtctgaggacgaagtcgaggaagccagtaaggccctccagaaagacggagtcaagatcattagtgttggagtacaaaaggcaagtgaagagaaccttaaggccatggccaccagccacttccactttaacttaagaactatcagagatctctcaactttctctcagaatatgacccagattataaaggacgtgaccaagtacaaagaaggggctgttgacgcagacatgcaggttcattttccaatttcttgtcagaaggatagcctagccgatctcgtgttccttgtggacgagtctctgggcactgggggtaatctgaggcatctgcagacgtttttggagaacataaccagttcaatggatgtgaaagaaaattgcatgcgtctgggtctgatgagttacagcaattcagccaagaccatttctttcctcaaatccagtaccacacagagcgaattccagcagcagatcaaaaatctgtcaattcaggtcgggaaaagtaacactggagctgccattgaccagatgagacgtgacgggttctccgagtcgtacggctcccgaagggcacagggcgtcccccaaatagccgtcctcgtgacccacagaccctctgatgatgaggtgcacgacgccgcactgaatcttcggctagaggatgtgaacgtttttgccctttcaatccagggcgctaacaacacgcagcttgaagagatcgtgagttatcccccagagcagactataagcactctgaagtcttatgctgaccttgaaacctactcaaccaaatttctgaaaaaattgcaaaacgaaatatggagccagatttccacatacgctgagcagcgcaatctcgataaaaccgggtgcgtagacactaaggaagctgacatccacttcttgattgatggctcctcctctatccaggagaagcagtttgaacaaatcaaaagattcatgttggaagtaacggagatgttcagcatcggtccagataaggtccgggtgggagttgtccagtatagtgatgacacggaggtcgaattttacattaccgactattcgaatgatatcgatctacgaaaggcgatcttcaacattaagcagctaacaggcggaacgtacactgggaaagctctggactacattctgcaaattatcaagaacggcatgaaggatcgaatgagcaaagttccctgttacctcatcgtgttaactgacggaatgtccactgatcgagtcgtggaacctgccaaacggctgagagccgagcagataaccgttcacgcagtgggcatcggagccgcaaataagatagagctacaggagatcgccggaaaagaggagagggtctcctttggtcagaacttcgacgccttgaaaagcataaagaacgaggtggtgagggagatttgcgccgagaaaggttgtgaagacatgaaggccgacatcatgttcctggtggacagtagctggtcaataggtaacgagaattttagaaagatgaagatattcatgaagaatctcttaactaagatccagattggagcagataaaactcagataggggtggtacaattctccgataaaactaaagaggagttccagttgaataggtatttcacccagcaagagatcagcgatgcgatagaccgcatgagcttaatcaatgagggcaccctgacaggtaaagcccttaactttgtgggtcaatattttacacattcaaagggcgctcggttgggcgctaaaaagtttctaattttgatcaccgatggtgtggctcaggacgacgtgcgagacccagcaagaatcctcaggggcaaggatgtgacaattttctctgttggagtctataatgcaaataggtcccagttagaagagatctcaggagacagtagcttggttttccacgtggaaaacttcgatcacctcaaggccctcgaaaggaaactgatattccgtgtgtgtgctttacatgactgcaagcggatcacacttttggatgtggtgttcgtgctggaccactctggctccatcaagaagcagtaccaggatcatatgataaacctgactattcacttagtgaaaaaggcagatgtgggcagggatagggtacagtttggagctctcaaatactccgaccagcctaatattctgttctatctgaacacctatagcaacaggtcagcaattatcgagaacctgagaaaacgcagagatacagggggaaacacctacacagctaaagctctgaagcacgcaaacgcactgttcacagaggaacatggatctcggatcaaacaaaacgtcaagcagatgctaatagtcatcacagacggtgaaagtcacgatcatgaccagctgaacgataccgccttggaactgcgcaataagggtatcacaatattcgccgttggtgtggggaaagccaaccagaaagagctggaagggatggcaggaaataagaacaacactatctacgtggataattttgataaattgaaggacgtctttactttggtgcaagaacggatgtgcaccgaagctcctgaggtctgccatctgcaggaagctgacgtaatttttctctgcgacgggtccgaccgggtgtccaacagtgattttgttacaatgacaacctttttgagtgacctaatcgacaattttgacatccagagccaaaggatgaaaataggaatggcacagttcggaagcaactaccagtcaatcattgagcttaagaattcccttaccaagacccagtggaagacacaaattcagaacgttagtaagtctgggggattccccaggatcgactttgcactcaagaaagtctccaatatgtttaaccttcacgccggaggccgacggaacgcaggggttccacagaccctggtcgtcatcaccagtggtgacccaagatacgacgtcgctgatgctgtgaaaacgctcaaagacctgggcatctgtgtgttggtgctaggtattggtgacgtatataaagaacacctactgcctattaccgggaacagcgaaaaaataattacttttcaggactttgataagctgaagaacgtcgacgtgaaaaagcgaatcataagagaaatctgccaatcctgtggcaaaacaaattgcttcatggacatcgtcgttggcttcgacataagcacccacgttcaaggacagccactgttccagggtcatccacagctggaaagctacttacctggcatcttggaagatattagcagtatcaaaggggttagttgcggggcaggaacagaagcccaggtgagcctcgcctttaaggtgaatagcgatcagggtttcccggcaaaattccagatctatcagaaggctgtgttcgattccctcctgcaagtgaacgtatctgggcctacacatctgaatgctcagttcctccgatccttgtgggatacctttaaggacaagagcgcatctcgaggacaggtgcttcttatatttagcgacggccttcagtctgagtctaacattatgctggagaatcagagcgacagactccgtgaggccggattagacgcactactggtggttagcctaaataccaccgcccaccatgagttctcatcatttgagtttggaaaaagatttgactataggactcacctaaccatcggcatgagggagctcggcaaaaagctgagtcagtatctggggaatatcgctgaacgcacttgttgttgtaccttctgtaaatgcccagggatccctggaccacacggaaccagggggctccaagccatgaagggaagccagggccttaagggctctcggggtcatcgcggtgaggacggcaaccctggcgtgcggggagatactgggcctcagggtgataagggtattgcaggatgcccaggcgcatggggccagaagggccttaaggggttctccgggccaaagggagggcatggggacgacggtatcgacgggctggatggtgaggagggatgccatgggttcccaggaattaagggcgagaagggtgacccaggtagtcagggctctccgggttcccggggagctccgggacagtacggagagaaaggattcccgggagatcccggaaatcccggacagaacaataacattaagggacagaaagggagcaagggagagcaggggaggcagggccgttcaggacagaagggagtccagggatcaccttcatcaagaggctctcggggacgagaaggccagagaggtcttcgaggggtttccggagaacccggaaatcccggtccaacggggacccttggagccgagggattacagggaccgcagggatcacagggcaatccaggaagaaagggggagaaggggtcccagggtcaaaaggggccacaaggaagtcccggtctcatgggagcaaaaggttcaaccggcaggcctggcctcctgggaaaaaaaggggagcccggactccccggagatctggggcctgtcggacagacaggccaaagagggagacagggcgatagcgggatcccgggatatggtcagatggggaggaaaggggtgaagggacccagaggctttccaggagatgcaggccagaagggcgacatcggaaaccccggtatccccggaggcccaggccctaagggttttcgaggcttggctctgaccgtcggcttaaagggtgaggagggtagcaggggccttcccggtcctccaggccagaggggtattaagggcatggcgggacagcccgtgtactcacagtgcgacctgattcgcttcttgagggaacacagcccttgttggaaagagaagtgtccagcatatccaactgaactggtgttcgccctcgacaatagctatgatgtgaccgaggagtcattcaacaaaacccgtgatattattacctccattgttaatgatttgaatattagggagaataattgtcctgtcggagcccgtgtggccatggtctcatataactcaggcacatcatatctgatcaggtggtctgactataaccggaagaagcagcttttacagcaactttcccagatcaaatatcaagataccacagagccccgagacgttggcaatgcaatgaggttcgtgacgcgcaacgtgttcaaacggacatacgcaggagcaaacgtgagacgcgtcgctgtgttttttagcaacggccaaaccgcctctaggtctagcattatcactgccacaatggagttcagcgcactggatatctctcccactgtctttgcattcgatgaaagggtgttcttggaagcctttggcttcgacaacactggcacttttcaggtgatccctgtgccacctaacggagaaaaccagacattggagagactgcgaaggtgtgcgttatgttatgacaaatgcttcccgaatgcttgtataagggaagcattcctcccagaggactcatacatggatgtcgtttttctgatcgataactccaggaacattgcaaaggatgaattcaaagccgtgaaggcacttgtctcctccgtcattgataactttaatatcgcctcagatccgctaatctcagatagcggcgaccgcatagccttgctttcctacagcccctgggaaagttcccggagaaagatgggaaccgtgaaaactgaattcgatttcataacctacgacaaccagctcctgatgaagaaccatatacagactagttttcaacagctgaacggcgaagccaccataggacgagcccttctctggacaacagagaatctgtttcccgagactccttatctgaggaaacataaagttatatttgtagtttcagccggagaaaactacgagcgaaaggagtttgtcaaaatgatggccctgcgcgcaaaatgccagggctacgtcatttttgtaatctccttgggctctacacggaaggatgacatggaggaactcgcctcctaccccctcgaccagcacctcattcagttggggcgaatccacaaacctgatctgaactatatcgcaaagttcctgaaaccatttctatatagcgttaggaggggattcaatcaatacccgcctcccatgctagaagatgcatgtaggctgatcaatttgggaggtgaaaatatccagaacgacggctttcaatttgtcactgagctccaagaagatttcctgggaggtaacggatttatcggacaagaactaaacagcggccgagaaagccccttcgtgaagacggaagataacggatctgactacctcgtgtacctacccagccaaatgtttgagccgcagaagctcatgatcaattacgagaaggatcaaaagtccgccgagatcgcttcccttacctcgggacacgagaattacggtcggaaggaggaaccagatcacacatacgagcccggagacgtcagtctgcaggagtattatatggatgtggcctttctcatcgatgcttcacaacgcgtcgggagcgatgaatttaaagaggtcaaggctttcatcaccagtgtgttagactatttccacatcgcccctactcctctcacgagcacattgggggaccgcgtagcggtcctgagttactcaccccctgggtatatgcccaataccgaggagtgcccagtgtacttggagttcgatcttgtaacttataacagcatccaccagatgaaacaccaccttcaggacagccagcaactaaatggggacgtgtttattggccatgcacttcagtggactattgataacgtctttgtgggcacacccaaccttcggaaaaataaagtgatctttgtgatctcagcaggagaaaccaatagcctggacaaagatgttttgcggaatgtgtctctgagggcaaagtgccagggctatagcattttcgtattctcttttggacctaagcacaacgataaagagcttgaggagctcgcttcccatcccctggatcaccacctggtgcaactgggacgcactcataagccagactggaactacatcatcaaattcgtgaagccctttgtgcacctgatcagacgcgcaattaacaaataccctaccgaagacatgaaggccacctgtgttaatatgaccagccccaaccccgagaatgggggtacagagaatacagtgcttttactcccaggaatttacgagatcaagactgaaaacggggatctgttcgacgaattcgatagccaggcacagcacctgctcgtcctgggtaataaccactccagcggaagcgagaccgccacagatctgatgcaaaaactgtatctgctgttcagcactgagaagctcgcaatgaaggacaaggaaaaggcccacctggaagaaataagcgctctcgttgtggacaaacagcaggagaaggaagataaggaaatggaagccacagacatctat

SEQ ID NO: 4703 - DNA, 1674 bp, Artificial Sequence
  Description of Artificial Sequence: Synthetic coding sequence
ataggcagggcacttctgtggaccacagaaaacctcttcccagagaccccctacctgagaaagcacaaagtgatttttgtggtgtccgccggagagaactacgagcgtaaagagtttgtgaagatgatggcccttcgggctaagtgccaggggtacgtcattttcgttatcagcctgggctcgactcgcaaggatgatatggaggagttggctagttatccactggatcaacacctgatccagctagggaggattcacaaaccagatctaaattatatagcgaaatttctgaagccttttctctacagcgtgaggaggggctttaaccaatacccccctcccatgctggaggacgcctgtcgtctaatcaacctgggtggggagaacattcagaatgacggctttcagtttgttacagaactccaggaggactttctgggtggcaatggcttcatcggccaggaattaaactcaggcagagagagtccctttgtcaaaactgaggataatggtagtgattaccttgtctatctcccctcacagatgtttgagccacagaagctgatgattaactacgagaaagatcagaaaagtgcggagattgcctctttaaccagcggacacgaaaattacgggaggaaggaggaacccgaccacacatatgagccaggggacgtgagtctgcaagagtactacatggacgtcgccttccttatcgacgcatcccagagggtggggagtgacgagttcaaggaggttaaggccttcattacatctgtccttgactactttcacatcgcccctaccccactgactagcacattaggagatcgggttgctgtgctcagttacagtcccccaggctacatgcccaatacagaagaatgtccggtgtatctcgagttcgatttggtgacatataactcaatacatcagatgaagcaccatctccaggacagccagcagttaaacggggatgtgtttattggtcacgctctgcagtggacaatcgacaatgttttcgtgggcacacccaatctgaggaagaacaaagttatttttgtaataagcgcaggcgagacaaattccttggataaggatgttctgaggaatgtctccttacgtgccaaatgccagggatattcaatcttcgtcttcagctttggtcccaaacataacgataaagaactggaagaacttgcttcccaccctctggaccaccacttagtgcaattaggccgtacccataaacctgattggaactacattattaagtttgtaaagcccttcgtgcatctcattaggcgcgctatcaataagtaccctacggaggacatgaaggctacatgtgtaaacatgaccagtcccaaccccgaaaacggcggtaccgagaacacggtcttgctgctgcctgggatatacgagataaagactgaaaacggagatctctttgatgaatttgattcgcaggcacaacatctgctggtgttgggcaacaatcactcatcaggcagcgaaacagctactgacctgatgcagaaactctatcttttgttttctaccgagaaactggccatgaaggataaggaaaaggcccaccttgaggaaatcagcgctctggtcgtggataagcagcaagaaaaagaggatggagaagatactcggagtagctag

SEQ ID NO: 4704 - DNA, 7581 bp, Artificial Sequence
  Description of Artificial Sequence: Synthetic coding sequence
atgaaaattctgctaattatatttgtgctaataatctggaccgagaccctcgcggatcaaagtccgggaccaggccctgtttacgccgatgtcgttttcctcgtcgacagctcggaccacctgggcccaaagtcatttcctttcgtgaagacatttattaataaaatgatcaattcccttcccatagaggccaataagtaccgcgtcgcactggcccagtacagtgacgaatttcacagcgagtttcatctatcaacttttaaggggaggtctccgatgctgaaccatcttaaaaaaaacttccagtttatcggaggctctctgcagataggaaaagctcttcaagaggctcatagaacgtactttagcgcccctatcaacggacgagaccggaagcagtttccaccaattcttgtggtactggctagtgcggaatcagaagacgaggtggaagaggcctcaaaggccctccagaaggacggcgtaaagattatctccgtgggagtgcagaaggcttcagaagagaacttgaaggccatggctacatcccatttccattttaacttacgcaccatccgcgatctctcaacattttcacagaacatgacccagatcatcaaggatgtgacgaagtataaagagggtgctgtggatgccgatatgcaggtgcactttcctataagttgccagaaggactctctagcagatctagtgttcctcgttgacgaaagtctgggtaccggcggtaatctccggcacttacagaccttccttgagaacatcacttcaagtatggacgtgaaagaaaactgcatgcgactgggcctgatgagctatagtaatagcgcaaagactatttcttttctgaagtcctcaactactcagagcgagttccaacaacagatcaagaacttatccatacaggtggggaagagcaacaccggggcagcaattgatcagatgcggagagacggattctctgagagttatgggagtcgcagggcccaaggagtcccgcagattgccgtgcttgtgacccacagaccaagcgatgacgaggtgcacgatgcagcccttaatctccgtctggaagacgtgaacgtgttcgccctttcaatacagggtgcaaataatacccagctggaagagattgtatcatatcccccagaacagacaatctctactctgaagtcttacgcagatcttgaaacttactctacaaagttcttgaaaaaactccagaatgaaatttggagccagatttcgacgtatgcggagcagagaaatttagataaaactggctgcgtcgacactaaagaagccgatatccactttctgattgacggatcaagctccatccaggagaagcagtttgaacagattaagaggtttatgcttgaggtgaccgaaatgttcagcatcgggcctgacaaggtacgcgtgggggtggtgcagtactctgacgataccgaagtagaattctatattaccgactacagtaacgatatcgatctgaggaaggccatttttaacataaagcaactgaccggagggacctatacaggcaaggccctggactatatcctgcagataatcaagaacggaatgaaggaccgcatgagcaaagtcccctgttatctaatagttctgaccgatgggatgtccacagatcgcgtggtggagcccgctaaaagactcagggccgaacagattacagtgcatgccgtcggcataggcgcagctaataaaatcgagcttcaggaaatagccggaaaagaagagcgcgtgtcatttggccaaaactttgacgcacttaagtcgataaagaatgaggtcgtacgggagatttgtgccgagaagggttgcgaggacatgaaggccgacataatgttcctggtggatagctcctggtctatcggcaacgagaattttcggaaaatgaagatcttcatgaagaatctgttgacaaaaatacagatcggtgcagacaagactcagatcggcgtggtgcaattcagcgataagacaaaggaagagttccaactgaacagatacttcacgcagcaggagatcagcgatgccatcgatcgcatgagcctgatcaacgaaggcactctgacgggcaaagcccttaactttgtgggtcagtacttcacccactccaaaggggctaggctgggggctaagaagttcctcatcctgatcaccgatggcgttgcacaggacgatgtgagggaccccgcaagaatcttgagggggaaggacgtgactattttttcagttggagtgtacaatgccaaccgcagccagctggaggagatttcaggggactcttccttggtgttccacgttgaaaattttgaccacctcaaagctttagagcggaaactgatattccgcgtttgtgccctgcatgactgtaagaggattacactccttgatgtggtgttcgttctggaccactccggcagcattaagaagcagtaccaagatcacatgattaatcttactattcatctggtcaaaaaagccgacgtgggccgtgatcgggttcagttcggagctctgaagtattctgaccagccgaatatcctgttctacctcaatacgtactctaatagatctgcgatcatagagaaccttcggaaaagacgggatactggcggtaatacttacacagccaaagctttgaaacacgcaaacgctctcttcactgaagaacacggtagcagaattaagcaaaatgtaaaacagatgctcattgtgattactgacggcgagtcccacgatcatgaccagctgaacgacactgcactcgagttacggaataagggaattaccatctttgctgtgggggtgggtaaggcaaaccagaaagagcttgaaggcatggcgggaaataagaacaacacaatttatgtggacaattttgataaacttaaggatgttttcaccctggttcaggaacgtatgtgcaccgaggcccctgaggtgtgccatctgcaggaggctgatgtaattttcttgtgcgacgggtccgaccgagtctccaactcagattttgtgacaatgaccacattcctgtccgatcttatcgacaactttgatatacagagtcagcgaatgaagatcggcatggcacagttcgggagtaactatcagtccattatagagttgaaaaacagcctgacaaagacccagtggaaaacccaaatccaaaacgtatcaaagtccggtggattcccgagaatcgatttcgctctgaagaaagtgtccaatatgtttaatctccatgccggtggtcgacggaacgccggagttccccagacgctcgttgttattaccagtggcgacccacggtatgacgtggcggatgcggtgaaaaccctgaaggatctgggtatctgcgtcctcgtgctcggaatcggggacgtgtataaagaacatcttttacccatcacaggtaattcagagaagattattacttttcaggacttcgataagctgaagaacgtggatgtaaagaaaagaataatccgggaaatctgtcagagctgcggcaaaacaaactgcttcatggatatcgtggttggatttgacatctccacgcacgtccagggccagccgctgttccaggggcacccccagctcgaatcctacctgcctgggatcctggaggacatcagttcgatcaaaggtgtgtcgtgcggcgctggcacagaggctcaggtctcgctggcctttaaagtcaattctgaccaggggttccccgcaaagttccagatctaccaaaaggcagtgttcgattccctcttgcaggtaaacgtgtccggtcccacccatctaaacgcccagttcctgcgtagcctgtgggacaccttcaaagacaagagcgcctcacggggacaggtgctgctcatctttagcgatgggttgcagagcgaaagtaacatcatgttggagaaccagtccgatagattgcgtgaggcaggcctcgatgccctcctcgttgttagcttgaatacaactgctcatcacgagttctcctctttcgagtttggaaaaagattcgattatcgaacgcatctgaccatcggaatgagggaattgggtaaaaaactgtcacagtatctaggaaatatcgctgaaagaacttgttgctgcaccttctgcaagtgtcctggtattcccggtccccacgggaccagagggcttcaagcgatgaagggctctcagggcctaaagggctctcggggtcaccgcggtgaggacggtaatcctggcgttaggggagacacaggaccccagggcgacaagggcatagcaggatgcccgggtgcatggggacagaaaggtctgaaaggttttagcgggcctaaaggcggtcatggcgacgacggaatcgatggtttggacggcgaagaaggttgtcacggcttccctgggattaagggggagaagggagatcctggaagccaaggaagtcccggatcgcggggagcaccaggccagtatggtgaaaagggctttccaggggatccaggcaacccgggtcagaataataatatcaaaggccagaaggggagcaaaggggagcagggtcgacagggccgttcgggccaaaaaggtgtccaagggtccccttctagccgaggctctcggggaagagaaggacagagaggattacgtggagtgagcggagagccaggtaatcccggtccaactgggaccctgggcgcagagggactccagggtccacagggtagtcagggaaatcccggaagaaaaggcgagaagggttcccagggacagaaaggcccacagggttcccctggcttgatgggggctaagggctcaactggccgtccgggactgctgggtaagaagggcgagcccggtttaccaggggacttgggtcccgtgggacagacaggtcaacgaggcagacaaggtgattcgggtatacccggatacgggcagatgggcagaaagggagtaaagggcccaaggggcttccccggtgatgccggacagaaaggagatattggcaatccgggtatacctggcggacccggacccaaggggtttcgagggctggcactgacagttggcttaaaaggggaagaaggcagtagagggcttccaggcccacctggacaaaggggaatcaaaggtatggctgggcaacccgtgtatagccagtgtgatttaattcgcttcttgcgagaacatagtttgtgcagtctagaaaaatgccctgcctaccccacggagctcgtgttcgctttggataattcttatgatgtgaccgaggaaagcttcaataaaacgcgcgacatcataacctcgatagtcaacgacctgaatatccgggaaaacaactgtcccgtaggagcgagagttgctatggtatcatacaacagcgggacctcctacctcatacgctggtccgactataaccgcaagaagcagttactccagcagctgagccaaattaagtatcaagacactaccgaaccaagagacgttggcaacgccatgaggtttgttactagaaacgtttttaaaaggacatacgccggagcaaacgtcagaagagtagctgtgttcttttccaatgggcaaactgctagtagatctagtatcataaccgccaccatggaattttccgcactggacatttctcccactgtctttgcatttgacgagcgcgttttcctcgaggcctttggctttgataatacaggaaccttccaagtgatcccggtgcccccaaacggcgagaaccagacgttggagagattgagaagatgcgccctgtgctacgacaaatgctttcctaacgcatgtatccgtgaggcttttttgcctgaggattcctatatggacgtcgtctttcttatcgataactctagaaacatcgccaaggacgagttcaaggccgtcaaagccttggtgtcatcggttatcgacaactttaatattgcctccgatcctcttatttcggacagcggagatcggatcgcgttactgtcctatagcccctgggagtcatcgcgccgaaagatgggaaccgtgaagaccgaatttgatttcattacctacgacaatcagctcctcatgaagaaccacattcaaacttccttccagcagcttaatggcgaggctactatcggcagggccctcctgtggacaaccgaaaacttgttccctgaaacgccttaccttcgaaaacacaaagtcatattcgttgtcagtgccggagaaaactatgaaagaaaggagttcgtcaagatgatggctctacgggctaaatgtcaaggctatgtgatcttcgtcatctcgttggggtcaacgagaaaggacgacatggaggaactcgcaagttacccccttgatcagcacctcatacagttgggcagaatccacaagcctgacctgaattacattgccaagtttctaaaaccgttcctctattccgtgaggagaggattcaatcaatatcctccaccaatgttggaggacgcctgtcgcctgataaacttggggggagaaaatatccagaatgacggatttcagtttgtgactgagcttcaggaagatttcctgggaggcaacggatttatcggccaagagctgaatagcggcagggagtcccccttcgtgaaaaccgaagataatggaagcgattatctggtttatctgccctcccagatgtttgaaccacagaaacttatgatcaattacgagaaggatcagaaatcagccgagatcgcaagccttacgagtgggcatgagaattatggcaggaaagaggaaccagatcatacctacgagcctggcgacgttagtcttcaggaatactacatggacgtcgccttccttatcgatgcttctcaaagggttggcagcgacgagtttaaggaagtgaaggcattcattactagcgtgctcgactacttccacatcgcgccaacaccactcacatccacactgggagatcgcgtggccgtactgtcttactccccccctgggtacatgcctaacaccgaagagtgtcctgtgtacttagaatttgatttggtgacatacaatagcatccaccagatgaagcatcaccttcaggattctcagcaactcaatggggatgtttttattgggcatgccctgcagtggaccattgacaacgtgttcgtgggaacccctaatttgagaaagaataaagttatctttgtcataagcgccggagagacaaactccctggacaaggatgtgctgcggaatgtgtctttaagagccaagtgtcaagggtactccatctttgtgttcagtttcggccctaaacataacgataaagagctggaagagcttgccagccaccctctcgaccaccacttagtgcaactgggaagaacccacaagccagattggaactatattatcaagtttgtgaagccgtttgtgcacttgattcggagagccattaacaagtatcctacagaagatatgaaggccacctgtgtgaatatgaccagcccaaatcccgagaacgggggtaccgagaacacagtactgtggtac

SEQ ID NO: 4705 - DNA, 1332 bp, Artificial Sequence
  Description of Artificial Sequence: Synthetic coding sequence
aatcagtacccacctcccatgttggaggacgcttgtcgcctcatcaatttaggcggagaaaatattcaaaacgacggcttccagttcgtgacagagctccaggaggacttcctcggcggaaacgggtttattgggcaggagttgaactcgggccgagaaagccccttcgtaaagaccgaagataatggctccgattacttggtgtacctaccatcacagatgttcgagccgcaaaagctgatgattaattacgaaaaggatcagaagtctgcagagatcgcctcattgacaagcgggcacgagaattatggcagaaaggaggagccagatcatacatacgaaccaggcgacgtctctttgcaggaatattacatggatgtggcctttctgattgatgcttcacagagggtcggatctgatgaattcaaggaagtaaaggcgttcatcacgagtgtgctggactactttcatatcgccccaaccccactgacttctaccctcggggaccgcgtggcggtgctctcttattccccaccgggatatatgcctaacaccgaggagtgtccagtctacctcgagttcgatctagtgacttacaactcgatccaccaaatgaagcatcatctgcaggattcccagcagctcaatggcgatgtgtttattggccacgcactgcagtggaccatagacaacgtttttgtcggcacccccaacctgaggaagaacaaagttatattcgtcatcagcgctggcgaaactaatagcctcgacaaagacgtgctcaggaacgtgagcctgcgcgcaaagtgccagggctatagcatcttcgtgttctccttcggaccaaagcataatgacaaagaactggaggaattagcctcacacccattagatcaccacctagtgcagctcggcagaacccacaagccggattggaactatattatcaagttcgtgaagccttttgttcacctgatcagacgcgctattaacaaatatcctacagaggacatgaaggcaacatgtgtaaatatgacctctcctaacccagagaatggcggtaccgagaacacggtcctgctccttcccggaatctatgaaataaaaacagagaatggcgacctgtttgatgagttcgattctcaggcccagcatctgctggtgttggggaataaccattccagcggaagtgagactgcgacggatctgatgcaaaagttatacctcctgtttagtacggagaagctggctatgaaggacaaggagaaggctcacttggaagaaatcagcgctcttgttgtcgacaagcagcaagagaaggaggatctgtag

SEQ ID NO: 4706 - DNA, 6791 bp, Artificial Sequence
  Description of Artificial Sequence: Synthetic coding sequence
atgatgttactgatactctttctggtgatcatttgcagccacattagtgtcaatcaggacagcgggcctgagtacgccgatgtggtgtttctggtggatagctctgatcggctcggcagtaaaagcttcccctttgttaaaatgttcattactaagatgatcagctcccttccaattgaggctgataagtatcgtgtggcactggcccagtacagcgacaagctgcactcggaatttcacctgagtacctttaaaggtcgcagtcctatgctaaatcatctgcggaaaaatttcggatttataggtggctctctccagattgggaaagctctacaggaggcgcatcgtacatatttctccgcacccgctaatggaagagataagaagcagtttccccctatcctagtggtgctggccagcagcgagtccgaagacaacgtggaagaggcctctaaggcgcttcgcaaggatggagtcaagatcatttccgtgggagtgcagaaggcgtccgaggagaaccttaaagccatggccacaagtcaatttcacttcaacctgcggacagtccgcgatctttctatgttttcccaaaatatgacccacattattaaggatgtcattaaatacaaggagggcgctgtcgacgacatatttgtagaggcttgccagggtccaagcatggccgacgtggtgttcttgctcgacatgtctatcaatggttccgaagagaattttgactacctcaaaggattcctggaggaaagcgtatccgcccttgacattaaagagaactgcatgcgcgtgggcctggtggcctatagtaatgagaccaaggtcataaactctctcagtatgggcatcaacaagtctgaagtgctgcagcatatccagaatctctcccctcggactgggaaagcctatacgggagcagcaatcaaaaagctgcggaaagaggtcttctcagccagaaatggctcaaggaagaatcaaggggtgcctcagatcgccgttctggttacacatcgcgactcagaggacaatgtgacaaaagccgctgtgaacctgagaagagaaggggtgaccatctttaccttaggcatagagggagccagcgatacccagctggagaagattgcaagtcaccctgcggaacagtatgtatcaaagttaaaaacctttgccgaccttgcagcgcacaaccaaacttttctgaagaagctaaggaatcaaataactcacaccgtgagtgtgttttccgaacgaacagagacactgaaaagtgggtgcgttgacaccgaggaggccgacatctaccttctgattgacggaagcggcagcacacaagcaactgactttcacgagatgaaaaccttcctcagcgaggtcgttggcatgtttaacatcgcccctcataaggtgagagtcggggctgtgcagtacgctgactcatgggatctagaatttgagataaataaatactcaaacaaacaggatttaggtaaggctatcgaaaatattcggcaaatggggggtaatactaatacaggcgcagctctcaacttcactctgtctttgctccagaaagctaaaaagcagagggggaacaaggtgccttgccacctcgtcgtgctgacaaatggaatgtctaaagatagcatcctcgagcctgctaacagactgcgcgaggagcacataagagtatacgctatcggtatcaaggaagcaaatcagacacaactgagagaaattgcgggtgaagagaaacgtgtgtattacgtgcatgacttcgacgccttaaaagacatccggaaccaggtggttcaggagatctgcaccgaggaagcatgcaaagagatgaaagccgacataatgtttctggttgacagtagtgggagcattggtccggagaacttctctaagatgaagacctttatgaagaatctggtttccaaaagccagattggtccagacagggtacaaataggagtcgtccagttctccgacataaataaagaggaattccagctaaacagattcatgagccagagcgatatctccaacgccatcgatcaaatggctcacatcggtcaaacaactttgaccggctctgcactgtcgtttgtctctcagtacttcagccccacaaagggtgcacgaccgaatattcgcaaatttctgattttgattaccgatggggaagctcaagatatcgtgaaagagcctgcagttgtgcttcggcaggagggggtgatcatttacagcgtgggcgtgtttggctcaaatgtgacgcagctagaagagatttctggcagaccggaaatggtattttatgtggaaaactttgacatcctccagcgcatcgaagacgatctggtgttcggcatctgcagtcccagagaggaatgtaaaaggatcgaagttcttgacgtcgtattcgtgattgatagctccggatccattgactacgatgaatacaatattatgaaggacttcatgattggactggtgaagaaggcggatgtgggcaaaaaccaggtgcggttcggcgctttgaagtatgctgatgaccctgaggtcctcttctatctagatgacttcgggacaaagctggaggtcatcagcgtgttgcagaatgaccaagccatgggcggatcaacttacaccgcggaggccttgggcttttctgaccacatgttcacagaggcccgaggctcccggttgaacaagggtgtgcctcaagtgctaatcgtcattacagacggagagagccatgatgctgacaagctgaacgcgactgccaaagccctgagggacaaaggaatcctcgtgctggcagtgggtatagatggtgccaacccagtggagcttctggctatggccggatcgagcgacaagtacttttttgtcgaaaccttcgggggtttgaaaggcatcttcagcgatgttactgcttccgtctgtaactcatctaaggtagattgtgagatagataaagtggatcttgtgtttttaatggacggaagtacaagtattcagccaaacgacttcaagaagatgaaggagttcctagcctctgtcgtccaggactttgatgtctcgctgaacagagttcggatcggcgcagcgcagtttagtgacacctatcatccggagtttcctctaggcacctttatcggcgagaaagaaattagttttcaaatcgagaacatcaaacaaatctttggcaatacacatatcggggcagccttgagagaggtcgagcactactttaggcctgatatgggcagccgcatcaacactggcactccccaggtgctcctggtgctgacagatggccagagtcaggatgaggtggcccaggccgctgaagccctgcgccaccgcggaattgatatctattccgtggggattggggatgtggacgatcagcagctgatccagatcaccggcaccgcggaaaaaaagctgaccgtgcacaacttcgacgaactgaaaaaggtgaacaaaagaattgtgagaaacatttgcaccacagccggagaaagcaattgcttcgtggacgtggtggtcgggtttgacgtgtctacccaggagaaggggcagacgctcctcgagggccagccctggatggagacttatctgcaggacatcctgcgggcaatctcatccctaaacggggtgtcttgtgaagttggaactgaaactcaggtgtccgttgcttttcaagtgactaatgccatggagaagtattctccaaaattcgagatctatagcgagaatattctgaacagtttaaaagacatcaccgtcaaaggacctagcctcctgaatgcaaatctccttgattcactgtgggacacctttcagaataagtctgcagccagaggcaaggtggtgttgctctttagtgacgggctggatgatgacgtggagaaactcgaacagaagtctgatgaattgaggaaggaggggttgaatgctctaatcactgttgcccttgatggacctgccgatagtagcgacttggccgatcttccttacattgagttcggcaaggggtttgaatatcggactcagctctctatcgggatgcgagagctgggatccagactctccaagcagctggtgaacgttgccgaacggacatgttgctgtttattctgcaagtgtatcgggggtgatggaaccatgggagacccaggcccacccggaaaacgcggtccccctggcttcaagggttccgaaggctatctgggggaagagggtattgccggagaacgcggagcccctggtcctgtcggcgagcaggggaccaaaggttgttacggcaccaagggacctaaagggaacagggggttaaacggtcaagagggagaggttggagaaaatgggatcgatggtcttaacggagagcagggtgataatggcttaccaggcaggaagggagagaagggcgacgaggggtcacaaggatccccagggaagcggggaacaccaggcgaccgaggcgcaaaagggttgagaggcgacccgggagctcccggagtggacagcagcatagaagggccaacaggccttaagggcgaacggggacgtcaaggacgcaggggctggccagggccacccggaacacccggttctaggaggaagacagcagcgcacggccgaagggggcatactgggcctcaggggacagccggaatccccggaccagacggcctggaaggcagcctaggcctgaaggggccacagggaccaagaggcgaagctggggtaaagggagaaaaaggtggggttggctctaaagggccacagggcccacccggtcctggcggagaggccggaaaccagggtcgcctgggtagtcagggaaacaagggagaacccggtgacctcggcgaaaaaggcgcagtaggttttcccggacctaggggcttgcagggaaacgacggctccccaggatacgggtcagtcggtcggaaaggggctaaggggcaggagggcttccccggagagagcggccctaaaggagagatcggtgatccgggtggacccggagaaaccggactgaagggagcacggggtaagatgatttccgccggactccctggagagatgggaagccctggggagcccggtccgccaggtcggaaaggagtgaagggcgcaaaaggcctggcatcattttctacctgtgaactgattcaatacgtgcgcgaccggtccccgggacgccatgggaagccggagtgtcctgttcacccaaccgagttagtctttgcactcgaccactcacgagacgtgactgagcaagagttcgaacggatgaaggagatgatggcgttcctggttcgggacataaaggtccgtgagaactcgtgccctgtcggagcccatatcgcgatacttagttacaacagtcatgcaaggcacctagttaggttctctgatgcctacaaaaagtcgcagctgctgagagagattgagaccatcccctatgagagatcctccgctagccgagagatcggccgagcgatgcgattcatatcccgaaatgtgtttaaaagaacgctgcctggagctcacaccaggaagatcgctacgttcttctctagtggacagtcagctgatgcccactccattacaacagcagcgatggaattcggcgctcttgagattatacctgtggtgatcaccttttccaacgtcccatcagttagaagggctttcgccatagatgacactggcacattccaagtgattgtggtgccttccggcgcagattacattcctgccctggaacggctgcagcgctgcacattttgctacgacgtttgcaagcccgacgcttcttgtgatcaggctaggcccccacccgtgcagagctatatggatgccgcttttctcctggatgcctctagaaacatgggaagcgctgaatttgaggatattcgcgctttcctgggggctttgctagaccacttcgagatcacacctgagccagaaacctccgtcaccggtgaccgggtagcactgttatcccatgctcctccagacttcctcccgaatacccagaaatcccccgtccgggcagagttcaatcttaccacatacagaagcaaacgactcatgaaacggcacgtgcatgaatctgtgaagcagctcaatggagatgctttcatcggacatgcgttgcagtggaccctggacaacgtctttttgtccacaccaaatttaaggaggaataaagttatcttcgtgataagtgcgggagagacttctcatctggacggagaaatccttaaaaaggaaagtctgcgcgcaaaatgtcaagggtacgccctgttcgtcttcagcctcggacccatatgggacgacaaagaactggaagatcttgcctcccatcctctggatcatcatctggtgcaacttggtaggatccataaacccgaccattcctacggggtgaaattcgtgaaaagcttcatcaattctattcgacgcgcaattaataaatacccccctatcaacctgaaaatcaaatgtaaccggctaaattccatcgacccgaagcagccacctagaccattccgctcattcgtgcctggcccactgaaggctacactgaaggaggacgtgctccagaaagctaagttttttcaggataaaaaatatctctctcgggtcgcacgcagtggaagggacgatgcgattcaaaatttcatgcgatccacaagccataccttcaagaatgggcgtatgatcgagagtgccccaaaacagcacgacta

SEQ ID NO: 4707 - DNA, 6791 bp, Artificial Sequence
  Description of Artificial Sequence: Synthetic coding sequence
atgatgctgcttatccttttcctggtgataatctgctcacacatctcagttaaccaggacagtggacccgagtacgccgacgtggttttcctcgtggatagctctgacaggctggggtccaaaagtttccccttcgttaagatgttcatcacaaagatgatttcatcgttacccatagaggctgataagtatcgagttgcgctggcccagtactctgacaagctgcacagcgaatttcatttgtcaacgttcaaaggaagatctccgatgttgaaccatcttaggaagaacttcggattcattggtggttccctgcaaatcggcaaggccttgcaggaggcccacaggacatacttcagcgcacctgctaatggacgggataagaaacagtttccaccaattttagtcgtgctggcatcttccgaaagcgaggataatgtcgaagaagctagtaaggccttacggaaagatggtgtgaagataatctcggtgggcgtacaaaaagctagcgaggaaaatctaaaagcaatggctacaagccagtttcactttaacctgagaacagtgcgcgatctcagcatgttctcgcagaacatgacgcacatcataaaggacgtgattaaatataaagaaggggctgtggacgatattttcgtggaggcctgtcagggcccttccatggcagacgtggttttcttgctcgacatgtctattaatggctctgaggagaattttgattacttaaagggattcctggaggagagtgtttcagccctggacatcaaggagaactgcatgagagtgggcctagtggcctatagcaacgagaccaaggtgatcaatagcctctctatgggcatcaacaagagcgaagtcctccaacatattcaaaacctgagcccacgaactggcaaagcctacaccggggctgccatcaaaaagctcaggaaagaagtgttttcagcacgtaatgggtcccgcaaaaaccaaggcgtacctcaaatcgccgtgctggttacgcaccgagactcagaagataacgttacaaaagctgcagtgaatctccgaagagagggcgtgacgattttcacattgggcatagagggggcatctgatacccagctcgagaagatagcctcccaccctgccgaacaatacgtgtctaagctcaagacattcgctgatctggccgcacacaaccagaccttcctcaagaagctccgaaatcagatcacccataccgtgagtgtctttagtgaaaggactgaaacgctcaagagcggctgcgttgacactgaagaggccgatatttacctgctgatcgacggatctgggtcgacacaagcgaccgactttcatgagatgaaaacctttctgagcgaggtcgtcggaatgttcaacatcgcaccccataaggttagggtcggggctgtacagtatgcggactcttgggatttggagttcgagattaataaatacagtaacaagcaagacctgggtaaagcaatcgaaaacattcggcagatggggggtaacaccaacacgggggcagcgctgaactttaccctgtccctgctccaaaaggccaaaaagcagcgcggaaataaagtgccctgtcatctggtcgttctaactaacgggatgtctaaggattccattcttgagcctgcaaacagactgagggaggaacatattagagtatatgcgatcggcattaaggaagcgaatcagacccagcttagggaaatagccggtgaggaaaagcgtgtatattacgttcacgatttcgacgctctgaaggatatacggaaccaggttgtgcaggaaatttgtacggaggaagcctgcaaagaaatgaaagccgatataatgttcctcgtcgactcatccggctcgattggcccagaaaacttcagcaaaatgaaaacttttatgaaaaatctagttagcaaaagccagatcggtcctgatcgagtgcaaatcggcgtggtgcaattttcagacatcaataaagaggaatttcaattaaacaggttcatgtcgcagagcgatatctctaacgccatagatcagatggcacacattggccagacaacgctgaccgggagcgctctttcctttgtgtctcaatactttagccccactaaaggggctcgtccaaatatccgaaaatttctcattctgataactgacggggaagctcaggatattgtgaaagagccagcagttgtgctccgacaggaaggagtgatcatttactccgtaggggtattcggctcaaacgtcactcaactggaagagatttccggccgaccagagatggtgttctatgtagaaaacttcgatattctccagcggatcgaagacgacctggtgttcggcatctgcagtccccgtgaggagtgcaagcggatagaggttctggatgtggtgtttgtgatcgattcctccggatcaattgattacgacgaatacaatattatgaaagatttcatgatcgggttggttaagaaggcagacgtcgggaagaaccaggtgcgcttcggggcacttaagtacgctgacgacccagaagttctgttttatctcgacgactttggcacaaagttggaggtgatatcagtgctccagaacgatcaggccatggggggtagcacctacaccgcggaagccctgggcttttcagaccacatgtttaccgaggctaggggaagccgtctcaacaagggggtcccacaagtcctaatcgttatcaccgacggagagtctcatgatgccgacaaactaaacgccaccgcaaaggcgctaagggacaagggcatcctggtcctcgccgtcgggatcgacggagccaatcccgtggagctcctggccatggctggttcatctgacaagtacttttttgttgagacttttggcggattgaaaggcattttttcagatgtcacagccagtgtttgcaacagcagcaaggtcgactgtgaaattgataaagtggacctcgtgttcttaatggatgggtcaacttctattcaaccgaacgacttcaaaaagatgaaggagtttctagcctctgtcgtgcaggacttcgatgtgtccctcaatcgggtgagaatcggcgcagcacagttttcagatacgtaccacccagaatttccactcggaaccttcatcggcgaaaaggagatttctttccagatagaaaatattaagcagatcttcggaaacacccatattggggcagccctgcgggaagttgagcattattttcgtcctgacatggggtcaagaattaatacaggtacaccgcaagtgctgctggtgctcaccgacgggcagagtcaggacgaggtcgctcaggcagccgaagcactccgccatagagggatagacatttacagcgtaggcatcggagatgtggacgatcaacagctgatacagatcaccgggactgccgaaaagaaattaaccgtccataacttcgatgagctgaagaaagtgaacaaacgtatcgtgcgcaacatttgtaccacagctggggagagcaactgctttgtcgatgtagtcgtcggatttgatgtcagcacacaggagaagggccagacattattagagggacaaccttggatggagacctatcttcaggatattctgcgagctatcagttctctgaacggtgttagttgcgaggttggaacagaaacccaggtctccgtggcgtttcaggtcaccaacgcaatggagaagtactcccccaaattcgaaatctattctgaaaacattttaaacagtcttaaggatattactgtcaagggcccaagcctcttgaatgccaatctcctggacagtctgtgggacacattccaaaacaaaagcgctgcgagaggcaaggtagtgctgctgttttctgatggcctggacgatgatgtcgagaaactcgagcaaaaatccgatgaactacggaaggagggcctcaacgctctcatcacagtggccctggatggacctgccgattcatccgatctggcagacttgccatatattgaattcgggaaagggtttgaatatcgaactcaactgagcatcgggatgcgggaactagggagcagattgtctaagcagctggtgaacgttgccgagagaacttgctgctgcttgttttgcaagtgcattgggggtgacgggacaatgggagatcccggaccacctggaaagaggggtccccctggatttaagggtagcgaaggataccttggcgaagaggggatcgctggggagagaggagctccgggacctgttggcgagcagggcaccaaggggtgctacggcacaaaaggaccaaaggggaacaggggcttgaacgggcaggagggggaggtcggagaaaacggaatcgatggacttaacggggaacagggggataatggtctcccaggccgtaagggggagaagggggatgaaggatcccaaggctcgcctggcaagcgcggaaccccaggggaccgcggagccaagggcctgcggggagaccccggagccccaggcgtggattccagcatcgagggccctaccggactgaagggtgagaggggtaggcaagggaggagaggctggcctggtccaccaggcacccctggctctagacggaagacagctgcacacggcagaaggggccacacagggccacaaggcacagctgggattccaggccctgatgggctagaaggaagtctagggctcaagggcccacagggaccccgaggggaggccggagttaaaggggagaagggtggggtcggctctaagggaccgcagggcccaccgggacctggcggagaggccggaaaccaggggcgactcggcagtcagggaaacaaaggggaacccggagacctgggcgaaaagggggctgttggcttccccggtccacgaggtctccaaggaaacgatggtagtcctgggtatggcagcgtgggacgtaaaggggcaaagggacaggagggctttcctggggaaagcggcccaaaaggagaaatcggagaccccggaggccctggcgagaccggcctgaaaggagctaggggtaagatgataagcgcaggcttgcctggagagatgggttccccaggtgaacccggacctccaggtaggaaaggcgtgaaaggggcaaaaggtcttgcgtcctttagtacgtgtgagttgatccagtacgtgagggaccgctcgccaggacagcaccgtaagcccgaatgcccagtccatccaactgagttagtcttcgctctggatcacagtcgggacgtgaccgagcaggagtttgagaggatgaaggagatgatggcgttcctggtgcgcgacattaaggttagggaaaattcatgtccagtgggcgcacacatagccattctgagctacaattcacatgcgagacaccttgttagattcagcgatgcctacaagaagagccagcttctgagagagatcgagactatcccatacgaacgctcgagtgcgtctagggagatcggcagagctatgcgctttatttcgagaaacgtttttaaacggacactgcctggggctcacactcgtaaaatcgccactttttttagctccggccagtccgctgacgcccactctattactacagctgccatggaattcggtgcactagagatcattccagtggtcatcaccttttctaatgttcctagtgtgagacgagctttcgctatcgatgacactggtacctttcaggtgatcgttgtgccttccggagctgactatatccctgctttggagcggctgcagaggtgcacattttgctacgacgtatgtaagccagatgctagttgtgatcaggccagaccccctcccgttcaatcctacatggacgctgcttttctgctcgacgctagccgtaacatgggctccgctgaattcgaggacattcgcgcattccttggcgcactgctagatcatttcgaaataacccctgagccggagacctccgtcacaggagaccgggtggccctgctcagccacgcccctcctgactttctcccaaatacccagaagtcccctgtcagggctgagttcaatttaaccacctaccgctccaagagacttatgaagcggcacgtgcatgaaagtgtcaaacagctgaatggcgacgctttcattggccatgcactgcagtggaccttagacaacgtgttcctgagcactcccaaccttcggagaaataaggtgatctttgttatatcagctggcgaaaccagtcatctggacggcgaaatcctgaagaaggaatccttgagggccaagtgccagggttacgctttgttcgttttttctttaggacctatctgggatgacaaagagctcgaagacctggcgagccatccgctcgatcatcaccttgttcagctgggtcgtatacacaagcccgatcacagttacggtgtcaagtttgtgaagagctttatcaactctattcgtagagctatcaataagtacccaccaatcaatctgaagatcaaatgcaacagactcaacagtatcgatcctaagcagccaccgagacccttccgatcattcgttcccggtcctttgaaggctacccttaaggaagacgtgctgcagaaagctaaattctttcaggataaaaaatacctgtcacgagtcgccagatccggcagggatgatgctattcagaatttcatgaggtccacaagtcatacgttcaagaacgggcgtatgattgaatccgcaccgaagcaacacgatta

SEQ ID NO: 4708 - DNA, 2112 bp, Artificial Sequence
  Description of Artificial Sequence: Synthetic coding sequence
atgttgggaaccttgactccactgagttccttactgttgcttcttttagtccttgttctggggtgtggaccaagagcctcatccgggggaggtgccggtggagctgccggttatgcccctgtgaagtacattcagccgatgcaaaagggcccagtgggaccaccattcagagaaggaaagggacagtatctggagatgcctctgccactactccccatggacttgaagggagagcctggcccacccggtaagcctggacctcgcggtccaccaggccctcccggatttccaggcaagccgggtatggggaaacctggccttcatggtcagcctgggcctgccggaccccctgggttctccagaatggggaaggccggaccaccgggactgcctggcaaggtcggccctccaggtcagcccggactccgtggagaacctgggattagaggtgatcaaggactgcgcggaccaccgggtcctcccggactgcccggaccaagcgggatcactataccgggtaagccaggcgctcagggcgttcccggtccacctggattccagggagagcccggaccacagggtgaacccggacccccaggcgatcgcggacttaaaggtgacaatggtgtagggcagccgggtctccccggtgctcctggacagggtggagcccctggacctcccggattaccgggtccggctggcctcggtaagcccggactggacggattgcctggggcacctggcgataagggggaatccggaccgccaggtgtgcctggaccaagaggcgaaccaggagcagttggccctaagggcccacctggggtagacggtgtgggagtgccaggtgccgcaggcctcccgggaccccagggtccgagcggggctaagggggagcctggcacgagggggcctcctggactcattgggccaacaggttacgggatgcctgggctccccggtccaaaaggagaccgtggtcccgctggagttcctgggcttctcggcgatcgaggcgagcctggcgaggacggcgagccaggcgagcagggaccccagggcctgggtggtccgccaggcctgcctggttcagccggtttaccgggacgaagaggccctcctggaccaaagggcgaggctggccctggagggccaccgggagtgcccggtatacgcggagatcagggaccgtctgggctggccggtaagccaggtgttcccggtgagagaggactcccgggagcacacggacctcccggtccaactggacctaagggagagcccggatttaccggcaggcctggcggtccaggagttgcgggagccctcggccaaaagggcgacctgggcttacccggacagcctgggctcaggggcccatctggcataccaggactgcagggtcccgctgggcctattggccctcagggcttgccaggcctgaaaggcgaacctggattgccgggaccgcctggggagggccgagccggagagcccggtacagcagggccaactggccctcctggggtccccggtagcccagggattactggccctcccggacctccagggcctcccggacccccaggggctccaggcgcatttgacgaaaccggtatcgccggattacatctccccaatggtggtgtggagggtgctgtcctaggaaagggcggtaaaccacagttcggcttgggagagcttagcgcacatgctaccccggctttcactgcagtccttacgtccccctttccagcctctggtatgccagtgaagttcgataggaccctctacaacgggcattctggatacaacccagctactgggatctttacctgcccagtgggcggagtttattatttcgcttatcatgttcatgtcaagggcaccaacgtgtgggtggcactatacaagaacaacgttcccgcaacttatacttacgacgagtacaagaaaggttacctggaccaggcttctggaggggctgttcttcagctgagacccaatgaccaggtttgggtccagatgcccagcgaccaggccaatggactgtattctactgagtatattcacagctcgtttagcggctttctactgtgcccaacgtag

SEQ ID NO: 4709 - DNA, 1284 bp, Artificial Sequence
  Description of Artificial Sequence: Synthetic coding sequence
atgctcggcaccctgacacccctgtcttccctcttgctactgctcctggtcttggtactgggctgtggaccccgagccagttcaggcggaggagcagggggagctgccggttacgctcccgtgaagtatattcagcctatgcagaaaggccctgtgggtccccctttccgcgagggtaagggccagtatctggagatgcccctgccactgctccccatggacctcaaaggggaaccaggaccaccagggaaaccgggtcctagaggtcccccagggcctccagggtttcctgggaagcctggtatgggaaagcctggacttcatgggcaacctggccctgcaggaccgcctggattctctcggatgggcaaggctgggccacccggactgcccggaaaggtggggccacccggacagcccggtctgcggggagaacctggcatccgcggagaccagggattacgcggacctcccggaccaccgggactgcctggacctagtggaatcaccatccctggaaaacctggtgcccaaggcgttccaggacccccaggttttcagggagaaccaggtcctcagggcgagcccggacctccaggggatagaggcttgaaaggcgataatggcgtgggacagcctggactgcccggagctcccggtcagggcggagctccaggaccacctggtctccccggaccagctggcctcggcaagcccggtttagatgggctgccgggagccccaggagataagggcgaaagcgggccacctggggctttcgatgagactggaatcgcgggattgcacctgcctaacggcggagtggaaggggctgtgctgggtaagggaggaaaaccccagttcggtctcggcgagcttagcgcccacgcaaccccagccttcacagccgtccttacttctccttttcctgccagtggtatgcccgtcaagtttgaccggacactgtataacgggcattctggctacaaccccgcaactggcatctttacgtgccccgtcggcggtgtctattacttcgcttatcatgtgcatgtaaaggggactaacgtctgggttgctctgtataaaaacaacgtgcctgccacatacacctatgacgagtataaaaaaggatacctagatcaagcgagtggaggggcagttcttcagctgaggcctaacgaccaagtctgggtgcagatgccatctgaccaggctaacgggctctactcgaccgagtatatacactcctcctttagtggatttctcctgtgtcctacttag

SEQ ID NO: 4710 - DNA, 2112 bp, Artificial Sequence
  Description of Artificial Sequence: Synthetic coding sequence
atgctgggcacgttaactcctctttcttcactcttactgctgctgctcgtactcgtgctgggctgcggcccacgcgcaagctctggcggaggggcagggggtgccgcaggctatgctccagttaagtacatccagccaatgcaaaagggacctgtgggccctccttttcgggagggcaaagggcagtacctggaaatgcccctgccccttctgcccatggacctgaaaggcgagcccggacctccagggaaaccaggcccaagaggcccaccgggaccaccaggatttcctgggaagccgggaatgggaaagcccggtttgcacggtcagcccggtcctgctggaccccctggcttctctcgtatggggaaggcaggccctcccggactgcctggtaaagttggcccacctggacagcccggactgcggggagagcctggtatcagaggcgaccagggattacgaggacccccaggccctccgggattgcctggcccaagcggcattaccatccctggcaaacctggcgctcagggagttcccggtcccccaggcttccaaggggaaccgggacctcagggagagcctggcccaccgggagacagaggcttgaaaggggacaatggcgtcgggcagcccggtttgcccggtgccccagggcaaggcggtgccccaggacctccgggacttccaggccctgctggcttgggaaagcccggtctcgacggcttacccggagcaccaggcgataagggcgaatctggcccacccggagtcccaggccctaggggtgaacctggcgcagtcggtcctaaggggcctccaggggtggacggagttggagtgccgggtgccgctggactgcctggcccacaaggcccttcaggggctaaaggcgaacccggaactcgcggacccccaggcctcattggtccaaccggatacggcatgcccggtctccctggacccaagggtgaccgtggcccagctggcgttccagggctgctcggagataggggagagccaggggaagacggggagccaggcgagcaagggcctcagggcctgggcggtccccctgggctgccaggctcggcgggtctgcctggtcgtcgaggccctccagggccaaagggagaagcgggacccggagggcctccaggcgtaccaggaattaggggcgatcaaggtccttctggactggcagggaagcccggagttccaggggaaaggggcctgcccggagctcacggcccaccgggaccaacggggccaaaaggggaacccggtttcacaggacgacccggaggcccaggcgtggcaggagcgttgggacagaagggagacctgggtctgcccggacagcccggactaaggggaccttcaggcatccctggattacaaggccctgcgggtccaatcgggcctcagggactgcctgggctcaaaggcgagcccggtttgccagggcctcccggagagggacgcgctggtgagcccggaaccgcaggaccaaccggacctccaggggtgcccggaagtcctggaataacaggtccgccagggcctccgggtccccctggccctccgggagctccaggagcttttgatgagactggtattgccggtctgcatctcccaaatggtggcgtggagggcgcagtgcttgggaagggaggaaaaccccagtttggactgggggagcttagcgcccatgccacccctgcctttacagccgtgctcacaagccccttcccagccagcggaatgcctgtgaaattcgatcgaaccttatataacgggcatagcggctataatcctgctaccggcatatttacatgtcctgtgggcggtgtttactactttgcataccatgtacatgtaaaaggcacgaatgtttgggtcgcactgtacaagaataacgtaccagcgacgtatacttacgatgagtacaagaaggggtatctcgatcaagcttccggcggtgccgtgctgcagctgcgaccaaatgatcaagtctgggtccagatgcccagcgaccaggcgaatgggttatacagcaccgagtacattcactcttccttttccggcttcctgctttgcccaacttag

SEQ ID NO: 4711 - DNA, 1917 bp, Artificial Sequence
  Description of Artificial Sequence: Synthetic coding sequence
atgccactgcctttactcccaatggacctgaagggcgagccaggtccacccggaaagcccggaccacgtgggccacccggaccgccaggctttccgggaaagcccggaatgggcaaaccgggtttacacggtcagccaggtccggctgggcctccgggattcagccggatggggaaggccggaccaccagggctgcctggaaaagttggtccacccggtcagccgggtttaaggggggagcctggaattcggggtgaccagggactgaggggtcctccgggaccacctggcttaccgggaccatccggaattaccatccctggaaagcctggagcccaaggagtgccaggtcccccagggtttcaaggcgagccagggccacagggagagcctggacctccaggggaccggggtttgaagggcgataacggcgtaggtcagcccggactgcctggtgcccctggccaggggggagcaccaggacccccaggactgccaggcccagccggtctgggcaagcctggcctcgatgggttgccaggggctcccggtgacaaaggggagtccgggccacccggagtcccaggtcccaggggggagcccggagcggtcggacccaagggtcctcccggagtagatggcgtgggtgtcccaggcgctgctggtttgcccggacctcagggacctagcggcgcaaagggagagcctggcacgcgagggcctccaggcttaatcggtcctaccgggtatgggatgccaggactcccgggaccaaaaggcgatcggggtcccgcaggagtgccaggccttctgggtgacagaggagaaccaggggaggatggagaaccaggtgaacagggccctcaaggcctcgggggaccgcctggcttgcctggtagcgccggactccccggaagacgagggcctccaggccctaagggcgaagctggccctggaggccctcctggtgttcctgggattcgaggcgatcagggtcccagtggtttggctggtaagcccggagtcccaggggagaggggactcccaggggctcatggaccaccgggaccgaccggacctaaaggcgaacccggattcacaggcagacctggtggtcctggggtggccggagccctaggacagaagggagacttggggctccccggacagccaggcctccggggaccctcaggaatcccaggtttgcagggccctgccggaccgattggccctcagggattgcctggtcttaaaggcgaaccaggcctccccggacccccaggtgagggacgggcaggtgagccaggaacagccggacctaccgggcctcctggagttcccggtagtcctggcattaccggcccaccgggaccccctggtccgccaggcccacctggggctccaggagcttttgatgagactggcatcgccggactgcacctccccaatgggggtgttgaaggggcagtgttgggaaagggtgggaaacctcagtttggtctgggggagttgtctgcgcacgcaacgcccgcattcacggccgtgcttacgtctccatttccagcttctggaatgcctgttaaatttgaccgcaccttgtataacgggcacagcggctacaatcccgcaactggtatctttacatgtcctgtggggggagtttactactttgcttatcatgtccatgtgaagggcacgaacgtgtgggtggccctgtataagaacaatgtacctgctacgtatacttacgacgagtacaagaaaggatacctggaccaggcgtctggcggagccgtgctgcagttgcggccaaacgatcaggtgtgggtgcaaatgcctagcgaccaggccaatgggctctattcaactgaatacattcactcatctttctctgggtttttgctctgccctacctag

SEQ ID NO: 4712 - DNA, 2043 bp, Artificial Sequence
  Description of Artificial Sequence: Synthetic coding sequence
atgttgccccaaatacccttcctgcttctcgtttcactcaatctggtccatggcgtcttctatgcagagagatatcagatgcccactggaattaaaggcccattgccaaacacaaaaacccagttctttatcccgtataccatcaagagtaagggtatagccgttcgcggagaacagggcactcccggtcccccaggcccagcaggccctcggggacacccaggtccctcgggccctcccggtaagcccggatacggcagccctggactgcagggcgagcccggactccctggtccccctgggccaagtgcagttggcaagccaggcgtccctggactgccagggaaaccgggtgagcgcggaccttatggaccgaaaggggatgttggccctgcaggattaccgggaccgcgaggaccccctggaccacctggcattcctggtccggctggtatctccgtccccggaaagccgggacaacagggtcccactggagcaccgggacccagaggattccccggagagaagggcgcacctggagtcccaggtatgaatggccagaagggggaaatgggctacggagcccctggcaggcccggtgagagaggtttgcccggtccccaggggccaactggcccatccggccctcccggagtgggtaagcgcggagaaaatggggtgccagggcaacccggtataaagggtgaccggggttttccaggcgaaatgggccctattggcccaccgggtccacagggacctcctggcgagaggggtcctgagggcataggtaagccgggagcagctggtgcaccaggccagcctgggataccagggacaaaggggctgcctggggctcctggcatcgcaggtcctcctggcccacccggtttcggaaagccgggactgccagggttgaaaggtgagaggggacctgcgggactcccaggtggcccaggagctaaaggcgagcagggtcccgctggcctgccgggaaagcctggactaaccggacctcctggtaacatgggcccacagggaccaaagggcatacctggatcgcatggacttccagggccaaagggggaaacgggacctgctggtccagctggctaccctggtgctaaaggcgaacgagggtcaccaggatcagatggcaaacctgggtatcccggaaagccaggattggatggccctaagggcaaccccggtctccctgggcctaagggcgacccgggagtggggggacctccaggacttcccggtccggtcggacctgccggagccaaggggatgccgggacataatggtgaagctggccctcgcggagcccctgggattccagggacgcgtgggccaattggccctcctggaatcccaggctttcccggttcgaagggggatccaggttctcccggtcccccaggacctgctggaattgccacaaaagggcttaatgggcctacgggaccacctggacctccaggccctcgcggtcattccggagagcctggcctccctggccctccaggccctcctggcccacccggtcaggctgtgatgcccgaaggttttattaaggcaggacaacgtccgagtctgtccggaacccctctcgtctcagctaaccaaggggtgacgggcatgccggtgtctgcctttactgtgatactctcaaaagcatacccggcaattggcaccccgatccctttcgataagattttatataataggcaacaacactatgacccccgaacgggcatctttacatgccagattcccggaatctactacttcagctaccacgtgcatgtcaagggcacccatgtctgggttggcctgtacaaaaacggcaccccagttatgtatacctacgacgagtacaccaagggctatcttgatcaagcctctggcagcgcaatcatcgatttaaccgaaaacgaccaagtatggctccagctgcctaatgcagagagcaacggactgtacagcagcgagtacgtacatagtagcttctccggttttctcgttgcccctatgtag

SEQ ID NO: 4713 - DNA, 2043 bp, Artificial Sequence
  Description of Artificial Sequence: Synthetic coding sequence
atgcttccacaaatccctttcctgctcctggtatctttgaacttagtgcatggagtcttctatgccgaaaggtatcaaatgcccaccggcattaaaggcccattgccaaacaccaaaacacagttttttattccttacacgatcaaatcaaaggggatcgccgtgagaggagagcagggcacccctggaccccctggtcctgccggacctcgtggccacccaggcccatccgggccacctggtaagcccggttacggatcccccggattgcagggcgagccagggctgcctggacccccagggcctagtgcggtggggaagcccggtgttcctgggctgcccggaaagcccggagaaaggggcccttacggaccaaagggcgatgtgggacccgctggtctgcccggtcccaggggacctcccggaccaccaggtattcccggacccgcagggatttccgtccctggaaagccaggccagcagggtcctacgggcgcaccgggtcccagaggcttcccaggtgagaagggcgctccgggagtccctgggatgaatggccagaaaggggaaatgggttatggagctccaggcagacctggcgagaggggcttgcctgggccacagggacctacaggccctagcggccctccgggtgttggcaaacgaggcgagaacggtgtgccaggccagccaggcatcaaaggcgacagaggatttcccggtgaaatggggcctattggaccacctggcccacaaggccctcctggcgaaagaggacctgaaggcattggcaagccaggcgcagccggtgcgcctggacagccgggtatcccaggcaccaagggtctacctggtgctcctggtatagcaggccctccaggcccacccggtttcggtaagcccggactgccagggctgaaaggcgagaggggccctgcaggactaccaggcggaccaggggcaaaaggcgagcaagggccagcgggactgcctggcaagccgggactcaccggaccaccagggaatatgggaccccagggccctaaaggaatacctgggtcccacggacttcctggacctaaaggcgaaacgggaccagccggacctgccggttatcctggagccaaaggtgaaagaggttcccccggatctgacggaaaacccggttatccaggtaagcccggtctcgatggacccaagggtaaccccggtctccccggtccaaaaggtgacccaggcgtcgggggtcctcctggactccccggtccagttggtcccgcaggcgcaaagggaatgcctggacacaacggagaggccggacccagaggggctccaggcatccctgggacgaggggacccatcggcccacccggaataccgggattcccaggcagcaaaggagacccaggcagccctggtcctcccggtccagccggtatcgccacaaaagggctaaacggtccgaccgggccacccggtccacctggcccacggggtcattccggagagccgggtctccccggtccaccaggtcccccagggccaccgggacaggcggttatgcccgaaggcttcattaaagctggccagaggccatccctctccggaacaccactcgtgagcgccaatcagggcgtgacggggatgcctgtgagtgcatttacagttattcttagcaaagcataccctgctataggcacacctatcccatttgacaagatattgtacaatcgccagcagcattacgatccccgaaccgggatcttcacatgccaaattcccggaatatactactttagctaccacgtccatgtcaagggcactcacgtttgggtaggtctttacaaaaacgggacacctgtgatgtatacttacgacgagtatactaaaggctacctggaccaggcatccggttccgccattatcgacttaacggaaaacgaccaggtttggctacagctaccaaacgccgagagcaatggtctctacagctctgagtatgtgcattcatctttctctggcttcctggttgcgcctatgtag

SEQ ID NO: 4714 - DNA, 156 bp, Artificial Sequence
  Description of Artificial Sequence: Synthetic coding sequence
atgctcccccaaatcccatttctgttacttgtgtccctcaacctggtccacggggttttttatgccgagcgctaccagatgcctaccggcattaagggaccactccccaacacgaagacccaattttttattccatacacgatcaagtcgaaatag

SEQ ID NO: 4715 - DNA, 651 bp, Artificial Sequence
  Description of Artificial Sequence: Synthetic coding sequence
atgctgccacagatcccttttctgctgctggtgagtctcaacttagtgcacggggtgttttatgcagagcggtaccagatgccaacaggaattaaagggcctctgcctaacaccaagacacagttttttatcccttacacaatcaagagtaaggggatcgccgtcaggggtgagcaggggacccccggacctcccggtcctgctgggccacgtggccatcctggcccaagtggtcctcctggcaaacccggttacgggagtccgggactccagggggaacccggattacccggtcccccaggcccaagcgctgtggggaaacccggtgtgcctggattacccggtaagcccggagagcgcggtccgtatggcccaaagggcgatgttggcccagcaggcttgccaggaccacgcggacctccaggtccccctggaattccaggccctgcaggaatttctgttccgggtaaacctggacaacagggaccaaccggcgctcccggacccagaggcttccccggagaaaaaggcgctccaggggttccaggtatgaacggccaaaagggagagatggggtatggcgctcccggtcgcccaggggaacggggactaccgggacctcagggcccaacggggccatctggaccatag

SEQ ID NO: 4716 - DNA, 5211 bp, Artificial Sequence
  Description of Artificial Sequence: Synthetic coding sequence
atggaaagatgttcacgatgtcatcgcttgctgctgctccttcctcttgtgctgggcctgtcggccgcacctggctgggctggtgctcccccagtggacgtacttagggcattacggttccccagtctgcccgacggcgtgagacgagcgaaggggatttgccccgctgacgtagcataccgagtggccagaccggctcagctgagcgcgcctacacgtcagctgttccccggaggtttccctaaggacttctccttgctgacggtagttaggacaagacccggtttgcaggctccgttgctgaccctctatagcgctcagggtgtcagacagcttggtctagagctggggaggccagtgaggttcctgtatgaggaccagaccggccgaccacaacccccaagtcagccagtgtttcggggattgtccctggcagatgggaaatggcatcgagtggccgttgccgtgaaggggcagagcgtgactctgattgtcgactgcaaaaaaagagtgacgagacccctgccaagatccgcccgtcctgtcctcgatacccacggagtcatcatcttcggggctagaatccttgacgaggaggtgttcgagggcgacgttcaggagctggccattgtgcctggagtgcaggctgcttacgagagctgtgaacagaaagaactggagtgcgagggcggtcagagagagcggcctcagaatcaacagccccaccgggctcagcggtctccccagcaacaaccgagcagactgcatcgaccacagaatcaggagccacagtctcagcctacggagtcactgtactacgattacgagcccccttattatgatgtcatgacaactggaactacacccgactaccaagaccctactcctggtgaggaggaagaaatcctagaatcctccctactgccacctctcgaagaagagcagaccgacctccaggtaccaccaactgccgacaggtttcaggccgaagaatacggcgaaggaggcaccgacccgccagaaggcccatatgactatacatatggctacggtgacgattacagagaggaaaccgaactgggcccagccctgagcgctgaaactgcacatagcggcgctgcagcccacggccctagaggcctcaaaggagaaaagggggagccggcagttctcgaacccggaatgctggtagagggcccaccaggacccgagggccctgcaggcctgatcggccctcctggcatacagggaaaccccggtccagttggtgatcctggagagcgcggacctccgggaagagcgggtctgcccggttctgacggtgcccctggtcccccagggacctctctaatgctgcctttcagattcgggagtggcggtggcgacaaagggcctgttgtggccgcacaggaggcccaggcacaagccattctccaacaggcccgactggcgctgagaggcccacccggacccatgggatatactggcagaccgggaccactgggccaacctgggtcacccggtctgaagggtgaatccggcgacttgggccctcaggggcctcgcggtccccaaggcctgaccggacctcccggtaaagccggtaggcggggtcgagccggtgctgacggggctagagggatgccaggagaccctggggtgaagggtgaccgcggttttgatggcctccctggccttcccggagaaaaaggacacaggggcgacaccggcgcacaaggcctcccaggtcctccgggagaagacggggaacggggagatgacggtgaaatcggccctcggggtttaccaggagagtctggcccacggggtctgctcggtccaaaggggcctcccggtatcccgggaccgcctggcgtcaggggcatggacggaccccaaggccctaagggctccctgggtcctcaaggggaacctggccctcccggacaacaagggacacccggtacccagggcctgcctggccctcaaggtgcaatcggtccacacggcgagaaagggccacaagggaagcccggtctgcccggaatgccgggtagcgacgggcctccaggccatcctgggaaggaagggccacctggcaccaaggggaaccagggacccagcggaccccagggacctctgggctatccgggtcccagaggagtcaaaggggtcgacggaatcaggggactcaagggacacaaaggggaaaaaggcgaagacggcttccccggattcaaaggagatataggagtgaagggagataggggagaagtgggagttcctgggtcacgcggagaggatggccctgaggggcctaagggtagaactggtcccactggagatcccggtccacccggattgatgggagagaagggaaaactgggagtccccggattaccgggataccctgggcgacaagggccaaagggcagtctagggtttcccggattccctggtgcttctggcgagaagggcgcacgaggcctgagcggcaagtccggacctcggggagaaaggggcccaaccggacccaggggacagcgtggaccgcgaggtgccactggaaagagtggtgcaaagggcacctccggaggcgatggtccccatgggcctccgggagagcggggactgcccggtcctcaaggaccaaatgggtttccaggcccaaaggggcctcccggaccgccaggaaaagacggtttaccaggtcaccccggacagaggggcgaggttgggtttcaagggaaaacagggccacctggacctcctggcgtggtcggcccacaaggtgcggcaggcgaaactggtccaatgggagagaggggccatccaggtccaccaggaccacctggagaacagggattgccaggtaccgcgggtaaggaggggacaaaaggggatcccggacctcctggcgcacccggtaaggacggcccagccggattacggggatttcctggggagagaggcctgccaggtacggctggagggcctggtctgaagggcaatgagggcccatctggtcccccaggccctgccggttccccaggtgagcgaggggctgcaggtagcgggggtcccatcggaccacctggcaggcctggccctcagggccctcccggtgccgctggagagaagggtgtccccggtgagaaaggtccaatcggtccgaccggcagagacggagtgcaggggcctgtggggcttcccggtccggctgggcctcccggtgtcgctggtgaagatggggataagggggaagtgggagacccaggccaaaagggtaccaaagggaacaagggcgaacacggccctcctggaccccctggccctataggccctgtgggccagccgggagccgcaggggctgacggcgagccaggcgctcgcggacctcaaggccatttcggagcgaaaggagatgagggtactcgaggtttcaatggcccacccggtcctatcggtcttcagggtttgcctggaccttctggagaaaagggggagaccggagacgtgggccctatggggccaccgggaccgcctgggccacgtggacccgctggaccgaacggtgccgatggcccacagggtcctcctggcggagttggtaacctcggcccacctggagagaaaggggagccaggcgaaagtgggagcccgggaatccagggcgaaccgggagtcaagggtcctagaggggagcgcggagagaaaggcgaatcaggacaacccggagaacccggaccacccggacctaagggccctactggtgacgacggacccaaggggaaccccggtcctgttggttttccaggcgatccgggaccgccaggggagggcggaccacggggtcaggatggagccaagggagacagaggcgaggacggggaacccggtcagcccggatcacctggcccaaccggcgaaaatggccctcccggtcccctcggcaaacgcggaccagccggatctcccggaagcgaaggacggcagggagggaagggggctaagggggaccccggtgccattggggcacccggtaagacagggcctgtgggtcctgcaggacccgctggtaagccgggtccagacgggttacgcggtctcccagggtccgtaggacaacagggcagacccggtgcgaccggccaggcaggaccccctggcccagtgggccctcctggcctccctggtctgaggggtgatgccggagcaaaaggcgaaaagggccatccgggacttataggcctgattgggccacctggagagcaaggagagaagggcgatcggggtctgccgggtccccaaggatcacccggacagaaaggggagatggggattcccggagcgtccggtcctattgggccaggcggacccccaggtctgccaggacccgcagggcctaagggggctaagggagccactggaccaggtgggcctaagggggagaaaggagtccagggaccacccggacatcctggaccaccaggggaggtgatccagccattacctattcagatgcctaaaaagacacgacggtccgttgatggttctagactcatgcaggaggacgaggctataccgacagggggagccccaggcagtcccggaggactcgaagaaatctttggctccctcgactctctgagggaggagatagagcagatgaggcggccaacaggcacccaggacagtcccgctcgaacttgtcaagacctgaaactctgccacccggaactgcccgacggcgagtattgggtggacccaaaccagggttgtgctcgcgatgcttttcgtgtcttctgcaactttaccgctggcggagaaacttgtgtgactcctagagatgatgtgacccagttttcttacgtagactcggagggatctcctgtgggggtcgtccagttgaccttcttacgcttgctgtcagtgtcagcccatcaggacgtgagttatccttgctccggcgcagcccgtgatggtccccttcgactgcgcggagccaatgaagacgagctttcccccgaaactagtccctatgtgaaagaattcagggacggttgtcagacacaacagggccgaacagtacttgaggtgcgaacccccgtgctggagcagctacccgtgttagacgcatcatttagcgatcttggcgctccaccccgtaggggaggcgtgctgcttgggcctgtgtgcttcatgggctag

SEQ ID NO: 4717 - DNA, 5148 bp, Artificial Sequence
  Description of Artificial Sequence: Synthetic coding sequence
atggaacgctgctctcgatgtcaccgactgcttcttctactccctttagttctgggattatcagctgcaccagggtgggctggtgcaccgcctgttgatgtgttgagggcacttcggtttccttctctgcctgacggtgtgcgccgagctaaagggatttgcccagcagacgtggcttatagggtcgcacgacctgcccagttgagcgctccaacccgccaactgttccccggtggctttcccaaagatttcagcctactaacagtcgttagaacccgtcctggacttcaagctcccctactgacactctattctgctcagggggtccgacaactgggactcgaattagggagacctgttcgcttcttgtacgaggatcagacgggccgaccgcagccaccgagtcagcccgtctttaggggccttagcctcgccgatggaaaatggcatcgcgtggctgttgcggtcaaaggccagagtgtcaccctgatagtggactgcaagaaacgtgtgacccgtcctctcccccgttctgcgagacccgtcctcgatacacatggtgtgatcatttttggcgcaaggattctggacgaggaggtgttcgaaggagatgtgcaggaactcgcaatcgttccaggtgtccaggcagcctacgaatcttgcgaacagaaggaactggaatgtgaaggcggacaacgagaacggccacagaaccagcagccccaccgagcacagcggtctcctcaacagcagccctcaaggcttcaccgccctcagaaccaagagccccagtcgcagccgacagaatcactttattacgactatgagccgccttactacgacgtcatgactacaggaacaacccctgattatcaggagcagacagatcttcaggtacctcctactgccgaccgcttccaggcagaggagtatggcgaaggcggaaccgatccacctgagggtccctatgactacacatacggatatggggacgactacagagaggaaaccgagctgggacccgctctgtctgcagagacagctcattctggagctgctgcccacggccctcggggattaaaaggagagaaaggtgaaccagctgtgctggagcccggtatgttagttgagggcccaccaggtccagagggacccgctggcttgatcggccctccgggaatccaggggaaccccggaccggtcggggacccaggagagcggggaccacccggaagagctggactcccagggtccgacggagccccaggtccacctgggactagccttatgctgccttttcgcttcggctccggcggaggtgacaagggcccagtggttgccgctcaggaggcacaagcacaggccatcctgcagcaggcgcgtctggcattgagagggcctccaggccctatggggtacaccggacgtccagggccactagggcaaccagggagcccgggactgaaaggcgagagcggggatctggggcctcagggccctcggggtccccaaggccttaccggtcctcccggaaaggcgggaagaagaggcagagctggagccgacggcgcaagaggaatgcctggtgacccaggcgtaaagggtgaccgcggattcgatggactccctggccttcccggagagaaagggcaccgaggtgacacaggagcccaaggcctgcctggccctccaggagaagacggtgaacgcggagacgacggggagattggtcccagaggcctgccgggagagagtgggcctcgtggccttctggggcctaaggggcctccgggtatacctgggccaccaggggtgagagggatggacggcccacagggacccaaaggaagtctcggtccacagggagaacccggtccccctggtcaacaaggtacccctggtactcagggtctcccaggtccacagggggctatcggccctcatggtgaaaagggccctcaaggcaaaccgggtttacccggaatgcctgggtccgacggtcccccaggccatcccggaaaagaagggcctcctggcaccaagggcaaccaaggtccgagcggtccacaaggtccattaggatatcctggtcccagaggcgtcaagggggttgacggaatcagggggctgaaaggtcataaaggggagaaaggagaagacggatttccgggattcaagggagacattggggttaaaggtgaccgaggggaagttggggtgcctggcagtaggggtgaggatggacccgagggccctaaggggagaacaggacccactggcgaccctgggccacctggcttgatgggagagaagggaaagctcggcgttcccggattgcccggatatcctggcagacagggcccaaaaggatcactcggttttcccggtttccccggtgccagcggagagaaaggcgcaaggggactttccggcaaaagtggtccacgcggagaacggggacccaccggtcccagaggtcagagaggaccaaggggcgctactggaaagtcaggagctaagggaacctctggcggtgatggccctcatggtccgccaggcgaacgagggcttccgggaccacagggcccaaacgggtttccgggaccaaagggtcccccaggccctcctggaaaagatggcctgcctggacacccagggcaaagaggcgaggtcggctttcaaggaaagacagggcctccgggtccccctggcgtagtcgggccacagggggcagctggcgagaccggacccatgggagagcggggtcatccaggacctcccggaccccctggagagcagggattgcccggtacagccggaaaggaagggactaaaggcgatcctggccctccaggcgctcctggtaaagacggcccagctggactgcgcggattcccaggggaaaggggactcccaggcaccgccggtgggcctggacttaagggcaacgaagggcctagtggtccgcctgggcctgcagggtctcctggagagcgaggcgctgcaggttcaggcggaccgattggtccacctgggagacctgggcctcagggtcccccaggagcagctggcgagaaaggcgttcccggagaaaagggccctattgggcctaccgggcgagacggtgtacaaggaccagtgggtttgccaggcccagcaggacctccgggagtggccggagaggacggtgataaaggggaggtcggagatccgggtcaaaaggggacaaagggtaataagggcgagcacggccctcctggcccaccgggtccgataggacctgtgggccagccaggtgcggctggtgcagatggagagcccggagcgagaggcccacagggacacttcggagccaagggggatgagggcacaagaggatttaatggaccacccggaccgattggtctgcagggactgcccggaccaagtggtgaaaagggggaaaccggcgacgtaggaccaatgggcccaccgggaccccctgggccacggggaccagcaggtccaaacggggctgacggccctcaggggccaccaggtggagtggggaatctggggcctccaggtgagaagggcgaacctggtgagagcgggtccccgggtattcagggcgagcccggagttaaagggcctcgcggagagcgcggagagaaaggcgagagcgggcaacctggagagccgggtcctccgggacccaaaggcccaacaggtgatgacggtccgaaaggaaatcctggtcccgtcggcttcccgggagatccgggacccccaggagaggggggtccccgtggacaagacggcgctaaaggagatagaggagaggacggagaacctggtcaacccggtagccctgggccaacaggcgagaacggaccacccggaccccttgggaaacgagggcctgcaggttctccaggcagcgaaggccgacaaggcggaaagggggcaaagggcgaccccggtgctattggcgctcctggtaaaaccggtcctgtagggccagccggtccagcaggcaagcccggacccgatggtctgcggggactccccggtagtgttggccaacaaggacgccctggggcaaccggccaggctggtccacctggaccagtgggaccgcctggcttgcccggtctgcggggtgacgctggggcaaagggagaaaaaggccatcctgggctcattgggctcatcggaccacctggtgagcagggagagaaaggggatagaggactaccaggcccacaggggtcgccgggacagaagggcgaaatggggatccccggagcttccggcccaatcggacccggtggaccacccggactgccaggcccagccggtcctaaaggagccaagggcgcaaccggtcctggcggaccaaaaggtgagaagggggtccagggccctcccggacatccgggtcctccaggggaggtgatacagcctctccctatacagatgcccaagaagacacgacgatccgttgatggatcccgtttgatgcaggaagacgaagcaattcccaccgggggtgcacccggatcaccgggaggtctcgaagaaatcttcggcagcctagacagtctgagggaagaaattgagcagatgagacgaccaactggaacgcaagattcacctgccagaacctgccaggatctgaaactgtgtcaccctgagctgcccgatggtgagtactgggtcgatccaaatcagggatgtgcaagggatgcatttcgggtcttctgtaacttcacagcgggaggggagacctgcgtcacccctcgggatgacgtgacgcagttttcctacgtcgattcagagggttcacccgtgggagtcgtacaattgacgtttctgagattactctcagtgtccgcccatcaggatgtttcatacccatgcagcggagcggctcgtgacggccctttgcgcctgcggggagctaacgaagacgagctgagccctgagactagtccatacgtcaaagagttccgagacggttgccagacacaacagggtaggactgtgctcgaggtgagaacacctgtcttggaacagctgcctgtccttgatgctagcttctcagacctcggggcacccccacgcaggggcggtgtactgttaggccctgtttgttttatgggatar

SEQ ID NO: 4718 - DNA, 4890 bp, Artificial Sequence
  Description of Artificial Sequence: Synthetic coding sequence
atggagagatgctcacgatgccacagactgcttctccttctccctttagtgctggggttgtctgctgcccctggatgggccggtgcaccaccggtggacgtcctgcgggctctacgattcccgagcctcccagatggggttaggagagccaaagggatctgtccagctgatgttgcttatcgggtcgctcgacccgctcaactgagcgcccctaccaggcagctattccccggagggttcccaaaagattttagcttgctgacagtcgtccggactcgaccagggttacaggctcctctgctcaccttgtatagcgcccagggggtgcgtcaattagggctggagctggggagaccagttcggtttctctatgaggaccagaccggacgacctcagccaccatctcagccagtctttaggggcctcagcctggctgacggcaagtggcatagagtggccgtggcggtgaagggacagtctgtgactttgattgtggactgtaagaagagagtgactagaccccttcccaggtcagccaggccagtgctcgatacacatggcgtgatcatcttcggagctaggatactggacgaagaagtgttcgagggcgacgtccaggagctcgctatcgtaccgggtgtgcaggctgcctacgaatcctgcgagcaaaaggaactggaatgcgaaggcggacaaagggagcgtccgcagaaccagcaaccccatcgggctcaaaggtcaccacaacagcagccgtctaggctgcatcggccacagaatcaggagccgcagagtcaagctgcgcacgggccacgagggttgaaaggggaaaagggcgaaccagctgtgctcgaaccaggcatgctcgtcgagggtccgcctggaccggaaggcccagccggactgattgggccacccggtatacagggcaacccaggtcctgtaggcgaccccggtgagcgcggtccaccgggacgcgctggcctccccggatccgacggagcacccggtccccctggtactagtttgatgctgcccttccgattcggtagcggcggtggggacaagggccctgttgtggccgctcaggaagctcaggcccaggcgatcttacagcaggcccgattggctttgcgaggtccacctggcccaatgggttacaccgggaggccgggtccacttggccaacccggttccccaggtctgaaaggagaaagcggcgatctcgggccacaaggtcccaggggaccgcagggtcttacaggcccacccggtaaagcaggcaggcgcggaagagcgggagcggacggcgcaagaggaatgcccggtgatcccggagtgaaaggggacaggggtttcgacggcctaccaggactgccgggtgaaaaaggccataggggcgacaccggagcccagggcctaccagggcctcctggggaagatggtgagaggggggatgacggggagatcgggcctaggggactgccaggtgaaagcggacccagggggctactgggaccgaagggtcccccaggcatccccggacctccaggagtacgtggaatggatggcccacagggcccaaagggaagtcttgggcctcagggagagcccggaccacccggacagcagggcaccccgggtacgcaggggttgcccggtccacaaggtgcaattggaccccatggagagaagggcccacagggcaagccagggctgccaggtatgcccggatcggacggcccaccaggacacccaggaaaggaaggacccccaggaactaaggggaaccagggcccaagtgggcctcagggcccacttggttacccaggcccacgcggtgtcaaaggcgttgacggaattaggggactgaaagggcacaagggggaaaagggggaggacggctttccaggtttcaaaggggacataggcgtgaaaggagatcgcggtgaggtgggcgtgccagggtcgagaggagaagacgggccagaggggccaaaggggagaaccggtccaacaggagacccaggtcctccgggactgatgggagagaagggtaagcttggcgttccaggactcccaggatatccagggagacagggaccaaagggatcacttggctttccgggattcccaggcgcatccggcgaaaagggtgcgaggggtttgtcaggcaagtctggtcccaggggtgagcgtgggccaacggggccaagagggcaacgcggaccaagaggggctacgggcaagtcgggggctaaagggaccagcggtggcgacggtcctcacgggccacctggtgaaaggggcctgcccggtcctcaaggcccaaatggatttcccggtcctaaagggccacctggacccccagggaaggatggactccccggtcacccaggccagcgcggtgaagtgggctttcagggcaagacgggccctccaggcccacctggggtggtcggcccacaaggagcagcaggcgaaacaggccctatgggcgaaagaggtcatccaggccctcccggtcctcccggtgagcaggggctgccagggaccgccggtaaagaagggacaaaaggcgatcccggaccccctggagcacctggtaaagacgggccagccggactgcgaggctttcccggtgaaagggggctgccaggtacagctggaggaccagggctgaagggaaatgagggtcctagtggaccgcctggccctgccggtagccctggcgagaggggggcagccggtagcggtgggcctatcgggccaccaggtcgcccagggcctcagggaccacccggagccgcaggcgaaaagggagtccccggagagaagggtccaattggtcctacggggagggacggagtccaaggcccagtgggattgcctggccctgcagggcctcccggagtggcgggtgaggacggagacaaaggcgaagtcggcgatccaggccaaaaaggaaccaagggaaataagggggaacacgggccacccggtcctcctggtcccattggcccagtcggtcagcccggagctgctggagcagatggcgaacctggcgctagagggccacagggtcatttcggagcaaagggggacgagggcacacgaggatttaacggtccacccggacccattggacttcaaggactgcccggaccgtctggagaaaagggggagaccggagacgtcggcccaatgggaccaccgggaccacccggtccgagaggcccagcgggacccaatggtgccgatgggcctcagggccctccaggtggagtcgggaatctcgggccaccgggtgagaaaggggagcccggagagagcggatctccgggtatccaaggagaaccgggagtcaaagggcctcgaggcgagcgcggagaaaaaggagagagtggtcagcccggagagcctgggccaccagggcctaagggccctacaggggatgatgggccaaaaggcaatcctggccctgtggggtttccaggagatcctgggccacctggggagggcggaccacggggacaggacggcgctaagggcgataggggcgaggacggggagcctggccagccaggaagcccagggccaaccggagagaacggaccacccggacctcttggcaagaggggacctgccggaagccctggtagtgagggacgccaaggaggtaagggcgcaaaaggtgaccccggagcaattggagccccagggaagacagggcctgtcggtcccgctggcccagccggaaagccagggccagacgggcttcgaggactacccggtagcgtcggacaacaaggtcgcccaggtgcaactggacaggccggaccaccgggaccagtgggaccccctggtctgcccggattaaggggcgacgctggcgcaaagggagagaaaggacacccaggcctgataggtctcattggaccacccggagagcagggcgaaaagggcgacagagggttgcctggtccacaggggtccccaggccaaaaaggagagatggggattcctggggcttccgggcctatcgggccaggcggtccaccagggctacctggcccagccggacctaagggagctaaaggcgctactggacctgggggaccgaagggagaaaagggggtgcagggaccgccaggccaccccggaccaccaggagaggtgattcagccactccctattcagatgcccaaaaagaccagaagatccgttgacgggtccagactaatgcaggaagacgaggccatccctactggtggggctcctggtagtcctgggggattagaagagatcttcggatctctggactctctccgggaggagatcgagcaaatgaggcgcccaacaggtacccaggactcgccagcgagaacctgtcaagatttgaagttgtgccacccagagttgccagatggggaatactgggtggacccgaatcaaggatgtgcaagagacgccttccgtgtattctgtaatttcacggccggaggcgagacttgcgtgactccgagggatgatgtgacccagttctcatatgtcgactcagaggggagtcccgtgggggtggtgcagctgactttcctgcgattgttgagtgtctcagcacatcaggatgtgtcttatccatgctcaggtgccgcacgcgatgggcctctgcgcctgcggggagccaatgaagatgaactgtcacccgagacaagcccttatgtcaaggagttccgcgatggctgtcagactcaacagggaaggaccgtgttagaagtgaggacacccgtgctggagcagctgccggtcctcgatgctagcttttccgatctgggtgcgcctccccgaagaggaggcgtgcttctgggcccagtgtgcttcatgggttag

SEQ ID NO: 4719 - DNA, 4953 bp, Artificial Sequence
  Description of Artificial Sequence: Synthetic coding sequence
atggagagatgttccaggtgccaccggttattactcttgctgcctctggtcctagggctttccgccgcacctggatgggcgggtgcacccccagtcgatgtcttacgcgctctgcgattcccctctttaccagacggagtaaggcgggctaaaggaatctgccccgctgatgtggcataccgggtggcaaggccagcgcagctgtcggctccaacaagacagttgttccctggcggttttcctaaggatttcagcctcctgacagtagtgagaacccgccctggcctgcaagcgcctcttttaacactgtactcggcacagggtgtgcgtcaattggggttggaactgggcagacctgtgcgttttctttatgaggaccagactgggcgaccacaacccccatcgcagcccgtgttccgagggttaagcttagccgatggaaagtggcatcgcgtggcggtggccgttaagggccagtctgttactctcatcgtggactgcaagaaacgcgtgacgaggccccttcctcgctctgccaggccggtcctggatacccacggcgtcatcatatttggggcacggatcctggatgaagaagtctttgaaggcgacgtccaggagttggccatcgtcccgggtgtccaagcggcatatgaatcttgtgagcaaaaggaactggagtgcgagggagggcaacgcgagcgaccgcagaaccagcagccacaccgggctcaacgctctccccagcaacagccaagccgactccaccgcccacagaaccaggagccccagagccaggaccctacacctggtgaagaagaggagatactcgagtcttctctcctgccgccattggaagaggcagcgcatggtcctcggggacttaagggagaaaaaggggaacccgctgtgctggaaccaggcatgctcgtggagggccctcccggtcccgaagggccagccggtctcatcggaccgccagggattcaggggaaccctggtcccgtcggagaccctggcgagcggggtcctcctgggagggccggtcttcccggttcggatggggcacctggcccaccaggtacctctttgatgttaccattccggttcggaagcggaggaggtgataaagggccagttgtcgctgctcaggaggcccaggcccaggccattctgcagcaggctaggctggcattaagagggccacccggacctatgggatacactgggaggccaggccctctaggacagccaggctctccaggcctaaaaggagagtcaggggatctcggacctcaagggccaagggggcctcaagggctgaccggccctcccggaaaagcgggaaggcggggaagagccggtgctgacggagctcgtggcatgcccggtgatccaggggtgaaaggtgaccggggattcgacgggcttcccggactcccaggggaaaaggggcaccgaggggataccggagcacagggactgcctggccctcctggggaagatggtgaacgtggagacgacggggagatcggtcccagggggctgccgggagaaagtggtcctaggggtctactgggtccaaaggggcctcctggaattccagggcctcccggtgtgaggggcatggacggcccacagggaccaaaaggaagcttaggacctcagggggagccaggccctccaggccagcaggggacaccagggacccagggcctgcccggtccgcagggagcgatcggtcctcacggggaaaaaggccctcagggcaagcctggcctgcccggtatgcctggcagcgacggtcctccagggcatcccggtaaagaagggcctcctggaactaaaggaaaccagggccctagtggaccccagggaccgttgggctaccctggtccgaggggtgtcaaaggagtggacggcattcggggtcttaagggccacaagggggagaaaggtgaagacggcttcccgggatttaagggggacattggtgtaaagggggatcggggtgaggtgggcgtgcctggctctcgtggggaagatgggccagaaggcccaaaaggtcgtacagggcctacaggcgaccccggaccgccaggcctgatgggggagaaggggaagcttggagtgccaggactgcctggctaccctgggaggcagggccctaagggctccttaggctttcctggattccctggagcaagtggggagaaaggggcaaggggtctgagcgggaagtcaggacctcgcggagagcggggaccaacagggccacgcggacagcgcggtcccagaggagccaccgggaaatctggtgcgaagggtaccagcggaggcgacggtcctcacggtccacccggtgagcgcggactccctgggcctcagggtcccaacgggtttcctggaccaaaggggccaccagggccacctggcaaagacgggttacccggtcaccctgggcagagaggcgaggtgggttttcaaggtaaaaccggaccccctggacctccaggggtggtaggaccacagggcgcagccggtgagacaggaccaatgggcgagagaggccatcccggaccgccaggtccccctggtgagcagggcctgcccggaaccgccggaaaagaaggaacaaaaggcgatcccggaccaccgggagcccctggaaaggatgggcctgcgggactcagggggtttccaggcgaacgagggctgcccggtaccgctggaggcccaggtcttaagggcaacgagggtcctagcggaccaccaggacctgctggctctcccggtgagcgcggtgccgctggttctgggggacctatcggacctcctgggaggccaggtccccaagggccacccggagcagccggtgagaaaggagtacccggtgagaaggggcctatcgggcctaccggcagggatggcgtccaaggtcctgtcggcctgcccggtcccgctgggccacccggagttgcaggggaagacggcgacaagggcgaagttggagaccctggacaaaagggcaccaagggcaacaagggcgaacatggaccacccggacccccaggacctatcggaccggtggggcagcctggtgccgcaggcgctgacggcgagcccggtgccagggggccacaaggccatttcggggcaaaaggggatgaggggacaagaggatttaacggcccaccgggaccaatagggctgcaaggcctgcccggacctagcggagagaaaggcgagactggcgacgtgggccctatgggcccaccaggaccgcctggacctcgtggacccgcagggccaaatggagcggatggcccacaaggacccccaggtggcgtgggaaacctgggaccaccaggcgaaaaaggtgagcctggggaatcaggctcccccggaatccaaggagaacctggggttaaaggccctaggggagagcgaggtgaaaaaggcgagtccggccaacccggtgaaccagggccacccggtccaaaaggccctactggtgacgatggtcctaaggggaacccaggaccggtgggatttcccggagacccgggacctccaggagaaggcggaccccgtgggcaggatggcgctaaaggagaccgtggagaggacggtgaaccaggtcagcctggctctcccggtccaactggagagaatggccctcctggccctctgggtaagcgcggtccagccggatctcctggcagtgaaggaaggcagggaggcaaaggagctaaaggcgatcctggcgcaataggggctccaggcaagacagggcctgtggggcctgctggccctgcagggaagccagggccagacgggcttaggggactcccaggatctgtgggccagcagggtcgacctggcgctaccggtcaagctggtcctcccggacccgtgggacccccaggacttccaggcctccgaggcgacgctggcgctaaaggcgagaaaggacatccagggctgattggcttgattgggcctcctggggaacagggggaaaaaggtgatagagggttgcctgggccacaggggtctcccggacagaagggcgagatggggataccaggcgctagcggcccaattggcccaggtgggccaccagggctgccaggaccagctggacctaaaggtgcgaagggcgctacgggacctggtgggcctaagggagagaagggagtccagggacccccaggacatccgggaccgccaggggaagtgattcagcctttgccaatccaaatgcctaagaagactcggagaagtgtggacggcagtcggcttatgcaggaggacgaagccatacctacggggggagcgcctggaagcccgggaggcctggaagagatttttggttcactggattctctgagagaagaaatagagcagatgcggagacctactggaacacaagacagccccgcaagaacatgtcaagatctgaaattatgccatcctgaattgcccgacggtgagtactgggttgaccccaatcaaggatgtgcacgagacgccttccgcgttttctgtaattttaccgctgggggagagacctgcgtgacccccagagacgacgtcacacagtttagttatgttgattcagaaggatcccctgttggtgtcgttcagctgacctttctgaggctgttatccgtctccgctcatcaggacgtctcatacccatgcagcggggcagcccgtgacgggccactgaggcttcgaggggctaacgaagacgagttgagtcccgaaacaagcccctatgttaaggagttccgcgacggctgccagacccagcaagggaggactgtgctggaggtacgcacccccgtccttgaacagctccctgtcctggatgccagctttagcgacttgggcgctcccccaagacggggaggcgtactgctgggaccggtctgttttatgggctag

SEQ ID NO: 4720 - DNA, 4967 bp, Artificial Sequence
  Description of Artificial Sequence: Synthetic coding sequence
atggagagatgttcacgctgtcaccggcttctgctgctactgcccttagtcctgggcttaagcgccgctcctggttgggctggggctccaccagtggatgtactgcgagccctgcggtttcccagtctgcccgacggcgtgcggagggccaaggggatttgcccagccgacgtcgcctaccgggtggccaggccagcacagttaagcgcccctacaagacagttatttcctggaggcttcccgaaagatttcagtttgctaaccgtggtgcgtactaggcctggactgcaggcacctctgcttacgctttattcggctcagggggtgcggcaactcggactggaactggggagacccgttcgctttctgtacgaggatcagacagggaggccacagcccccatctcagccagtcttccgtgggcttagtttggcagacgggaagtggcatcgagtcgctgtggcggtcaaggggcagtcggttacgctgattgttgactgtaagaaaagagtgaccagaccactacctagatcagctcgtccagtcctggatactcatggtgtgatcatctttggcgctagaatcttagacgaggaagtgtttgaaggagacgtgcaggaactagccattgtgcccggtgtacaggcagcctacgaatcctgcgaacagaaggagctagaatgcgaagggggacagagggaacgcccacagaatcagcagccccaccgtgctcaacggagccctcaacaacagccgagtcggctgcataggcctcagaatcaggaaccgcaaagtcagccaaccgagtccctctattacgactacgagcctccatactatgatgttatgacaacggggactactcctgattaccaggctgctcatgggcctaggggcttaaaaggggaaaagggggagcctgccgttctagagccagggatgcttgtggaaggtcctcccggacccgagggtcccgcaggtttaattggacctcctgggatacaagggaatcccggacccgtaggggaccccggagagcggggaccccctggcagagcaggattgcccggttcggatggggcaccaggccctcccggtacgtccctgatgttaccttttcggttcggctcagggggaggggataagggccctgtggtggcagctcaggaggcccaggcacaggccatcctccaacaagccaggctagccctgaggggacccccaggacctatgggctacactggtaggccgggtcccctgggccaacctggctctccaggcctaaaaggagagtctggagacctcggccctcagggccctcgcggtccacaaggcttgacaggccctccaggcaaagctggaagaaggggccgtgccggagccgatggcgctaggggtatgcccggtgaccccggagtgaagggtgacagaggtttcgacggcctcccagggctacccggagagaagggtcatagaggggacacgggagcccaaggtctacctgggccacccggagaagacggcgaaagaggagatgatggcgagattggacccagaggactcccaggcgagtccgggcctcgcggtctgctaggaccgaagggccctcctggaattcccggtccaccaggagtgcgcggaatggatggccctcagggcccaaagggcagcctgggaccacagggagaaccagggcctcctgggcagcagggcaccccaggaacgcagggacttcctggtcctcagggcgctatcggcccacacggcgaaaagggccctcagggcaagccaggactgcctgggatgcccggaagcgacggaccaccagggcacccagggaaggagggaccacctggtacgaaagggaatcagggcccttcaggccctcaaggccctctgggttacccaggacccaggggagtgaagggggttgatggcatccgcggattaaagggtcacaagggggagaaaggtgaggatggtttccccggattcaaaggcgacatcggagtgaaaggagacagaggcgaggtcggcgtgcccggtagtcgcggagaagacggccctgagggcccaaagggaaggaccggtccaactggtgacccgggacctcctggcctcatgggagaaaaaggcaagctaggcgtgccaggtttgccaggttacccaggcagacaaggcccaaagggaagtctcgggttccctggtttcccaggcgcttcaggggagaagggggcacgcggattgagcggaaaatccggaccaagaggagaacgagggccaaccgggcctagaggacagagagggccacggggagctacaggcaaaagtggtgctaaagggacctctggcggagacggtccacacggacccccaggggaaaggggtctccccggaccccagggcccaaacggttttccgggaccgaagggacccccaggccctccaggaaaagatgggctaccgggtcatcccggacagcgtggtgaggtcggatttcagggtaagaccgggcctccgggtccccctggggtcgtcggaccgcagggggcagcgggagaaacgggccctatgggagaacggggtcaccctggacctcctggtccccctggagaacagggacttcctggaacggcgggtaaggaaggcacaaaaggggacccaggtcccccaggtgcgcctggcaaggacgggcctgccggtcttcgcggattccccggagagcgaggtctgcctgggacggccggaggacccggacttaaggggaatgaggggcctagcgggcctcccggacctgccggatccccgggagaacgcggtgccgcagggtcaggaggccctatcgggcctccgggtaggcccggtccacaggggcctccaggagccgcaggcgaaaagggcgttccgggtgagaaagggcctatcggacctaccgggagggatggagtgcagggccctgtgggtttgccagggcctgcaggcccacctggtgtcgcaggagaggatggggacaaaggcgaagtaggcgatccaggccagaaaggaaccaaagggaacaaaggggaacacggtccccctgggcctcccggacccatcggtcccgtcgggcaacccggagcagccggagcggacggagaacctggagctagggggcctcagggccacttcggtgcaaagggcgatgaagggacaagagggttcaacggcccaccaggtcccatagggctccaggggctcccaggaccttcgggcgagaagggggagacgggggacgtcggccctatgggaccacctggacctcctggcccacgagggcctgccggacccaatggtgcggacggaccacagggtcctcctggcggagttggcaaccttggccctcctggggagaagggagaacctggggagtcgggttcacccggtattcagggagagccgggtgtgaaagggcctcggggagaacggggagagaagggcgagagtggtcagcctggagaaccagggccaccgggtccgaaaggacccaccggagatgacggcccaaagggcaatccagggcctgtcggttttcctggagatcccggtccacccggtgaggggggacctcggggacaggatggtgccaagggagacagaggcgaagacggcgaaccaggtcagcctggctcacctggccctacaggcgagaacggcccacccggaccactcggaaagaggggccctgcgggttccccaggatctgaggggcgtcagggaggaaaaggcgctaaaggagaccccggtgccatcggggctcctggcaagaccggcccagtgggtcctgccggtccagctgggaagcccggtccagacggtctgcgtgggctacccggatccgtcgggcagcagggacggccaggggctaccggtcaggcgggtccccctggaccggtgggtccccctggcctgcctggactgaggggtgacgccggagccaaaggcgaaaagggccatccgggactgattgggctcatagggcctccaggagagcagggagaaaagggtgatcggggactgcccggtccacaggggtcccccggtcagaaaggcgaaatgggcatccctggcgcttccggtccaattggccctggagggcctcctggcctgccaggccctgcgggtcccaagggcgcaaagggagcaacaggtccagggggtccaaaaggcgagaaaggggtccaaggaccacccggacacccaggccctccaggggaggtcatccagccacttcctattcagatgccgaagaaaacccgcagaagcgtggatggttccaggctgatgcaggaggatgaagctatacccaccggtggcgcacctggatcccctggcggactcgaggagatctttgggagtctggactcgctgcgcgaagagatcgagcagatgcgcagacccactggcactcaggactcaccagcccgaacctgccaagatctgaaattgtgccatcctgaactgcctgacggagagtattgggtagatccgaatcaggggtgtgctagggacgcctttagggtgttctgtaattttacggctgggggagagacctgcgtcaccccaagagacgacgtgacacaattctcctacgttgattcagagggttcgcccgtcggggttgttcagctcacttttttaaggctgttatctgtgagcgcacatcaggacgtctcttatccgtgttctggcgctgctcgtgatggtcctttacggcttagaggcgctaatgaagacgaactgtcccccgaaacatcaccatatgttaaggaatttcgggatggctgccagacccagcagggacggacggtactcgaggttcgcacacctgtgcttgagcaactccccgtgctcgatgcctctttttccgatttgggcgcaccccctagaaggggaggagtcttgctgggccctgtgtgttttatgggtta

SEQ ID NO: 4721 - DNA, 5069 bp, Artificial Sequence
  Description of Artificial Sequence: Synthetic coding sequence
atggagaggtgcagccgttgccatcgcctccttttgctcctccccttggtactggggctgtctgccgctcccggatgggccggtgctcccccagtggacgtcctgcgcgcattgcgtttcccctctcttcccgacggggtgaggagagccaagggtatctgtcctgccgacgtcgcatatcgcgtggccagacccgctcagctgtccgctcccacaaggcagctgtttcctggaggattccccaaggatttttctttgttaacagttgtccgaacccgccctgggcttcaggccccacttctaacattgtactccgcccagggcgtcagacaattggggctggagctgggacggcctgtgagattcttgtacgaagaccagacaggtaggccccaaccacctagtcagcctgtgttcagagggctctccctcgctgacggcaagtggcatagggtcgcagtcgccgtgaaaggacagtcagttactctgatagtcgattgcaaaaaacgcgtcacaagacctttacccagaagtgccaggccggttctggatacacacggtgtgattattttcggtgccagaatactggacgaagaagtattcgagggagatgtgcaggagctcgcaatagtgcccggagtccaggccgcatacgagtcgtgtgaacaaaaagaactggaatgtgagggaggtcagagagagcgcccacagaaccagcagccacaccgcgctcaaaggtccccacagcagcagccgagccgcttacacagaccccagaaccaggagccccagtctcaggagcagactgacttgcaggtccctccgacagcggacagattccaagccgaggagtatggggaaggaggaactgatcctcccgaaggtccatacgactatacctacgggtatggcgacgactaccgagaggaaaccgagctcgggcctgctctttctgcagagactgctcacagtggggcagcagcgcatgggcctagagggctgaagggagaaaaaggtgagccagccgtcttggagcctggcatgcttgtcgagggtcccccagggcctgaaggtcctgccggtttgatcgggcctccaggcatacagggtaatcccggacctgtgggggaccctggtgagcgtggtccccctgggcgtgccggactgccaggatccgacggggctcctggcccaccaggcacctcattgatgttacccttccgcttcggaagcggcggtggtgataaaggaccggtggtggcggctcaggaggctcaggctcaggccatccttcagcaagcccgtctggccttaaggggtcccccaggccctatggggtatactggtagaccaggacctttgggccaacctggctcacccggactgaagggcgagtcaggagacctcggcccacagggtccgagagggcctcagggcctgacgggacctcctggaaaagctgggaggcggggacgagccggagctgatggagcgaggggtatgccaggagatcccggagtgaagggcgataggggttttgatgggctgcccggactccccggagaaaaggggcacagaggcgatactggcgctcaggggttacccggacctcctggagaggatggagaaagaggtgatgatggtgaaataggccctcgcggtctgcccggagagagcggtcctaggggcttgctggggccaaagggaccccctggcatacctggaccacccggagttagaggaatggacgggcctcaagggcctaaaggctccctggggcctcagggtgagcctggacccccaggtcagcagggcacccccggtacacagggtctgccaggccctcagggcgctatcgggcctcatggagaaaaaggccctcaggggaaacccggacttcctggtatgcctggtagcgatgggccacctggacaccccggaaaggagggcccacccggtaccaaaggtaaccagggtccatccggaccccagggccctctcggctaccctggccctagaggagtcaaaggtgttgatggaataaggggactcaaggggcataagggggagaaaggagaggacggttttccaggctttaaaggcgatattggcgtcaaaggcgatagaggagaggtcggtgtaccgggatctcgcggagaagacggacccgagggaccaaagggacgcactggtccaacaggagaccctggcccacctggcttaatgggcgaaaaaggaaagctaggtgtgcccggtctgcctgggtatccaggaagacaggggccaaaagggtccctgggcttccccggatttccgggagcctccggcgaaaagggcgcacgcggactcagcggcaaatcagggcctcgtggcgaacggggtccaacagggcctcggggacagcgagggccacgaggggcaaccggaaagtctggcgcaaaaggcacttccggcggagacggcccacacggtcctcctggggagcgcggattgccgggtccacagggccctaacgggttccctgggccaaagggtccgcctggtccccctggaaaggatggcttgcccggtcatcccggacaaagaggagaagtggggtttcaggggaaaaccgggcctcctggtcccccaggagtggtcgggcctcagggggcagcgggagagaccggacctatgggggaacgcggacatcctggccctcccggtccccctggagaacagggtttgcccggaacggcaggtaaggagggtactaaaggtgaccccggaccccctggcgctccgggaaaagacggcccagccggacttcgcggttttccaggcgagcggggtcttccaggaacagcgggaggacctgggctgaagggtaatgaaggcccttccggcccacccggtccggctgggtctcctggcgaacgcggtgctgctggttccggcggaccaatcggtcccccaggcaggccaggcccacagggtccgcctggggctgctggggaaaagggtgtgcccggagaaaagggtcctattggcccaacgggcagggatggggttcagggccctgtgggactacctggacctgccggtccacccggtgttgccggagaagatggtgacaagggcgaagtgggagaccccggacaaaaggggacgaaaggcaataagggagagcacggaccccctggtccacccggacccatcggtccggtgggccagccgggagctgccggtgcagatggggagccgggtgcacgtggtcctcagggccatttcggagctaagggagacgagggtacacggggattcaatggtccccctgggcctataggcctgcaagggcttccgggtcctagcggtgagaagggagagacaggggacgtggggcctatgggaccgcctgggccacccggaccaagagggccagctggcccaaatggtgccgacgggccacaaggtccgcctggcggagtgggcaaccttgggccacccggagagaaaggagagcccggtgagtccggctcacctggcatccaaggagagccgggagtgaagggacctcggggagaacgcggtgagaagggtgagagtggtcagccaggggagcctggcccacctggaccaaagggacccacaggagatgacggccctaaggggaaccccggaccagtgggctttcctggcgatcccggacctcccggtgaggggggtcccagggggcaggacggcgctaaaggtgataggggggaggacggcgaacctggacaaccaggctcccccggtccaaccggggaaaatggaccacctggtcctcttggaaagcgtggaccagcgggatccccaggtagtgagggccgacagggtgggaagggtgccaaaggcgaccccggagctatcggagcaccagggaagaccggtcccgtgggcccagctgggcctgcagggaagccgggaccagatgggctccggggtcttcctggtagtgtaggacaacaaggcagacccggagccactggccaagcgggtccccctggtcccgtgggtcctccaggcctgccgggtcttagaggagatgctggcgctaaaggcgagaaggggcacccgggtcttatcgggctgataggaccaccaggagaacagggcgaaaaaggagaccgtggtctgcccggtcctcaaggatcccccggacagaaaggggagatgggaattccaggagccagcggcccaatcggcccaggcggacctcctggcctgccgggtcctgctggtcccaagggcgcaaaaggagccacaggaccaggtggcccaaaaggggagaaaggtgtacagggccctcctggccacccaggaccacctggggaggtgatccagcccctccccatacaaatgcctaaaaagacccggaggtcagtggacggatcgcgtctaatgcaggaggatgaggccatacctacaggcggtgctcccggatcacccggagggctggaggaaatttttggtagcctggattccctgcgtgaagagattgagcagatgcggcgacctaccgggacccaggatagtcctgcccgtacctgtcaagatctcaagctgtgccacccagagctgcctgacggggaatattgggtggacccaaaccaggggtgcgcacgtgacgcctttcgggtattctgtaacttcactgcaggcggagagacatgtgtgactcctagagatgacgttacacaattctcctacgtggactctgagggaagtccagtcggcgttgttcagctaaccttcctgcggctgctctccgtgtcagcccaccaagatgtgtcatatccatgctccggtgcagccagagacggccctttgcgcctcaggggagctaacgaagatgaactgagtcccgaaacttcaccctatgtaaaggaattccgggacggctgtcagacccagcagggtaggaccgtgctcgaagtccgcactcccgtcctcgaacagctgccagtactggatgcatccttttcagacctgggagccccaccacgccgaggcggagtcctgctaggtccggtctgcttcatgggtta

SEQ ID NO: 4722 - DNA, 5132 bp, Artificial Sequence
  Description of Artificial Sequence: Synthetic coding sequence
atggaaagatgttctaggtgccatagattactgctgctccttccactcgtcctcgggctaagtgctgccccagggtgggccggagcgcctccagtggatgtgctacgcgcacttcgcttcccttctctgccggacggtgtacggagggctaaaggcatatgcccagccgacgtggcatatagggtggcccgtccagcacagctgtccgccccaacccggcaattatttcctggcggattcccaaaggatttcagcctgttaaccgtggttcgtacaaggcctggcttgcaggccccactcctgactctgtattctgcccaaggggtgcggcagttagggcttgaattgggcagacccgtaagattcctttacgaggaccagactggacgtccccagccacctagtcagccagtatttagagggctgtcgctggccgatggcaagtggcatcgagtagctgtagccgtcaaaggacagtccgtaaccttaattgtggattgcaaaaaacgagtgacacggcctctgcccaggtccgcgagacctgttctcgacacgcacggggtgatcattttcggcgctcgcatcctggacgaagaagtgtttgaaggcgacgtgcaggagttggctatagtccccggtgtacaggctgcctatgaatcatgcgagcagaaggagctcgagtgcgagggagggcaacgcgagcgcccacaaaaccagcagccacatcgggcacaaaggtcccctcagcagcaacccagccgcttgcacagacctcaaaatcaagaacctcagtcccaagatccaacacctggtgaagaggaagagatcctcgaatctagtcttctgcctccactggaggaagagcagacagatctgcaagtgccacctaccgcagacaggtttcaggcagaagagtacggagaagggggaacggatccccctgaagggccatacgactacacttacggatatggggacgactaccgtgaagaaaccgagcttgggcctgccctgagtgccgaaactgcccactctggcgcagctgcccatggacccagaggactcaagggcgagaaaggggagcctgctgtgcttgagccaggcatgctcgtcgagggccctccaggtccagagggcccagccggtcttatcgggccacctggtatccaaggaaatcccggacccgtaggagaccccggagaaaggggacccccaggtagagcgggactgcccggaagcgatggcgctccaggcccaccagggacatcgctcatgctgccctttagatttggctccggcggtggggacaaggggccagtggtggcagcccaggaagcccaggctcaggctattctgcagcaggccaggctggcgctacgtgggccaccagggcctatgggctacactgggaggcctgggcctttaggtcagcctggctcccctgggctgaaaggcgagagcggcgacctgggccctcaaggaccccgaggacctcaaggacttactggtcccccagggaaggccggacgtaggggaagggccggtgccgacggagccagaggcatgcctggagatcctggtgtaaagggcgatcggggttttgatgggttgcccggtctgcctggggaaaaaggccaccgaggcgatacaggcgcacagggtttacccggaccaccaggagaggacggtgaacgcggtgatgacggggaaatcgggccaagaggcctccccggtgagtctggccctcgcggactgttaggacctaagggcccaccaggcatcccaggaccaccgggagtgcggggaatggatggtccccagggcccaaaaggctctcttggcccacagggcgagcccggaccacccggacagcagggaactcccggtacacagggcctaccaggaccccaaggagccattggaccacatggtgagaaaggcccacagggtaagccgggtctcccagggatgcccggttctgatggtcctccaggacaccctgggaaagagggaccacctggcaccaagggcaaccaggggccatctggccctcagggtcctctgggctacccagggcctcggggagtgaaaggcgtcgatggcatcagaggtttgaagggccataagggagaaaaaggggaagatgggtttcccggattcaagggcgatattggggtgaaaggagataggggtgaggtcggggtccccggaagccggggagaggatggccctgagggacctaaggggaggactggtccaaccggcgatccgggtccacccggtctcatgggtgagaaaggcaaattaggcgttccagggttgcctggatatcccggtagacaaggaccgaaaggaagcctgggctttccaggatttcccggagcgagtggggaaaagggcgcacgcggactgtcaggtaaaagtggccctagaggtgagcgcggacccaccggcccacggggtcagaggggacctcgcggtgctaccggcaaatccggtgccaagggaacatctggaggagatggacctcacggcccaccaggagaaagaggactaccaggtccacagggaccgaacggctttcccggaccaaaaggtcccccaggccctccaggaaaggatgggctgcctggacatccaggacaacgcggtgaagttggatttcaggggaaaacagggccacccggtccacctggagtagtggggcctcaaggcgcagctggagagactggtccaatgggggaacgaggacatcctgggcctcctggtccacctggtgaacaggggctgccaggaaccgccggaaaagaaggaactaaaggagaccctggacctcctggcgctcctgggaaagacggccctgctggactgcgcggttttccgggtgagcggggtttgcctggcacagccggaggcccaggactgaagggtaacgaagggccaagtggcccaccaggcccagctggctccccaggcgaacgcggagcagctgggagcggcggacctatcggacccccaggcaggcccggaccccagggtccccctggggctgccggtgagaagggcgtgcccggagagaaaggacctatcgggccaacaggcagggacggagtgcagggcccagtagggctccccggacccgcagggccaccaggcgtggcaggagaggacggtgacaaaggcgaggtgggtgatcctggacagaaaggtacaaaagggaacaagggagagcatggcccaccaggaccaccaggcccaatcggaccagtcggccagcctggcgctgccggagccgacggcgaaccaggtgcaaggggaccccaagggcactttggcgcaaagggagacgaaggcactaggggattcaacgggcctcctgggcctataggtctacagggcctgcccggaccaagcggggaaaagggtgagacaggggatgtgggaccaatgggccctcccggtcccccagggcctcgcggtcccgctggcccaaacggtgcggacggacctcagggcccaccgggaggcgtcggtaacctgggacctcctggagaaaagggggagccgggtgagtcaggatctcccggaattcaaggagagcctggcgtgaaagggcctcggggagaaaggggtgagaagggcgagagtggacagcctggggagcccggaccacctggccctaagggtccaacaggcgacgatggtcctaaaggcaaccctgggccagtgggatttccaggcgatcccggacctcccggagaaggcggaccgaggggccaagatggggctaaaggagacagaggcgaggacggggaacctggccagccaggatcgccagggcctacaggggagaacggccctccaggccctctgggaaagcggggaccagccggttcacccggtagcgaaggccgacaagggggaaagggtgccaagggcgatcctggagccatcggggctcctggaaaaactggaccagtaggcccagccggtccagccggaaagccaggaccagatgggcttagagggctgcctggttccgtcggtcaacaaggacgaccaggcgctacaggacaggctggacctccagggcctgtcggaccgccaggactgccaggactgagaggggatgccggtgccaaaggagaaaaggggcaccccggtctcatcggcttaatcgggccacctggagagcagggtgagaagggagatcgcggactgcccggaccccaagggagtccagggcagaagggcgagatgggcataccaggcgctagcggccctattggcccaggaggacctccaggcctgcccggtccggcagggcctaaaggagccaagggtgccaccggtcctggaggacccaagggagagaaaggcgtgcagggcccaccgggacacccgggaccccctggagaggtgattcagcccttgcctattcaaatgccaaaaaagacacgcagaagcgtggacggatctcgacttatgcaggaagatgaggctatccccactggcggagctcccggttctcctggcggactggaagagatcttcggctctctcgacagtctgagagaggagatcgagcagatgcgccgaccaacaggaacacaggatagtccagcgcgtacttgccaagatctgaaattatgccatcctgagctgcccgacggcgagtattgggtggaccccaaccagggatgtgcaagagatgccttcagggtcttctgcaatttcacggccggtggagaaacctgcgtaactcctagggacgatgtcacccagttttcctatgtcgattccgaaggatcccccgtcggagtcgtccaactcacatttttaagattgttatctgttagcgcgcaccaagatgtttcttacccatgttctggtgcagcaagggatgggcctcttcggctccggggtgcaaacgaagacgaactctctcctgaaaccagcccttatgtgaaggaatttcgagatgggtgccagacacaacagggaagaacggtccttgaagtacgaacgcctgttctggagcagctgcctgtgttggatgcctccttttccgatctcggagctccaccgaggagggggggagtactgctgggcccagtatgctttatggggta

SEQ ID NO: 4723 - DNA, 4953 bp, Artificial Sequence
  Description of Artificial Sequence: Synthetic coding sequence
atggagcggtgctctagatgtcaccgcctcctgctccttctacccctggtgctgggactgtccgccgcacccggttgggcgggagctccacccgtggacgtgctgcgagctctccggttcccctccctcccagatggtgtgaggcgggcaaaaggaatatgtccagccgacgtggcatatagggttgctagacctgcacagctgagtgctcctactaggcagctcttccctgggggatttcccaaggactttagcctgctgactgtcgtgagaaccagaccagggcttcaggccccactattaaccctctatagcgcacagggcgtgcggcagctgggtttagaactgggtagaccagtgcgcttcttgtacgaggaccaaactggaaggccgcagcctcccagccagcctgtttttcgagggctgagccttgctgacgggaagtggcatagggtggcagtggctgtgaaggggcaatcagttactttgattgtggattgtaaaaaacgagtcactcgcccacttccaaggtctgctagaccagttctggatacacacggagtgattatttttggggcacgtattctggacgaagaggtgttcgaaggagacgtgcaggagctggcaatcgtccctggcgttcaagctgcgtacgagtcatgtgaacagaaagagctcgagtgtgaaggtggacaaagagaacggcctcaaaaccaacagccacaccgggctcaacggtccccccagcagcagccctcaaggcttcatagaccgcagaaccaggagcctcaaagccaggaccccactccaggagaggaagaagagattttagaaagctccttgctccctccactggaagaggcagcccacggacccagaggtttaaagggcgagaagggggagccggctgttctggagcccggtatgctcgttgaaggacctcctgggccagaggggccagccggtctgatcggaccaccaggaatccaggggaaccctggacccgtgggagatcccggagagagaggacccccaggtcgtgccggtttgcctggttccgacggcgctccgggtccacctgggaccagccttatgctcccttttcggtttggaagtggtggaggtgacaaaggcccagtcgtggctgctcaggaagcacaggctcaggctatactgcagcaagccaggcttgctctgcgcggaccccctggacccatgggctatacaggtaggcccggtcccctggggcaaccaggatcacctggcctgaaaggagaatcaggcgatttgggaccacagggcccaagaggcccacaggggttaacgggaccgccagggaaggccggaaggcgaggacgcgctggcgcagatggggctcgaggaatgcccggagatccaggcgtgaagggagacagggggttcgacggcctgcccggactgcctggcgagaagggccaccgaggcgacacgggagctcaggggctccctggcccacctggcgaggatggcgagcggggagatgacggcgagataggtcctaggggcctcccaggggagtccgggcctagaggacttctgggccctaaaggcccaccagggatcccagggccacccggtgtgagaggcatggatggaccgcagggcccaaaaggctctttagggcctcagggcgaaccaggacctccgggtcaacaggggaccccaggcacccaggggttaccaggccctcagggggctatcgggccacacggcgaaaaaggaccgcagggtaaaccgggactaccaggcatgcctggctctgatgggcctccaggacaccccggaaaagaggggcctcctggaaccaaggggaatcagggcccatcaggacctcagggaccgctcggttatccaggtccacgaggtgtaaagggtgtggacggaatcagagggttaaaaggacacaagggcgagaagggcgaggacggattcccgggattcaagggcgacatcggtgttaaaggcgatcgtggggaagtcggggtgcccggaagtaggggggaggatggcccagaaggcccaaagggcaggactggtcccaccggcgatcctggccctccaggactaatgggcgagaaaggcaagctgggcgtgccaggtttaccagggtatccaggtcgtcagggccctaagggctcactcggttttcccggtttccccggtgcctcgggtgagaagggagcccgaggcttgtccggaaaatcaggccctagaggtgagcgaggaccaaccggcccacgcggacagagaggtcctaggggggctactgggaagtcgggcgcaaagggaacatctggtggagacggcccacatgggcctcctggcgaacgtgggctgcctggacctcaggggcctaacggatttccaggcccaaaaggtcccctcggaccgccaggcaaagacgggcttccaggacacccagggcaacgtggcgaggtgggattccagggcaagactgggccaccagggcctccaggggttgttggcccacagggggctgccggtgaaaccggacctatgggcgagcgaggccatccagggccacccggacctcccggagaacagggtctgcccggtaccgcagggaaagagggcacaaagggagatccaggtccacccggtgccccaggcaaggatgggccagccggactgaggggctttcccggagaaagagggctgcctggcaccgcgggaggccctggccttaaagggaatgaaggaccctctgggccacctggccctgcgggaagtccaggtgagcgcggtgccgctggcagcggaggtccaatcggccctccgggtaggcccggaccccagggcccacctggagccgctggggagaagggagtcccaggcgaaaaagggcctatcggcccaaccgggcgagacggcgtccagggcccagtgggtctgccgggtcccgcaggaccgccaggggtggcgggtgaggatggagataaaggagaggtgggtgaccctgggcagaagggaaccaaaggaaacaagggtgaacatgggccaccaggcccaccgggaccaattggtcccgtggggcaaccaggtgctgccggtgcagacggcgagcctggagcaagaggtccgcagggccattttggcgctaagggggacgaagggacccgcggattcaatgggcctcctgggccaatcggtttgcaagggctacccggaccttccggagaaaaaggcgaaactggtgatgtggggccaatgggacctcccggacctccgggacctcgcggtccagccggtcccaatggcgctgacggccctcagggccctcctgggggtgtcggcaacctgggcccacctggtgaaaagggcgaacctggagaatctggctcccccggaattcagggcgagccaggagttaaaggaccacgaggcgaaaggggcgaaaagggcgaaagtggacagcctggtgagcccggtccaccaggcccaaaaggtcctaccggcgacgacggaccaaaaggaaatcctggccctgtcggatttccgggagaccccggtcctcccggagaaggcggtccacgcggacaggatggagcaaaaggggataggggagaggacggcgagccgggtcaacccggaagcccaggacctaccggcgagaatggaccccctgggccacttggcaagagggggccagccggatcacctggctctgaaggcaggcagggcggaaagggcgcaaaaggcgacccaggcgctataggggcacctggaaagactggcccagttgggcctgccggtccggctggaaagcccggaccggacgggctgaggggcctgcccggttcagtgggacagcaaggtcggccaggcgcaactggacaagccggtcctcctggacccgtgggccctccaggtctgccgggtctgagaggcgacgccggagcaaaaggcgaaaaaggacatccaggattaataggactcattggaccacctggcgaacagggagagaaaggagaccggggattgcccggtccacagggttcccctggacagaagggcgaaatggggattcccggtgcctctggacctattggaccgggaggacccccaggcctgccagggccagccggtcctaagggcgctaagggagctacaggcccaggcggacctaagggagaaaaaggtgtgcaggggccacccggtcatcccggtccccctggtgaggtaatacagccactgcctatccagatgcctaagaaaactagacgcagcgttgatggaagcaggctgatgcaggaagacgaggccattcctacaggtggcgctcccggttcgcctgggggtctggaagagattttcggctccctagatagtctgagagaggagatcgaacaaatgcgcagacccaccggcacccaagacagccctgcgaggacttgccaagatctgaaactgtgtcaccccgagctgcccgatggagagtattgggttgacccaaaccaaggatgcgccagggatgcgttccgggtgttctgtaatttcaccgccggtggcgaaacctgtgttaccccacgcgacgacgtgacccagttcagctacgttgactcagagggctctcctgtaggcgtcgtgcagttgacgtttctgaggcttctgtctgtgagcgctcaccaggacgttagctatccgtgttctggggctgctcgcgatggacccctgagattgagaggtgcaaacgaagatgagctttctcctgagacctcgccatacgtaaaggaattcagggacgggtgtcaaacgcaacagggcagaaccgtgcttgaggttcggaccccagtcttggaacagctgccggtcttggacgcgtccttcagcgacttaggagctcctcccaggagaggcggtgtgcttctcgggcctgtctgttttatgggctag

SEQ ID NO: 4724 - DNA, 873 bp, Artificial Sequence
  Description of Artificial Sequence: Synthetic coding sequence
atggagcgttgcagcagatgtcataggctgttactcttgctgccattggtcttgggactcagcgccgcacctggatgggccggtgcccctcctgtcgacgtgctcagggcattgcgatttcctagcctgccagacggggtcagaagagcaaaggggatttgccctgccgacgtagcgtatcgcgtggcaaggcccgctcagctgtccgctcctacacgacagctgttccctggcggttttcctaaggacttcagtctgctcaccgtcgtccgtacaaggcctggcctacaggccccactcctgacgttgtatagtgcccaaggcgtccggcagctggggctggaactgggcaggcctgttcgctttctctatgaagaccagactgggcgacctcaacccccttcccaacctgtgtttcgcggactctctctggcagacggaaaatggcaccgggttgctgttgctgtgaagggtcagtctgtgaccctgattgtggactgcaaaaagagggtcacacgaccactacctcggtcggctagaccagtgcttgatactcatggagtgattatctttggtgctcgaatacttgatgaggaagttttcgaaggcgacgtgcaggaacttgcaatagtaccaggcgtacaggcagcgtatgaatcctgcgaacagaaagaacttgagtgcgaagggggacagcgagagcgccctcagaaccaacaaccacacagggctcagcggagcccgcagcagcagccatctcgccttcaccgaccccagaatcaggagcctcaatcacaagtgcgcgaattgggcgaaccgccaagcgccgctcatccacgcgagggccgacatcccggtatctcacccccttag

SEQ ID NO: 4725 - DNA, 4953 bp, Artificial Sequence
  Description of Artificial Sequence: Synthetic coding sequence
atggaaagatgcagcagatgccaccgtctcctccttctcttacctctggtactgggactgagtgcggctccaggatgggctggtgccccacctgtggacgtcctcagagccctgaggtttccatctctaccagacggggtgcgtagagccaagggaatctgtcctgccgatgtggcctaccgagtggctagacctgcccagcttagtgcccctacccggcagctgttcccaggcggattcccaaaggacttctcacttctgacagttgtcagaactcggccaggccttcaggctccgttgctgaccctgtatagtgctcagggcgtgcggcagctgggcttagagctgggccgacccgtgcggtttctgtacgaagaccagaccggaaggccccaaccacctagccagcctgtgtttaggggcctgtctttagcagatggaaagtggcacagagtcgcagttgcagtcaaggggcagtctgtaactctgattgtggattgtaagaaacgcgtcacccgtcctctgccccgtagcgccaggccagtgctggacactcatggtgtcataatctttggtgcgagaatcctggacgaggaggtatttgagggtgacgttcaggagttggctatcgtgccgggagtccaggctgcctatgagtcttgtgagcagaaagaattagaatgcgagggcggtcagcgcgaaaggccccaaaatcagcagccccatagagcccagaggagcccacagcagcagcccagccgcttgcatcgcccacagaaccaggaaccccagtctcaagatccaacacccggagaagaggaggaaattctggagtcatccttactgccaccgctggaggaggctgcccacggccctagggggctcaaaggcgaaaagggcgaacccgcagtgctggagcccggaatgctcgtggagggcccaccaggaccggaaggcccagctggccttatcggcccacctgggattcaggggaacccagggccagtaggggatccaggagagaggggacccccaggacgcgctggcttgcccggaagcgacggcgcacctggaccccctggcacatccctgatgttaccctttcgtttcggctctggcggtggagacaaggggcctgttgtggccgcacaagaggcccaggcacaggccatcttacagcaggcacggctagccctgcggggtccacccggaccaatgggttacactggcagacccggaccattaggacagccaggctccccaggattaaaaggcgaatctggcgacctgggccctcaggggcctagaggcccacagggcttgaccggccctcccggaaaggccggaagacgcggtcgggcaggcgctgacggggctcgcggaatgcccggagacccaggggtgaagggcgatcgcggattcgacggcctgcctggcctccccggagagaaagggcatcgcggtgacaccggtgctcaagggttaccaggaccccctggtgaggatggagagagaggtgatgacggtgagatcggtcctagaggattgcctggggagagcggccctcgtggtcttcttggccctaaaggccctccaggaatccctggcccacccggagtcagggggatggatgggcctcaggggcctaaggggagtcttggcccacagggtgaaccaggacccccagggcaacaaggcacacccggaactcagggcctgcctggccctcagggagccattgggcctcacggggagaagggtccgcagggcaaaccgggtctcccgggtatgccaggcagcgacggaccgccagggcatccaggaaaagaaggacctcctggcacgaaggggaatcagggcccatctggaccacaaggacctctcgggtaccccggacctcgtggcgtcaaaggagttgatggcattcgcggactgaaaggccacaagggggagaagggggaggacgggtttcccggattcaaaggcgacattggggtgaaaggcgatcgcggtgaggtgggagtgccaggcagccgcggagaggatggcccagagggtcccaagggccgaactggccctaccggggaccctggccctcctggtctgatgggggaaaaaggcaagttgggggtccccggtcttccgggatatccgggtcgtcagggacctaagggcagtctcggattcccaggtttccctggggcatccggcgaaaaaggtgctagaggcctttctgggaaatccggaccacgcggagaacgaggcccaacaggacccagaggccagagaggcccaagaggcgctacgggcaagtcgggagctaagggcaccagcggaggcgacggtccacacggcccaccaggagaaagaggtctgcccggaccccagggacctaacggatttcccggacccaaaggcccaccaggccctccagggaaggacggactacctggacatccgggtcagaggggagaagtcgggtttcagggtaagacaggcccaccagggccaccaggcgtcgtcggacctcagggtgctgcaggtgagacaggtccaatgggagagcgaggccaccctgggcctcccggaccccctggtgaacagggcttacccggtacggcaggcaaggagggcactaaaggcgatcctggaccacctggagctcccggtaaagatggccctgctgggctaagggggtttccgggtgaacgcggactgcccggaactgcaggcggaccgggtctcaaggggaatgaagggccttccggtccacctggacccgcaggctctcccggagaacggggagccgcaggcagcggcggacctatcggaccacccggacgtcccggaccgcaggggccaccaggcgcagcaggtgaaaagggggtgcccggagaaaagggcccaatcggaccaacaggccgtgatggggtgcagggcccagtgggattgcccggacctgcaggccctcctggcgtcgcgggagaagatggtgataaaggagaagtgggcgatccaggccagaaggggacaaagggaaacaaaggggagcacggacccccagggccaccaggcccaatcggacctgttggccaacctggcgcagccggagctgatggcgagcccggagccaggggccctcagggacactttggggctaagggggatgaagggaccagaggattcaatgggccaccaggcccaatcggccttcaaggcctgccgggacctagtggcgagaaaggagagactggcgatgtaggcccaatgggcccacccggaccccctggaccacggggacccgctggtccaaacggggcagacggcccacagggacctcctggcggtgttggtaatctggggcctcctggtgagaagggtgagcccggagagtccggaagccctggaatccagggagagcccggtgtgaagggcccaaggggagagcgaggcgaaaagggagaatcaggccagcccggtgagccaggccctccaggcccaaaaggacctaccggtgatgacgggccaaagggcaaccccggaccagtcggcttccccggtgacccaggtcctccgggagagggaggaccacggggacaagatggcgcaaagggcgacagaggcgaggatggagaaccaggccagcctggtagtccaggtcctaccggggagaacggaccaccaggccctctcgggaaaaggggacccgctggctcacctggcagcgagggccgacaaggcggaaaaggcgcaaaaggggatccaggagctatcggcgctccgggtaagaccggcccagtggggcctgctggtcccgcaggcaaacccggacccgatggcctgcgaggccttcctggaagtgttggacagcaaggcaggcctggggcaacgggccaggccggtcctcccggacccgtcgggcctccgggattgccaggattgcgcggtgatgcaggggcaaagggagaaaagggccacccgggactgatcggattgatcggcccacccggtgagcagggggaaaagggcgatcgcggactgcccggtccccagggaagccccggacagaagggggaaatgggtatccctggtgcaagcggtcctattgggccaggcggacctcccggactgcctgggcctgcaggcccaaagggtgctaaaggcgcaacgggaccaggagggccaaagggagagaagggcgtgcagggccctccagggcacccagggcctcccggagaagtaattcagcccctgcctatccagatgcctaaaaaaacacgaagaagtgtcgacggcagccgcctgatgcaggaggacgaggcgatccctacaggaggtgcccctgggtcacctgggggtctggaggaaatttttggtagtctcgattctttgcgcgaggaaattgagcaaatgcggagaccaactgggactcaggatagtcccgctcgaacctgccaggacttgaagctatgtcatcctgaactgcccgatggtgagtattgggtggatcctaaccagggctgtgccagggacgccttccgagtgttctgcaacttcacagccggaggggaaacatgcgtgaccccgagagacgacgttacccagttcagttacgtagatagcgaagggtctcccgtgggggtcgtgcagttgaccttccttagactgctgagcgttagcgcccatcaggatgtgtcatatccctgttcaggcgcagcccgagatggacccctccggctgaggggggctaatgaggatgagttgtctcccgagacatctccttatgtgaaggaattccgcgacggctgtcagacccagcagggcagaactgtactggaggtgcgcacccccgtgctggagcagttacctgttctggatgcctcctttagtgatctgggagcccctccacgacgcggaggagtgctcttagggccagtatgctttatggggtag

SEQ ID NO: 4726 - DNA, 873 bp, Artificial Sequence
  Description of Artificial Sequence: Synthetic coding sequence
atggagcgatgcagtagatgccaccgattgctgcttttgctccccctcgtgctcggactaagtgccgcacctggttgggccggagctcctccagtcgatgtgctcagagcccttaggttcccctcactgccggacggtgtccgaagagccaagggcatttgcccagccgacgtagcttacagagtggcaaggccagcccaactttccgcccctacgcggcagttatttcccggagggtttccaaaggatttttccttgctaaccgtggtgcgcaccaggcccggacttcaagcaccgttgttaactctgtacagcgcgcagggggtccgccagttgggcctcgaactgggacgccctgtccggttcctctacgaggatcagaccggtcggccacagccaccttcccagcccgtttttaggggactaagcctggcggacgggaaatggcatcgagttgccgtggctgtcaaaggccagagcgttacattgatagttgattgcaaaaagcgggttacccggccactgcctcggtctgcacggccagtgctggatacccacggagtcataatcttcggagcaaggatcttggatgaagaggtctttgagggcgacgtgcaggaactggccatcgttcccggagtccaggccgcttacgagtcttgtgaacaaaaagaactggagtgtgaggggggtcagagggagcggccacaaaaccaacagcctcacagggcccagcgatccccccagcaacagccctcccgcctccacagaccccaaaaccaggaacctcagtcacaggtacgagagctgggcgagcccccatcagcggcacacccaagagaggggagacatccagggatttccccaccctag

SEQ ID NO: 4727 - DNA, 921 bp, Artificial Sequence
  Description of Artificial Sequence: Synthetic coding sequence
atggattggagagcctcagaggcctggatggttcctagggccccaaagggggcttgggaccctagggaatcccaggatctgctcgataaccgggctcctctgggtcccagggtattcccaggccctcgcgtgccgagtgcactcatggaacgccgagtactgaaaggttcacagggttcgcctgcctgtccaggtccacccggtgaagtaattcagccactgccaatccaaatgccgaagaagacgcggcgatctgttgatgggagccggctaatgcaggaggatgaagcgatcccgacagggggagctcccggaagtccaggcggattggaagagatctttggctcactcgatagtttaagggaggagatcgagcagatgcgcaggcctacaggtacacaggattctccagcaagaacatgccaggacctgaagctgtgccaccctgaattgcctgatggggaatactgggttgatcccaatcaggggtgtgccagagacgcctttcgagtattctgtaattttacggccggtggcgagacctgtgtgacgcctagggacgacgtgacccagttttcctatgtcgactccgaggggagccccgtgggcgtcgtccagctgacattcctcagactgctgtccgtttctgctcatcaggacgtcagctatccctgtagcggagctgctcgcgacggacctctccggttgcgcggtgccaacgaggatgaactgtccccagaaacatccccctatgtgaaggagttccgagatggctgccagacccagcaggggcgaaccgtgctggaggtccgaactcctgtgcttgagcaacttcccgtgcttgatgcttcattcagcgacctcggggctccgccaaggcgcggaggtgttctcctgggacctgtatgttttatgggctag

SEQ ID NO: 4728 - DNA, 5031 bp, Artificial Sequence
  Description of Artificial Sequence: Synthetic coding sequence
atggaacgctgctcacgctgccaccgcttgctcctgctcctccctctcgtcctgggcctgtctgcagcccctgggtgggccggagcgccaccagtggacgtactcagagctctgcgctttccctctttgcccgacggcgtgcgtagggccaaagggatttgcccggctgatgtggcatatcgggtcgcaagaccagcccagctgtctgctcccaccagacagctgttccccggaggctttccaaaggacttctccctcttgaccgtggttaggacccgacctggcttacaggcaccacttctaaccctctatagtgcccagggggtgcgacagctgggcctcgaactgggacggcctgttcgctttctctatgaggaccagaccgggaggcctcagccaccatcccaaccggtcttcaggggtctaagtctggctgacggaaaatggcatagagttgccgtggctgtgaaaggacagtctgtgactctgatcgtggattgtaaaaaaagggtgacacgtcccctacccaggtcagctcgaccagtgttggatacccacggagtaataatcttcggtgctcgaatcctggatgaagaagttttcgagggggatgttcaggaactcgcgattgtaccgggtgtacaagccgcttatgagtcctgcgaacagaaagagttagaatgtgagggaggccaaagagaacgccctcagaaccagcaacctcacagagcacagcggtcccctcagcagcaaccctctcggctgcaccgaccacagaatcaggaacctcaaagccagccaacagagtcactgtattacgattacgagccaccatactacgacgtgatgactactggaactacacccgactatcaggatccaacaccaggcgaagaggaagagatcttagaatctagcctgctgcccccactggaggaggcagctcacggaccacgcggactgaagggcgagaagggtgagcccgctgttttggaaccaggaatgctggtcgaggggcctcccggtccagaaggtcccgctggcttgataggaccccctgggatccagggtaatcctggccctgtcggcgatccgggtgaaaggggtcccccagggagggctgggttaccaggttcggatggtgctccaggcccacccggtacatcccttatgttgccattccggtttgggtccgggggtggggacaaaggtcctgttgtggccgcacaggaagctcaagcgcaggccatcctccagcaggctagactggccctgcggggacccccaggcccaatgggttacacaggcagacccggtcccctgggtcagcccggaagtcctgggcttaaaggtgaaagcggtgaccttggccctcaaggaccaagagggccacagggccttacagggccacctggcaaagcaggccgtagaggtcgagccggagcagacggcgctcgtgggatgcctggagaccccggtgttaagggcgaccgcggtttcgatggactgcctggtctgcccggagaaaagggccaccgcggtgatactggggctcagggcctgccgggaccacctggggaggatggcgagcgaggcgatgatggggagatcgggccaagaggcctgcctggtgaaagcggccctagggggttgctggggccaaaaggaccacctggaatcccgggtccccctggggtgcgaggcatggacggaccacaagggccaaagggctccctaggaccacaaggggaacccggaccacctggccagcagggcacgcccggaactcagggccttcccggtcctcagggcgctataggcccacacggggagaaggggccacaggggaagccagggttacccggtatgcctgggagcgatggcccacccggtcaccccggaaaggaggggcctccgggaactaaggggaatcaaggtccctctgggccacagggcccattgggttatcccggaccccgaggcgtgaaaggagtcgacggtatccgcggtttgaagggtcataaaggtgaaaaaggagaagacggctttccaggtttcaaaggcgacattggagtgaagggcgacaggggcgaggtcggcgttcccggttctaggggcgaggacggacctgagggacctaaaggccgaacgggccctaccggcgatccaggaccaccaggtctgatgggagaaaaagggaagctcggcgtgcctgggctgccagggtaccccggtaggcaagggccaaaaggctcactgggatttcctggtttccccggagccagtggtgagaaaggcgctaggggactgagtggaaagtctggcccacggggagagagaggaccaacaggtccaaggggccaaagagggcctcgcggtgctacaggtaaatccggagccaagggaacctctgggggtgacggacctcacggcccaccaggtgaacggggtcttccgggaccccaaggacctaatgggtttcctggaccgaaaggcccacccggaccccctggcaaggatggactgccagggcaccccggacagagaggtgaggtgggctttcaagggaaaacaggccctccaggcccacctggggtggtgggaccacaaggggctgccggagagacaggacccatgggggagcgcggacacccaggcccacccggtccaccgggtgaacaaggcctgccaggcactgctggcaaggaaggcaccaaaggcgatcccggaccccctggagctcccggtaaggacggccctgcgggactcaggggtttccccggagaaagaggcctgcctggaaccgcgggaggccctggcttgaagggtaatgaggggcctagcggccctcctggcccagccggttctccgggagagcggggagctgcaggtagcggcggacccattgggccacctgggaggcccggacctcaggggcctcccggtgccgctggcgagaagggggtgcccggagagaaagggcctataggtccaacagggagagatggcgtccaggggcctgtggggttgccagggcctgctgggcctccaggcgttgccggagaggatggtgacaagggtgaagtgggggatcctgggcagaaaggaactaagggaaataaaggtgagcatggaccaccgggtccacccggtccgatcggaccagtaggacagcctggagcagccggtgcagatggcgagcctggggctcgcggacctcaaggccatttcggtgccaagggtgatgaggggacccggggattcaatggccctccaggacccatcggtctccagggcctgcctggtccttctggcgagaagggcgagacaggggacgtggggcctatgggccctcccggaccccctggaccacggggtccagccggaccgaatggcgcagacggccctcagggtcctcctggaggagtgggaaacctgggcccaccgggtgaaaagggagaaccaggagagagtgggagccccggtattcaaggggaacccggagtaaaggggccacgcggagagcggggagaaaaaggggagagcggccagccaggtgaaccgggtccgcctggccctaaaggtcccactggagatgacggtcctaaaggcaatccaggcccagtggggtttcccggtgatcctggaccacctggcgagggtggcccacgaggtcaggatggtgcgaagggcgataggggagaggacggggaacccggtcaaccaggctcccccggtcccactggagaaaacggcccacctgggccattaggaaagcgcggaccagcaggtagcccaggttcagagggtcgccagggagggaagggcgcaaaaggagaccccggagcaattggggcaccaggaaaaacgggcccagtgggacctgcagggccagcgggtaagcccggacccgatggactgcggggactgcccggatccgtgggacaacaggggagaccaggcgcaactggtcaggccggtccaccaggcccagtcggaccccctgggctcccgggactgcggggagatgctggcgctaaaggggagaaagggcaccccggactgatcggactcattggcccaccaggagagcaaggagagaaaggcgacagaggcctcccaggcccacagggatcccccggtcagaaaggagaaatggggattcccggagcgagcggccctatcggtcctgggggtcctccaggactgccgggaccagcgggtcccaagggggctaaaggagccactgggccaggaggacccaagggagagaagggcgttcagggtccccctggtcatccgggtccaccaggcgaagtcattcagcctctgcctatccagatgcccaagaagactagacgctctgtagatggcagtcgtctgatgcaggaggatgaggcaatccccacgggaggagctcccggttctcctgggggactggaagaaatctttggaagtcttgactccctgagggaggagattgaacaaatgcggcgtcccacagggactcaggatagtcctgcccgtacctgtcaggacctgaagttgtgtcaccccgaactccctgacggggaatattgggtcgatccaaaccagggttgtgcgcgagacgcattccgggtattttgcaattttactgctggcggagaaacgtgcgtgacccctcgagacgacgtgacacagttttcctacgtggattctgaaggctcacccgttggagttgtgcagttgaccttcctcaggctactctctgttagtgctcatcaggatgtcagctatccatgcagtggggcagcgagagatggccctcttcggcttagaggagctaacgaagacgagctaagtcccgagacaagcccttacgtgaaagagtttcgggatggctgtcagactcagcaggggagaacggtactggaagttcgaactccagtcctcgagcagctcccagtgttggacgccagttttagcgatttgggtgcccctcctcgcagagggggagtgttgcttggcccagtgtgtttcatgggatag

SEQ ID NO: 4729 - DNA, 1875 bp, Artificial Sequence
  Description of Artificial Sequence: Synthetic coding sequence
atggaacgatgctctaggtgccaccgcctgctgctcctcttacctctagtcctgggtctgtcagcggcaccaggatgggctggagccccacctgtggatgtgctccgcgcactacgcttcccttcgctccctgatggagtccggagagcaaagggcatttgtcccgctgacgttgcatacagagtggcacggcctgcccagctttccgccccaacccggcaattgtttccaggtgggttccctaaagatttcagcctgctgacagtcgtacgcacaagacccggtctccaggctccactgctgaccctctattccgcccaaggagtgaggcagctgggactagagttgggacgcccagtgcgtttcctgtatgaagatcagacaggacggcctcagccaccatcgcagccggtttttcgaggactgtccttagccgatggcaaatggcatcgggtcgccgtcgccgtcaagggacagtcagtaacactgattgttgactgtaaaaagcgcgttacccggcctctcccacggtcagctcggccagtgttagacacgcatggggtgataatttttggcgcaagaatcttagatgaggaagttttcgagggcgacgtccaggaattggctatcgtgccaggcgtacaggctgcttatgagagttgcgagcaaaaggaattagagtgcgagggagggcagcgggagcggccacagaaccagcagccacacagggcacagcgttcacctcagcagcagccttcccgcctgcataggccccagaaccaggagccacagagtcagccaacggaaagcctgtattacgattacaaacctccatattacgacgtcatgacaaccggcacgaccccagactatcaggaccccactccaggtgaagaggaggaaattctggagagtagtctgcttcccccactcgaggaggagcagactgacttgcaagtgcctccgacagcggacagatttcaagcagaggaatacggcgaagggggtaccgatcctccggaaggcccttacgattatacatatgggtacggagacgactatcgagaggagactgagctgggcccagcacttagtgctgaaactgctcactcgggtgctgctgcccatggtcccaggggcctaaagggcgaaaagggggaacccgctgttttagagcccggaatgcttgtagaaggtccacctgggccagaggggccagccggtctgatcggtccacccggaatccaggggaatccgggaccggtcggggacccaggagaaaggggccctcccggtcgggcaggattgccaggctcggatggggctcccggtcctccaggcaccagcctgatgctgcccttccgatttgggagcgggggaggcgacaaaggccctgtggtggcagctcaagaagcacaggcgcaagctattctacagcaggcacggttagcgcttcggggtcctcctggtcccatgggctacaccggtcgccctggccctctgggccagcctgggtcacctggactcaaaggcgagtccggcgatctcgggccacaaggacccagggggccacagggcctaactggacctcccggaaaagccggaaggagagggcgtgctggagccgacggagcacggggaatgccgggagaccctggagtcaaaggagacaggggatttgacgggctgcctggtctccccggagagaagggccacagaggagacacaggcgcacaagggctccctggtccgccaggagaagacggtgaaaggggtgacgacggcgaaatcggacctcggggtctccctggcgaaagcgggccaagaggcctacttgggcctaagggtccccctggcattcctgggccaccttag

SEQ ID NO: 4730 - DNA, 4953 bp, Artificial Sequence
  Description of Artificial Sequence: Synthetic coding sequence
atggagcggtgctcaaggtgccaccgcctgctcttgctgttgccactggtactcgggttaagcgcagcccctggttgggcaggcgctccccctgtggatgtgctgagggccctgcggttcccctctctgcctgatggcgtgcggcgagctaaggggatctgtccagctgacgtggcctaccgtgtggcacgcccagcacagctgtcagcccctactagacagctgtttcctggaggctttcctaaagatttctcactcctgaccgtcgttcgcaccagacctggactacaggctccacttctgaccctctattcagcgcagggcgtacgtcaactgggtctagaacttggtccgccagtcagatttctctatgaggaccagactggcagacctcagccgccaagccagcccgtgtttagaggattgagtctggcagatggcaagtggcaccgggttgcggtcgccgtgaaagggcagagcgtcacacttatcgtagactgcaagaagagagttactaggcctttgccgaggtctgctcggccagtcctggacacccatggggtgattattttcggagctcgaatcctggatgaagaggtgttcgaaggagacgttcaggagttggccatcgtgccgggtgtccaggctgcctacgaatcgtgtgaacaaaaggaactcgaatgcgaagggggacagagggagcgtccacagaatcaacagccccatcgtgctcagcgctctcctcagcagcagccgtcccgcctacatagacctcagaaccaggaacctcagtcccaggatccaacacccggtgaagaagaggagattctggaatctagtctgctccctcctctagaggaagcagcacacggccctcggggtctgaagggagagaagggcgaacccgcagttctggaaccagggatgctcgtggagggtccgccaggcccagaaggacccgctggactgataggcccacctggaatacagggcaatcctgggccagtgggagatcccggagagcgcggacctcccggacgcgctggactcccagggtctgatggggctccgggtcccccaggcacaagcctgatgctccccttccggttcggctccgggggaggtgacaaaggacccgtcgtagctgcgcaggaagcccaagcccaagcaatcctccagcaagccagactggcgctacgcggacccccaggcccaatgggctacacaggccgtcctggacctttggggcagccgggttctcctggcctaaaaggagagagtggagacctaggtccgcagggtcccagaggacctcaagggttgaccggcccacccggaaaggcagggagaagagggagggccggagctgatggggctcggggaatgccaggagatcccggagttaagggcgacaggggtttcgacggacttcctggacttcctggagagaaaggacacaggggcgataccggcgctcaaggcctccctggaccaccaggtgaggatggggaaagaggggacgacggcgaaattggacctcggggtttgcctggtgaaagtggccctcgcggtctgttaggccctaagggccctccaggtatcccaggaccccctggggtgcggggaatggatggccctcagggccctaaaggaagcctgggccctcagggggagcccggaccccctggacagcagggaacaccaggtacacaaggactgcccggtccccagggggctatcggtcctcatggggagaagggccctcaggggaagcctggactcccaggcatgcctggaagcgacggaccccctgggcatcccggaaaagaaggtccaccaggcacaaagggaaatcagggaccctctggtccacagggcccactggggtaccctggaccaagaggcgtgaagggtgtggatggcattcggggtctcaagggtcacaagggcgagaaaggcgaggacggatttccaggcttcaagggcgacatcggcgtgaagggggacaggggcgaagtgggggtgccaggctcccgaggggaggacggtccagaaggcccaaaaggtcgaaccggtcccacaggggacccgggtccacctggcctgatgggggagaagggaaagcttggcgtccctggcctgccaggctatccagggcgtcaggggccaaagggcagtttgggatttccgggattccccggagccagcggagaaaaaggtgccagggggctctctggcaagagcgggcctaggggtgaaaggggtcctactggaccacgcggacagaggggccctcgtggtgccactggcaaatcaggagcgaaggggacatcagggggagatggacctcacggacccccaggtgaacgcggattaccaggccctcagggacctaacgggttccctggacctaaggggccaccaggccctcccggtaaagacggcctccctggtcacccaggccagcgcggtgaggtgggcttccagggaaagaccggtccccctggtcctcctggggtggtaggccctcagggcgctgccggagagaccggtcctatgggagagcggggacatcccggtccccctggtccgccaggcgagcaaggattgccgggaacagccggaaaggagggcaccaaaggcgatccgggtccgccaggagctcccggtaaagacggaccagccggtcttcgcggtttcccaggggaacggggacttcccggtaccgccggtggcccaggcctgaaagggaacgaaggacccagtggtcctcccggaccagctggctcacctggcgagagaggagctgccggaagcggagggcctatagggcctccaggccgacccggtccccaggggcctcccggtgccgctggcgaaaagggcgtgcctggagaaaaaggtcccattggacctacaggacgggatggagtgcagggacccgtgggcctcccgggaccggcaggtccacccggagtggctggagaagacggcgataagggagaagtaggggaccccggacaaaaggggaccaagggcaataagggcgaacatggtcccccaggccctccaggaccaatcggaccagtgggtcagccgggagccgcaggggcagacggcgaaccaggcgctagggggcctcagggacactttggcgctaaaggggacgagggcacaaggggttttaatgggccacctggtccaataggcctgcagggcctgcccggtccaagtggcgaaaaaggtgagacaggagacgttggacccatgggccctccgggaccacctgggccaagggggcctgcagggccaaatggtgctgacggccctcagggcccaccgggaggagtgggcaatttgggtccaccgggtgagaagggtgagcctggagaaagcgggagccccggaattcagggcgagcccggagtaaaaggccctcgcggtgagaggggggaaaagggagaaagcgggcagccaggagagcccggtcccccaggacccaaaggtccaaccggagatgatgggcctaagggtaatccgggtccagttgggttccctggagaccccggaccgccaggcgagggcggacctaggggacaggatggagccaagggcgacagaggagaggatggtgaaccgggacagccagggtctcctggaccaacgggcgaaaatggaccgccaggtcccttaggcaaacgaggccctgcaggtagcccaggtagcgaagggaggcagggaggcaagggagccaaaggggatcccggtgctatcggagccccaggcaaaaccggacctgtgggtccagctgggccagccggaaagcccggacccgatggcctgcgcggtctgccagggagtgtggggcagcagggtaggccaggagccactggacaggccggtcccccaggacctgtgggacccccagggttacccggactgcggggagacgcgggtgctaaaggtgagaaaggacatccaggtcttattggacttatcgggccacccggtgagcagggagagaagggcgacaggggactgcctgggcctcagggaagtcccggtcagaaaggagagatgggtatccccggtgcgagtgggcctatcggcccaggagggcctcccggactccctggccctgccggacctaaaggcgctaagggggctaccggtcctggcggacctaaaggcgagaaaggagttcaggggccaccagggcatccagggcctccaggagaggtgattcagccactgccaattcagatgcccaaaaaaacgcggaggagcgtcgatggatcccgcctgatgcaggaagatgaagcgattcccaccgggggagccccaggctctccaggtggactagaagagatttttggatcattagacagtctgcgtgaggaaatcgaacagatgcgtcggcctaccggcacacaagactcacctgctcgaacctgccaggacctgaagctgtgccatcctgagttgcccgatggcgagtattgggtcgaccctaaccagggctgtgcaagagacgcgttccgcgtcttttgtaacttcacagcaggcggtgagacctgtgttacacccagagacgacgtgactcaatttagttatgtggactcagaggggagccccgtgggagtggttcaactgacttttctcagactgttgagcgtgtccgcccaccaggatgtatcttacccatgttctggagcagccagagatggcccacttcgactgcgtggcgctaacgaagatgagctgtctcccgaaacatcaccttatgtaaaggaatttcgggatggttgtcagacgcaacaaggaagaaccgtcctcgaggtcaggactcccgtgcttgaacagctcccagtgttagatgcctccttctcagatctcggcgctccccctcgcagaggcggagtgctgctcggacccgtgtgtttcatgggctag

SEQ ID NO: 4731 - DNA, 1002 bp, Artificial Sequence
  Description of Artificial Sequence: Synthetic coding sequence
taaaaccagtcaccacaggcacaccgtagtacggtcccccacactgcaggccttgggcagctctgtctcctgggctttggcatggactggagagcttccgaggcctggatggtcccgagagcccctaagggcgcatgggacccccgagagagtcaggatctcctcgataatagagccccactaggtccacgggtgtttcccggaccccgtgttccctccgcccttatggagaggagagtcctgaaagggagtcagggcagccccgcatgtctggggcctcccggtgaagtgatacagccactgcccattcaaatgcccaagaagacacggaggagcgttgatgggtcgcgacttatgcaggaagatgaggcaattccgacgggaggtgctccaggatcacccggaggcctggaagaaatttttggttcgctcgactcactacgcgaagagattgagcaaatgcgccgtccaaccgggacccaggacagtcctgcgaggacgtgccaggacttaaaactgtgccacccagaactccccgacggtgagtactgggtggatcccaaccagggatgtgccagagatgccttccgagtgttctgcaatttcacagctgggggagaaacctgtgtgacccctagggatgacgttactcagttcagttatgtggattctgagggtagcccagtgggggtcgtccagctgaccttccttaggcttctaagcgtctctgcacaccaggacgtgtcctatccctgctcgggcgcagcgagggacggccctctgagactgcggggagctaatgaagacgagctaagccctgaaacgagtccgtacgtaaaagagttcagggacggctgccagactcagcaggggagaaccgtgctggaagtgcggactcctgttctggaacagctccccgtgctggacgcatccttttcggatttgggagcccctccccgacgcggaggcgtactgctgggccctgtgtgctttatgggttag

SEQ ID NO: 4732 - DNA, 792 bp, Artificial Sequence
  Description of Artificial Sequence: Synthetic coding sequence
tgagctccacccgttgacgtgctgagagcccttcgcttcccgagcctgccagatggagtgagacgcgcaaaaggaatctgcccagccgatgtggcctatagagtggccaggcccgctcagttgagcgctcccacaagacagctgtttccgggtggtttcccaaaagatttttcactgcttacagtagtgcgcacccgccctgggctgcaagccccactgctcacattgtattctgctcagggagtacgtcagttggggctcgagctagggcgaccagtcaggtttctttacgaggatcaaacaggcaggccacaaccaccttctcagccggtcttcagggggctgtctttggccgacgggaaatggcatagagtcgccgtggctgtcaagggacagagcgtgactctcatcgtcgactgtaaaaagcgggtcacccggcctcttccgagatctgccagacccgtccttgacacacatggcgtgatcatattcggtgccaggattctggatgaagaggtgtttgaaggtgacgtccaggagctcgctattgtgcccggagtgcaggctgcctacgaatcttgcgagcagaaggagttagaatgcgagggcggtcagagagaacgtccgcagaaccagcaacctcaccgagcacagaggtccccccagcagcaaccatcgcgactccatcgtccacagaatcaggagcctcaaagccaggttcgggagttaggcgaacccccatctgctgcccatcctcgagaaggaagacatccaggcatttcccctccttag

SEQ ID NO: 4733 - DNA, 873 bp, Artificial Sequence
  Description of Artificial Sequence: Synthetic coding sequence
atggagcgatgtagtcgctgccataggttgctcctcttgctccccttggtattgggattgtctgctgcccctggatgggcaggtgcaccacctgtggacgttctgcgcgctctgcgctttccatcactgcccgatggggtgcggcgagcgaaaggaatctgtcctgccgatgtggcgtatagggtcgctagaccagcccagctttcagctccaacaagacaactttttccaggaggctttcccaaagatttctccctgctgaccgtggtaaggactcggccaggactacaagcccctctgttgacactgtacagcgcccagggagttcgccagctgggattggagcttggaccgcctgtaagattcctgtacgaggatcaaaccggacggccacagcctccgagtcagcccgtttttaggggccttagcctggccgacgggaagtggcaccgcgtggctgtggcagttaagggtcaatctgtgaccctcatagtggactgtaagaaacgggtgaccagaccactcccccgaagcgccaggcctgtgctggacactcacggtgtgatcatctttggcgctagaatcctcgacgaggaagtgtttgaaggcgatgtacaggagctggcaatcgtgcccggagtgcaggccgcttacgaaagttgtgaacaaaaagagctcgagtgcgagggaggacagcgggaaaggcctcagaaccagcaaccgcaccgagcacagcgctcaccccagcagcaaccatctagactccaccgcccacagaaccaggagccccagtcccaggtgcgagaactgggggaacccccttcagctgcacatccccgagagggcaggcatccagggatttctcccccttag

SEQ ID NO: 4734 - DNA, 1875 bp, Artificial Sequence
  Description of Artificial Sequence: Synthetic coding sequence
atggagcggtgtagccgctgccacaggctgcttctgctgctgccgctggttctcgggctttcagctgcgccagggtgggctggtgctcctcccgtcgacgtgctgagagctcttcgttttcctagcctgcccgacggtgtccgaagggccaaaggcatctgtcctgctgacgtcgcgtatagggtagccagacccgcacagttgagcgctccaacacgccagctgttcccgggaggctttccaaaagacttcagtctgttgaccgtggtacgcactcgcccaggcctgcaagcaccactgctgacattgtattccgcccagggagttcgccagctcggcttagaactaggcaggccagttagattcctatacgaggaccagaccgggagaccccagcctccttcgcagccagtgttccggggtctgagtctcgccgacggcaaatggcatcgcgtggctgtggcagttaagggacagtctgtcacgctgatcgttgattgtaaaaagcgggttacacgtcccttgcccagatcagctagacctgtactggacacacacggcgtcattatcttcggcgcacggatccttgatgaagaagttttcgagggagatgttcaggaattggctatcgttcccggagtgcaggccgcatacgaaagttgtgagcaaaaagagctggagtgcgaagggggacaacgagaaagacctcagaaccagcagccccatagggcacagagaagtccccagcagcagcctagccgcctgcataggccacagaaccaagagcctcaaagtcaacctaccgaatcgttatactacgactatgagccaccatattacgacgtgatgacaacgggaacaacacctgactatcaggatcccactccgggagaagaagaagaaatattagagagcagcctcctgcctccacttgaggaggagcagactgatttacaggtaccccctacagctgacagatttcaggccgaggagtacggagaaggcggtactgacccaccagaagggccatacgactatacttatggctatggagacgattaccgagaagagacagaattggggcctgcccttagcgccgagacagcgcactctggcgcagccgcacacggaccaaggggactgaagggcgaaaagggagagcccgcagtcctggagccgggtatgcttgtagaaggccctccaggcccagaggggcctgccggactcattgggcctccagggatacaaggaaatccaggacccgtgggggatccaggtgaaagaggtccacccggacgggctggattacccggatcagacggggctcctggccctcctgggacttccctcatgctacctttcagatttggttccggcggaggggacaaaggcccagtggtggcagcacaggaagcccaagcacaagccatccttcaacaagctagactggctttgcggggtccacctggacccatgggctacaccggtcggcctggaccactcggccagcctggcagtccaggcctgaagggcgagagtggcgacctcggcccacaagggccacgaggaccccagggcttgacagggcctccaggcaaggccggaaggcggggaagggccggagccgacggggcaagaggaatgcctggtgaccctggtgtgaagggagaccgcggtttcgatgggcttcccggactgcctggcgagaaggggcacaggggagacaccggtgcccagggtctccctggccctcctggggaagatggtgaacggggtgacgatggcgagatagggcctagaggactcccaggtgagtctggcccaagaggtctgttggggccaaagggaccaccgggtattccgggacccccatag

SEQ ID NO: 4735 - DNA, 873 bp, Artificial Sequence
  Description of Artificial Sequence: Synthetic coding sequence
atggagcggtgttccagatgtcacagactgctgctcctcctgcccctcgtattaggtctgtctgctgcacccggttgggctggagcacctcctgtggacgtgctcagagcattacggttcccttctctgcccgacggcgtaaggagggctaaggggatctgtcctgccgatgttgcctacagagtggccagacccgctcagcttagcgcacctacacgccagctgttccccggaggctttcctaaagacttttctttgctcactgtcgtgcgaactaggccgggtctgcaggctccactattgactctctactccgcgcaaggggtgcgacagctggggcttgaactgggccgaccagtaaggttcctatacgaagatcagacaggacgaccccagccaccatcccagcctgtcttccgtggcctgtccctggccgacggtaagtggcatcgggtagcagtggctgtgaagggtcaatctgtgaccctcattgttgactgcaaaaaaagagtgaccagacctttgcccaggtctgcgaggcctgtcttggatacacatggggtgataatctttggggctagaattctggacgaagaggtgttcgagggagacgtccaggaactagccattgtgccaggcgttcaagctgcatatgaaagttgcgaacagaaggagttggagtgtgaaggagggcaacgagagcggccacaaaatcagcagcctcatcgtgcccaacgctccccgcaacagcagccatcacggctccaccgccctcaaaatcaagaaccacagtctcaggtgcgagagctcggcgagcctccaagcgctgcccacccgagggagggccgtcatcccggtatttcgcccccatag

SEQ ID NO: 4736 - DNA, 1002 bp, Artificial Sequence
  Description of Artificial Sequence: Synthetic coding sequence
tgaaaccaaagtcctcaagctcaccgaagcacagtgccgcacactgccggactgggacagctgtgtctgcttggttttggcatggactggagagctagcgaagcatggatggtgccgcgagccccaaaaggagcctgggatccccgtgagagtcaagatctcctggacaatagagcacccctgggtcctcgagtgtttcccggacctcgcgttccttcggcactgatggaaaggcgagtgcttaagggctcccaaggatccccagcctgcctgggaccgcctggcgaggtaatacaacccttgcctattcagatgcccaaaaaaactcgcagatccgttgatggttctaggttgatgcaggaggatgaggccatcccaacaggcggagcacccggtagcccaggcggactggaggaaatctttgggtcactggattcgctacgggaggaaatcgaacagatgcggagaccaaccggcactcaggattcaccagccagaacctgccaggaccttaaactttgccaccctgagttgcctgacggagaatactgggtggatcctaaccagggttgcgcacgcgacgccttcagagttttctgtaattttaccgccggaggggaaacctgcgtgacccctcgggacgacgtgacacagtttagctacgtggatagcgagggcagcccggttggcgtggtgcaacttactttcttgaggttgctctccgtatccgctcaccaagacgtgtcctacccctgctccggcgcagctagggatgggcctctccgcctgcgcggagctaacgaagatgaactgagccctgagacatctccttatgtgaaggaattccgcgatgggtgtcagactcagcagggccgaaccgttttagaagtcaggaccccagttctggagcagctacccgttctggacgctagctttagcgatctgggtgcacctcccagacggggtggggtcctgctcgggcctgtgtgctttatgggatag

SEQ ID NO: 4737 - DNA, 4872 bp, Artificial Sequence
  Description of Artificial Sequence: Synthetic coding sequence
tgagcaccacccgttgatgtgttgcgcgctcttcgttttccttccctaccagatggagtgagaagagcaaaaggcatttgccctgctgacgttgcctaccgcgtcgcccgtccggcacaactgagtgcccctacacgtcagctattcccaggtgggttccccaaggactttagcctcttaacggttgttaggacccgcccaggactacaagccccactgttgaccctgtattctgctcagggagtgagacagcttggcttggagctgggtcgtccagtcaggtttttatatgaagaccagactggtagaccacagcccccaagtcagcccgttttcagaggcttgtctctcgcagacggcaagtggcaccgcgttgctgtggccgtgaagggacagtctgtaacccttattgtcgactgcaaaaaacgggtcactaggcccctacctcgaagtgctcgacccgtgctggatacccatggggttattatcttcggtgccaggattttggatgaggaagtctttgagggagatgtccaggaacttgccattgtgccaggcgtccaggccgcatatgaaagctgtgaacaaaaggagcttgagtgtgagggaggccagcgggagcggcctcagaaccagcagccgcatagggcgcagaggtccccccagcagcagcccagtcggctgcatcgccctcagaaccaggaaccccaatctcaagacccaacaccaggtgaagaggaggagatcctagagtcttcactcctcccgccactggaagaagcagcccacgggccacgaggactgaaaggagagaagggagagccagctgtgcttgaaccaggcatgcttgttgagggcccacccggtcccgaggggcctgccggtcttatcgggcctccgggaatccaggggaatcccggtccggtcggcgaccccggagagcgcggaccccctggaagggcgggtctccctggatccgatggcgcacccggaccccctggaacctctctgatgctcccttttcgtttcggaagtggcggtggggacaaggggcctgtggtggcggctcaggaagcccaggctcaggctatccttcagcaggcccgtctcgcattgcggggaccaccaggccctatgggctacactggcagacctgggccactgggccagcctggttccccgggacttaaaggagaatcaggagatctgggcccacagggtccgcgaggaccccaaggccttaccggccctcccggtaaggctggcaggcgcggacgggcaggcgctgacggtgcgcgaggcatgccaggggatcccggtgtgaaaggcgaccgaggatttgatggtctgccaggtctgcccggagagaaaggccatcggggagataccggcgcacaaggccttcccggacctcccggtgaggatggcgagcgcggagacgatggagaaatcggacccaggggcctgccaggtgagtccgggccacgcggtctcctggggcctaagggaccaccaggcatacccggacccccaggggttcgcggaatggacgggccacagggacccaagggaagcttaggaccacagggggagcctggacctcccggacagcaaggcactcccggtacccagggcctgccgggtcctcagggagctattggtccgcatggtgagaagggccctcagggcaagcctggcctgccgggtatgcctggtagtgatggaccaccaggacatccaggaaaggagggccctcctggcaccaaggggaaccagggcccttcaggccctcagggtccactcggctaccctggccctcgaggggtcaagggcgtggatggtattcggggactgaaaggtcacaagggagaaaagggtgaggatgggttcccgggatttaaaggagacatcggcgtgaagggggacaggggagaggtgggtgtgccaggaagtcggggagaagacggaccagaggggccaaagggtagaacaggccctacaggggaccctggccctcctggtctcatgggggagaaagggaagcttggggtcccaggactcccgggatatcctggcagacagggaccaaagggtagcctcgggttccccggttttcctggcgcatccggggagaagggggctcggggactgtcggggaaatctggcccaagaggcgagcgtggccctaccggaccacggggacagaggggacccagaggcgctacagggaaaagcggagctaagggaacctcaggaggtgatgggccacatggacctccaggagagagagggttgcctggaccccagggacctaatgggttccccggaccaaaaggccctcctggccctcctggtaaggacggattgccgggtcatcccggtcagaggggggaggtcggtttccagggaaaaacagggccacctggacccccaggagtcgttggacctcagggggctgctggtgaaaccggacctatgggcgagcgcggacaccctgggcctcccggacccccaggcgagcagggcttgcctgggaccgccggaaaggaggggacaaagggtgatcccggaccgcctggagctcctgggaaagacggacccgctggcctccgcggattccccggagagagagggctgccaggtaccgctgggggacctggtctgaaggggaatgaggggccttcgggcccacctggacctgctggcagccccggagagcgcggtgccgcaggctcaggcggtcccatcggcccaccaggtaggccgggtccgcagggtccaccgggtgccgctggtgagaagggagtgccaggagagaaaggcccaatcggacccactggacgtgatggggtgcagggccctgtgggactgcccggaccggctggtcccccaggcgttgctggcgaagacggggataaaggcgaggttggggatcctggacaaaaggggacaaaagggaacaagggcgagcacgggcctcctggacctccaggtccaataggacccgtggggcagcccggtgcagccggtgccgacggcgagcccggtgctcggggaccgcaggggcatttcggagcaaagggggatgagggaactcgaggctttaacggacctcctggcccaattggtctccaaggacttccaggcccatcaggggagaaaggcgaaacaggggatgtgggacctatggggcctccaggcccacctggtccaagaggccctgcagggcctaatggggctgacggccctcagggcccacccggaggggtcgggaacttaggacccccaggagaaaaaggcgagccgggagagagcggaagccctggtatccagggcgagccaggggtgaagggccctcgaggagagcgcggagagaagggggagagcggacagccaggcgagcctggaccccctggccctaagggcccaacgggcgatgatggacctaaggggaatcctgggccagttggtttcccgggtgatcctggtccgcctggggagggtggaccaagggggcaggacggcgctaaaggagacagaggagaagatggcgaacccggtcagcctggctccccaggaccaacgggcgagaatggacctcctgggcctctcgggaaacgagggccagcaggatcccccggatccgagggtcgtcagggaggcaaaggcgcaaagggcgacccaggagctatcggggctccagggaaaactggcccagtggggcctgcagggcctgcagggaagcccggaccggacgggcttcggggactgcctggctccgtaggtcagcaggggaggcctggagcgactgggcaggctgggccaccagggcctgtaggtcctcccggactccccggactgcgcggtgacgctggcgcaaagggcgagaaaggacaccctgggctaatcgggcttattggaccacctggagagcagggagaaaagggcgatcggggacttccaggcccacagggttcccccggacagaagggcgagatgggcatcccaggcgctagtgggcctattgggccaggaggtccgcctggtcttcctgggccagcaggaccgaagggggctaaaggtgcgacagggccaggcggtccaaaaggggaaaagggggtccagggcccacctggacacccaggaccccctggggaagtaattcagcctctcccgatccagatgccaaagaagacaagacggtcagttgatggtagtagactcatgcaggaggatgaggccattcctaccggaggtgcaccgggatccccgggtgggctcgaagaaattttcggttcgcttgactcactccgcgaggaaattgaacagatgaggcgccctactgggacccaggacagtccggctagaacgtgccaagatctgaagttgtgccaccctgaactgcccgatggagaatactgggtcgatcccaaccagggctgcgctcgggatgcgtttagggtgttttgtaacttcaccgccggaggggagacatgcgtaacaccacgggacgacgtcacacaattttcttacgtggatagcgagggtagcccagtgggcgttgtccaactcactttcttacgactgctatctgtgtctgcacatcaggatgtgagttacccttgttcgggtgcagcccgagatgggcctctgaggctgcggggagcaaacgaagacgaactgtcaccagagacctccccatacgtgaaggaattcagggacgggtgccagacacaacagggcaggactgtgctggaagtgagaacgcctgtcttagaacagctcccagttctggacgcttccttctccgacctcggggcacctcctagacgcggtggtgttctcctcgggccagtctgtttcatgggctag

SEQ ID NO: 4738 - DNA, 4953 bp, Artificial Sequence
  Description of Artificial Sequence: Synthetic coding sequence
atggagaggtgtagtcgctgccaccggttgcttctccttcttccgttagtgcttggcctgagcgcagcacctggttgggccggagctccaccagtagacgtgttgcgcgctttaagattcccaagcctgcccgatggggttaggcgagccaaaggtatctgccctgccgatgtggcatatcgggttgccagacccgctcaactgagcgccccaacacgacagctctttccaggagggttcccaaaagactttagtctcttaaccgtggtcaggactaggcccggtctccaggcccctctcctgactttgtattctgctcagggggtgcggcagttaggactggagctggggaggccggtcaggttcctctacgaggatcagacaggacgccctcagcctccatcccaaccagtgtttcgagggctgtcgctggccgacggcaaatggcaccgcgtcgctgtggctgtgaaggggcaatccgttacgctgattgttgactgcaaaaagagagtgacacgacctcttccccgttctgcacgacccgtgctcgacacacatggcgtcatcatttttggagccagaatcttagatgaggaagtgtttgaaggagatgtccaggaacttgccattgtacccggtgtgcaggcggcttatgagagctgtgaacaaaaggagctcgagtgtgaaggcggtcagcgagaacgtccacagaaccagcagccacatcgtgcacagcgctccccgcaacaacagcctagtcgccttcatcggccacagaaccaggagccccagtcacaggatccaacacctggtgaggaggaagaaattttggagtcatccctcctgcctccactggaagaggccgcacacggcccacgaggactgaaaggagagaagggggagcctgctgtgctggagccaggaatgctcgtcgagggaccaccaggccctgaaggacctgcaggtctgatcggcccaccagggatacagggcaaccctggaccagtcggtgatcccggagaacgcggaccccctggcagagccggacttcctgggagcgacggtgccccaggtccccctggcacctctttgatgctgccctttaggttcggtagcggtggcggtgacaaaggccctgtggttgcagcacaagaagcacaggctcaggcaatccttcaacaggcaaggctggcattaagaggcccaccaggccctatgggatataccggaaggcctggcccattgggccaacccggatcacccggactgaagggagagtcaggagatcttggccctcagggacccaggggacctcagggcctgacaggacctcccggtaaagccggacgcagggggagagcgggtgccgacggggctcgcggtatgcccggtgaccccggagtgaaaggagacagaggattcgacggattgcccggtctaccgggagagaaaggacacagaggagataccggcgcacagggcctcccagggcctccaggcgaagatggcgagcggggtgacgatggagagatcggaccacgcggacttcctggcgagtctggtccacggggactgctgggccctaaagggccacctggaattcccggaccacctggcgtacgagggatggacggtcctcagggcccaaaggggtctcttggccctcagggagagcctgggcctccaggccaacaaggaactccgggaacacaaggactcccgggaccccagggggcaatagggccacacggagagaagggcccacagggtaagcctggcctacctggaatgcctggtagtgatgggcctcccggacaccctggaaaagaaggaccccctggaacaaaaggaaatcagggcccaagtggtccccaagggcctcttgggtaccccggtcccagaggcgtcaagggtgtggatgggataagggggctgaagggacataaaggggaaaagggcgaagatgggttcccaggattcaaaggggacataggagtgaaaggtgatcgcggtgaggttggggtgcctggaagcaggggagaggatgggccagagggcccaaagggcaggactgggccaaccggcgatccaggccctccaggtctgatgggggagaaaggaaagttgggagtgcccggactcccgggttatccgggacggcagggtcccaaagggagccttggcttcccaggctttcccggagcctctggagaaaagggagcaagaggcctttccggaaagtctggtcctagaggcgaacgaggaccgactgggccacgcggacagcgcggacctaggggagctacaggcaaaagcggggcaaagggcacctcaggtggagatggcccacatggaccccctggggagagagggctgcccggtcctcagggtccaaacggatttccagggcctaaaggcccaccaggtccccctggaaaggacgggttaccaggccacccaggtcagcggggagaagttggcttccagggcaaaactgggccacccggtcctcctggcgtagttggtccacagggcgcagcaggcgagacgggtcccatgggcgagcggggacaccccggaccacctgggcctcctggggagcagggccttccgggtaccgccggaaaggagggaactaagggcgatccaggcccacccggagccccagggaaggatggcccagctgggttgcgcggattccctggtgagagaggtctacctggaaccgctggcggacccggactcaagggtaacgaggggccttctgggcctcctggtccagcgggaagtcccggagaacgtggcgctgccggatcaggcggtcctattggcccacctgggcgacccggacctcaggggccacctggtgccgcaggggaaaagggggtgcccggagagaaaggaccgattgggccaaccggcagagacggtgttcagggtcccgtgggtctgcccggtccggcaggacctcctggcgtagcaggggaagacggagataaaggggaggttggcgatcctggccaaaagggtacaaagggcaacaaaggggagcatggtcccccagggcctcctggaccaattggccctgtaggacaacccggtgccgctggtgccgatggtgagcccggtgccagaggaccacaggggcatttcggcgctaagggcgacgagggtactcggggattcaacgggcctccaggacctattgggcttcaggggctcccgggtcctagcggagagaagggtgaaaccggagacgttggaccgatgggccctcctggtccgccaggcccaagagggccagccggtcccaatggagctgatggccctcaagggcctcctggtggggtgggcaacctagggcctccgggagagaaaggagaaccaggcgagtccggctctcctggcatacagggcgagcccggagtcaaagggcctagaggagagaggggtgagaaaggagagtccgggcagccaggagaacccggtcccccaggacccaaaggcccaaccggtgacgatggccctaagggtaatccaggccctgttggctttcccggtgacccaggcccacccggtgaaggagggcctcggggacaagacggagcaaaaggagatcgcggtgaggatggggagccgggacagccagggtcccccggacctacaggtgaaaacggcccacccggacctctgggcaaaaggggacctgccggttcaccaggcagtgagggcaggcaaggaggcaagggcgcaaaaggggacccaggagcgattggagccccaggtaaaacaggcccagtcggacccgctgggcctgcaggtaagccaggacccgatggacttcgcggtttgcctggctcggtgggccagcagggtcgacccggtgcaaccggccaggccggtcctcctggcccagtgggccctccagggttgccaggactacggggagatgctggggctaaaggggagaaggggcatcccggactaatcggtttgattggtccgccaggagagcaaggcgagaaaggggatcggggacttcccggaccccaaggaagtcccggacagaagggcgaaatgggcattccaggcgcatcaggcccaattggcccaggcggtccccctggcctccccggacccgctggtccaaagggcgcaaagggcgctacaggccctggtggacccaaaggtgagaagggtgtgcagggccctccagggcatcctgggccacctggagaagtgattcaacccctcccaatccaaatgccgaagaagacccgcagatcagttgacggatcccgcctcatgcaggaggatgaggcaatcccgaccgggggtgccccaggtagccctggagggctcgaagagatcttcgggtccttagattcactccgtgaagagattgagcagatgcggagacccacggggacccaagactctcccgcacgtacctgccaagatctgaaattatgccaccctgagctgccggatggcgagtactgggtcgacccaaaccagggctgcgccagagacgcctttcgggttttctgcaactttaccgccggaggcgaaacatgcgtgacccctagggacgacgtgacccagttttcctatgtggactctgaagggtcccccgtcggcgtggttcagttaaccttcctcaggctgctgtctgtaagcgcgcaccaggacgtctcatatccttgctctggagccgctcgagacggaccattgcgactccgcggagccaacgaggacgaactgtctccagaaacctctccgtacgtgaaagagtttcgtgacgggtgtcagacacagcagggtcggaccgtcctggaggttcgcacacctgtcctggagcagctcccagtgctagatgcctcttttagcgacctcggggcacccccaagaagaggaggcgtattactgggtcctgtgtgctttatgggctag

SEQ ID NO: 4739 - DNA, 873 bp, Artificial Sequence
  Description of Artificial Sequence: Synthetic coding sequence
atggaaaggtgctcaaggtgccaccgactgctgctgcttctgcccctggtgttagggctgagtgccgctccgggttgggctggggcaccacccgtggacgtcctccgggcactgagatttccttcactgcctgatggcgtgcgcagggccaagggtatatgccctgctgacgtcgcgtaccgcgtcgcacgacccgctcagctgagcgccccaactagacagctcttccctggaggatttccaaaagactttagcctcctcacagtcgttaggacacgtccgggattacaggcaccccttctgactctctacagcgcccagggggttaggcagttagggctggagctcggcagaccagttaggtttctgtatgaagaccagaccggtagaccccaacctccttcgcagccagtgtttcgcggtctttccctcgcagatgggaagtggcaccgggtggccgtggctgtcaaaggtcaatctgtgacattaatagttgattgcaagaagcgggttaccaggcccttgcccaggagtgcacgtccagtgcttgacacacacggggtgattattttcggtgcacgcatactcgacgaggaagtcttcgaaggggacgtccaggagcttgctatagtcccgggagtgcaggcggcatatgaaagctgcgaacagaaggagctggaatgcgaagggggtcagagggaacggccacagaatcagcagcctcaccgcgctcagaggtctccccaacaacagccttcgcgcctgcatagaccccagaatcaggaacctcagtcccaagtccgtgagcttggggagcccccaagtgcagctcatccgagagaggggagacacccgggtattagtcccccttag

SEQ ID NO: 4740 - DNA, 1794 bp, Artificial Sequence
  Description of Artificial Sequence: Synthetic coding sequence
taggcacccccagtagacgtgttgagagctctccgattccccagcttgccagacggcgttcgtagagccaaaggcatttgccctgcagatgttgcttatagggtcgccagaccagctcagcttagtgcccctacacgccagctattcccagggggatttcccaaggacttcagtctgcttaccgtggtgagaacccgcccaggcttgcaggccccattgctgacactgtactctgcccagggagtgcgacagctggggcttgaactgggaagacctgtacgattcctttatgaggatcaaacaggaagaccccagccccctagccagcccgtatttagaggactgagtctcgctgacgggaagtggcaccgggtggctgtcgccgtgaaggggcaaagcgttaccctgatcgtggactgtaagaagagggtgacaaggccactgcctcgaagcgcacgtccagtgcttgatacccacggcgtgataatcttcggtgctcggatcttagacgaagaagttttcgagggggacgtgcaggaattggctatcgtccctggtgttcaggccgcatatgagagctgtgagcaaaaggaactggagtgcgagggcggacaacgcgaacggcctcaaaatcagcagccgcacagagcccagcggtccccccagcagcagccctcaaggctgcatagaccccagaaccaggaacctcagtcccagcccaccgagtcactatattatgattacaagcctccctattacgacgtaatgactacaggcaccacaccagattaccaggaccctacaccgggtgaggaagaggagatcctggagtcttctctcttgcccccactggaagaagagcagacagatctccaagtacctccaacagctgatcgcttccaggccgaagagtacggcgagggcggaaccgatcctcctgaaggtccctatgattacacctacgggtatggagatgactacagggaagagactgagctcggacctgccctgagcgctgaaactgctcactccggggcagctgcccacggacctagaggtctgaagggagagaagggcgaacctgcagtccttgaaccgggaatgctcgttgagggcccaccaggaccagaaggccctgccggacttattgggcctcctgggattcagggcaacccaggccctgtgggggaccctggtgagagaggacccccaggccgagccggactgccaggctccgacggcgctccagggccaccgggaacctccctgatgctgccttttagattcggcagtgggggtggtgacaagggccctgtcgtggctgcacaggaagctcaggctcaggccattctgcagcaggcacggctggcgctcaggggccctcccggaccgatgggctataccggacgtcccggaccgctgggccagcccggaagtcccggacttaagggggaatccggggatctggggcctcagggtcccagaggaccacagggcttaaccggaccaccaggaaaagctgggaggaggggccgtgctggcgctgacggcgcaagaggaatgcccggagacccgggagttaaaggtgatagggggttcgacggccttccaggcctccctggagaaaagggccacaggggtgacacaggcgctcaaggcctgcctggcccaccaggggaagacggggagagaggcgacgacggggagatcggtcctcgcggactcccaggcgaatcggggcctaggggtctgttggggccaaagggtccccctggtattccaggtcccccttag

SEQ ID NO: 4741 - DNA, 4953 bp, Artificial Sequence
  Description of Artificial Sequence: Synthetic coding sequence
atggagagatgcagcagatgtcaccggctcctgctgctgctgcccctggtgctcggcttgagtgcagcccctggttgggccggagcacccccagtcgatgttctgagggcactcaggttcccatcactcccggatggtgtgagacgcgctaaaggcatatgtcctgccgatgtggcctacagagtagcgcgtcccgctcagctgtccgctcccacgcgccagttgttccctggcggatttccgaaagatttcagcttactcaccgtcgtccgcacccggcctgggctgcaggcccctctgctgactttatactcggctcaaggggtgcgccagctcggcttagaactcggccgaccagtgcgcttcctgtatgaagatcagacgggcagaccccaacctcctagccagcctgtgtttcgaggcctatccctggctgatggtaaatggcacagggtggccgtggccgtgaagggacaatctgtcacacttatagtagattgtaaaaaacgagttacgcggcctctgcccaggagcgcccgaccggttctggatacgcatggggtgataatttttggggctagaatcctcgatgaggaggtatttgaaggcgacgtgcaggagctcgcaatagttccaggcgtacaggctgcttacgagagttgcgagcagaaagagctcgaatgcgagggcggtcagcgcgagcgcccacagaaccagcagccacatagagctcagcgttccccccagcagcagcctagccgactccatagacctcagaaccaagaaccacagtcacaggacccgactccgggtgaggaggaagaaatcctcgagagctccttgctgcctcccctggaggaggcagcacacggcccaaggggcttgaagggggagaagggagaaccagccgtcttggagcccggaatgctggtagaagggcctccaggcccagaaggccctgccggtctcattggacctcctggcattcaaggaaacccaggccctgtcggggacccaggagagaggggaccacccggacgagccggtctgcctgggtccgacggggcacctggacccccagggacatcattgatgctgccgttccggttcggtagtggcggaggggacaagggtcccgtggtggcggctcaggaggcgcaagcgcaggcaattcttcagcaagcaaggctggctctgcgaggaccgccaggcccaatgggctacacggggaggcccggtcctttgggacagccagggtctcccggactaaaaggggagagcggcgacctggggccacaaggaccgagaggaccccagggactgacagggcctccgggaaaggcaggacgtaggggaagagcaggggctgacggcgctcggggaatgccaggcgatcccggtgttaagggcgatagaggcttcgacggattgccagggctacctggcgaaaaagggcatcgcggtgatacaggggctcagggcttgccagggccacctggagaggatggcgagaggggggacgatggcgagatcggtccacgcggtctacccggtgagagtgggcctagaggactactgggacccaaggggcctccaggcattcccggtccacccggtgtgagaggaatggacgggcctcagggacccaaggggagcctaggacctcaaggcgagcctggaccacccggtcagcagggtacaccaggcacacagggattacctgggcctcagggcgcaatcggaccgcatggtgagaagggcccacagggaaaacctggcctccccggtatgccaggcagcgacggtccccctgggcatccagggaaggagggtccacctggtaccaagggaaaccaggggccatccgggcctcagggtcccctgggctaccccggacctagaggggtgaaaggcgttgacggcatccgaggcctcaaaggacataaaggcgagaaaggcgaggatggctttccagggtttaaaggagacattggagtgaaaggggaccgcggagaggtcggcgtgcccggtagtagaggtgaggatggaccagagggccctaaaggacgaacaggtcccacaggcgacccaggtccaccgggactaatgggtgaaaaaggaaaattgggcgttcccggactgccaggctatcccggaaggcaaggtcctaaagggagcctgggtttccccggatttcccggtgcctcaggcgagaaaggggcaaggggtctgagtggcaaatccggccctcgaggagagcggggaccgaccggacccaggggccagaggggcccaagaggagcaacaggcaaaagcggcgctaaaggaacttccggcggtgatggaccgcatgggccacctggagaacgcggattgcccggaccgcagggcccaaacgggtttccaggccctaaaggccctcccggaccaccgggtaaggacggcctgcccggacaccccggacagaggggcgaagttggattccagggaaaaactggcccaccgggacctcccggagtcgtggggccacaaggagccgcaggggagacgggtcctatgggagaacgtgggcacccgggtcctccaggacctcccggtgaacagggactaccaggcactgcaggcaaagaagggactaaaggcgatcctggacctccaggggctcctgggaaagatggtcccgctggcctccgcggtttcccaggggagcgcggtctccctggaactgcgggtgggccaggcctaaaaggtaacgagggccctagcggcccacccggacccgctggcagcccaggcgagagaggggctgcaggtagcgggggacctatcggccctcccggtagacctggcccacaaggaccacccggtgccgctggcgagaagggcgtgccaggcgagaaagggcctatcggcccaactgggagagatggcgtgcaggggccagtggggctgcctggcccagcaggcccacctggagtcgcgggagaagacggtgataaaggagaagtgggagaccccggtcagaagggaactaaagggaacaaaggagaacacggtccccctggtcccccaggccctataggcccagtgggccaacctggagcggctggtgcagatggtgaaccgggagctcgcggacctcagggccactttggcgctaagggggatgagggcacgcgtggcttcaatgggcctcctgggcctattgggcttcagggtctaccaggccctagcggtgagaagggcgaaacaggcgacgtcgggcctatgggtccaccaggcccaccaggccctagagggccagctggccctaacggcgctgacggccctcaaggaccccctgggggagttggtaacctcgggcctccaggggagaaaggtgaaccaggcgagtccggctcgccagggattcagggagagccgggtgtcaaagggccacggggtgaacgtggagaaaaaggggagagcggacaacctggcgagcccggaccaccaggacccaagggacccaccggcgacgatggcccaaaaggaaatcctgggcctgtggggttccctggtgatcccggacccccaggggaaggaggccctcggggacaggatggcgctaagggtgatcgcggagaggatggcgagcctggacagccaggctcccctggccctacaggtgagaatggaccaccaggtccgctgggtaaacgaggtcccgctggctctcctgggagcgaaggcaggcagggcggaaaaggcgcaaagggcgaccccggtgctatcggtgcacctggcaagacaggccctgtgggtcccgctggtcccgcaggaaaaccaggcccagacggattgagggggctcccgggaagtgtgggtcaacaggggcgtccgggagctaccggccaggccggaccgccagggccagttggcccaccaggactgccgggactccgaggcgacgcaggtgcgaagggagagaaagggcaccccggtctgatcggattgatcggcccacctggagagcaaggtgaaaagggtgacagggggcttcccggaccccagggatcacccggacagaagggtgagatgggcatccctggggcatccgggccaattggccctggcggacccccaggcttgccgggtcctgccggtcctaagggagccaagggtgctaccggtcccggaggacccaagggagaaaaaggagtgcaagggccacctggacaccccggaccaccaggggaggttatacagccactgcctatccaaatgccgaagaaaacacgacggagcgtggacggtagccggctgatgcaagaggacgaggccataccaaccggaggcgcacccggtagccctgggggactagaggaaatctttggcagcctggattcactccgggaggagattgagcagatgcgcaggcccactgggacccaagacagtccagccaggacatgtcaggatctgaagctctgccatcctgagctgccggacggggagtattgggttgaccccaaccaggggtgcgcaagagatgctttcagggttttttgcaacttcacagccggaggagagacgtgcgtcacaccaagagacgacgtgacacaattctcctacgtggactccgagggctcgccagtgggtgtcgtgcaactgacgttcttgcgcctgttatctgtgtctgcccaccaggacgtgtcttatccatgctccggggctgccagagatgggcctttgcgactcagaggggcaaacgaagacgaactgagcccagaaacatccccgtatgtaaaagagtttagagacgggtgtcagacacagcagggaagaactgtgctagaggtgcgcacccctgttttagaacaactccctgtccttgacgcgtcattctctgacttgggagcaccacctagacgagggggtgttctgctggggccagtgtgtttcatgggatag

SEQ ID NO: 4742 - DNA, 1875 bp, Artificial Sequence
  Description of Artificial Sequence: Synthetic coding sequence
atggagcgctgcagccgctgtcacagacttttactactgcttccccttgtacttggactgagcgccgcacctggatgggctggggctcccccagtcgacgtgttacgggctctgaggtttcccagcctcccggacggagtgcgccgagctaagggaatctgccccgctgatgtggcctatcgcgttgctagacccgctcagcttagcgctcccactagacagcttttcccaggcggattccctaaggatttctcactcctcacggtggtcaggacccggcctggtttgcaagccccactcctgaccttatactccgcccaaggagttcgccagctaggacttgagcttggaagaccagttaggttcctatatgaggatcagacgggcagacctcaacctccaagccagcccgtatttagaggcctctccttggcagatggtaaatggcaccgtgtggccgtggccgtgaagggccagtcggttaccttgatcgtggactgtaagaaaagggtaactagacccctgcctcgttcagcccgacctgtactggacacacatggagtcatcatctttggggcaagaatactggacgaggaggtgttcgaaggagatgttcaggagctggctatcgttccaggtgtgcaggccgcttacgagtcttgcgaacagaaggaactcgagtgcgaaggcggacagcgcgagaggccgcagaatcagcaaccccacagggcccagcggagtccccaacagcagcccagccgtttgcaccggccacagaaccaggaaccccagtcacagcctacagagtctttgtactatgattacgaacccccatattatgacgtcatgactactggcaccacccctgactaccaggaccctacacccggagaagaggaagaaattctggagagcagccttttgcctcctttggaggaggagcagacggatcttcaggtcccgcctaccgctgaccggttccaggccgaggaatatggggaaggagggaccgacccccctgagggcccatacgactatacttacggctacggcgacgattaccgcgaggagacagagctgggtcccgctctgtcagccgagaccgcccatagcggcgcagccgcacacgggcctcgcggacttaagggtgaaaagggagagcctgccgtactggagcctggaatgttggtggagggcccaccaggccctgaagggccagcgggactgatcggcccacctgggatacagggaaaccccggtcctgtcggcgaccccggtgagcgcggacctcctggccgtgcagggttacccggatccgatggtgcccctggccctcctgggaccagtttaatgctgcccttcagattcgggtccgggggaggcgacaagggacccgtcgtcgccgctcaggaggcccaggcccaggctatactccaacaggcacggctcgctctgaggggccctcctgggcctatgggatataccggtaggccaggaccattaggccagccagggtcaccaggtctaaaaggtgagtctggggacctgggcccacagggaccgagaggacctcaggggctgacgggaccgcctggtaaagcaggcaggagagggagagccggtgctgatggtgccaggggcatgcccggtgacccaggtgtcaagggagataggggattcgatggactgcccggtctgcccggagagaaaggccaccgaggtgacacaggcgctcagggactgccagggcctcccggtgaggatggtgaaaggggcgatgatggtgagatcgggccaaggggactccccggagagtcgggacctagagggctgctcggccctaaaggccctcctgggattcccggtcccccatag

SEQ ID NO: 4743 - DNA, 1875 bp, Artificial Sequence
  Description of Artificial Sequence: Synthetic coding sequence
atggaacgatgttcccggtgtcaccgcctcctgttgctgctgccactcgtgctggggctgagtgccgctcccggttgggctggagcgcctcccgtcgatgtgctcagggccctccgctttccttccttgcccgacggtgtccgcagagcaaaaggcatttgccctgccgatgtcgcctatcgagtggcaaggcctgcacagcttagtgccccaactcgccaactgttccccggtggcttcccaaaagacttctccttgctgaccgtcgtgagaacgcgcccaggtcttcaggctccactcctgacgttatactcagcacagggagttaggcagttaggactggagttgggaccacctgtcagatttttatacgaggaccagaccggtagaccgcagccaccatcccaacccgtgttccggggactctctcttgccgatggtaagtggcacagggttgccgtcgccgtgaaaggtcaaagcgtaactctaatcgtggactgcaaaaaacgggtgactcgccctttgcccaggagcgctcgccctgtccttgacacccatggggtgataattttcggagccaggatccttgacgaggaagtttttgagggcgatgtgcaggaactggcgatcgttccgggagtgcaggccgcatacgagagctgtgaacaaaaagagttggagtgcgaaggcggacagcgggagcgcccacaaaatcagcagccgcatcgtgctcagagatctcctcaacagcagccaagtcgactccatagaccgcagaaccaggagcctcagtcccaacctacggagagcctatactacgactacaagccaccatactacgacgtgatgacaacaggcactacacctgactaccaggaccccacccctggtgaggaagaagaaatcctcgaatcatcactcctccctcccctagaggaggagcagacagatctgcaggtaccgcctacggccgaccgatttcaagcagaggagtacggcgaaggtggtactgacccccctgagggcccttacgactatacctatgggtatggggacgattatagagaagagactgagttggggcctgcgctgtccgcagaaactgcccactcaggcgctgctgcacacggcccacgtggattgaaaggcgagaagggtgagcctgccgttttggagccgggaatgctggttgaagggcctccaggcccagaggggccagccggactcatcggccctccaggcatccagggcaaccctggccctgtgggtgaccctggagagcggggaccaccaggaagggctggcctccccggttccgatggggctccaggccctccaggtacttccctgatgctgccctttcggttcggttccgggggtggcgataaaggacctgtggtagcagcccaggaagcacaggcacaagcgatcctgcagcaggctcggctggccttgaggggtcccccaggacccatgggttacaccggaagaccaggccctctggggcagcctgggagtccaggtctcaagggggagtccggagacctgggacctcaaggtccaagagggcctcagggcctgacgggacccccagggaaggctggcagaaggggaagggcaggcgcagacggcgcaagaggcatgcccggagacccgggtgtcaaaggggaccggggatttgacggcctgcctggcttgcccggtgaaaaaggccatcggggtgataccggagcacaggggctccctggaccacctggagaagatggggagcgaggcgacgatggcgaaatcgggcctagagggttacccggtgaatcaggtcctcgcggactgcttgggccaaaaggtccacccggaattcctggccctccgtag

SEQ ID NO: 4744 - DNA, 1875 bp, Artificial Sequence
  Description of Artificial Sequence: Synthetic coding sequence
atggagcggtgctcacggtgtcaccggctgctattgctcctgcctctcgtgcttgggctgagcgccgcacccggttgggcaggagcgcctccagttgatgtgctgcgggcactgaggtttcccagtcttcccgacggggtcagaagggccaaggggatctgtcccgcagacgtggcttatagggtcgctaggccagcccagctgtctgctcctaccaggcagctgtttccgggaggatttccaaaggatttctctctgcttacagtagtcagaaccaggcctgggcttcaagccccactactcaccctctactccgcccaaggtgtgcgacagcttggtctggaacttggacggcctgtgcgatttctttacgaggaccagaccggcaggccccagcctccaagccagccagtattccgtggactctccctcgctgatggaaaatggcacagggtggcggtggctgtgaagggccagtccgttacgttaatcgtcgattgcaaaaaacgtgtaacccgcccactgccccgtagcgctcgccctgttttagacacacatggggtcattatatttggcgctcgaattctggatgaagaagtgtttgagggcgatgttcaggagctggccatcgtccccggagtacaggccgcatacgagtcatgtgagcagaaggagctcgagtgtgaaggcggtcagcgcgagcgcccacagaatcagcagccacatagggctcagcgttctccacagcagcagccctccaggttacaccggcctcagaatcaagagccccagagccagccaaccgaatcactctactatgactataagcctccatattacgacgtcatgactaccggcacgacaccagactaccaggaccctacacctggagaggaagaagaaattctagaaagctcactgttgcctccactggaagaagagcagaccgacttacaggtgcctccaaccgcagatcgctttcaggcagaagaatacggcgaggggggtactgaccctcccgaaggaccttacgactatacatatggatatggtgacgattatcgggaggagaccgagcttggccctgctctatccgccgagactgcccattcaggcgctgctgctcacggccctaggggcctgaaaggcgagaagggggagccagcagtcttggaacctgggatgctggttgagggacccccaggtccagaaggccctgccggactgataggtccacccggaatacagggtaacccagggcctgtaggcgaccccggagagcgcggacccccagggagggcaggcctgcccggaagcgacggggcaccaggaccgcctggaacctcgttgatgctgccttttcggtttggttcgggcggaggggataagggccctgtggttgcagcacaggaggctcaggcacaagcaattctgcagcaggcgcgattggcactccggggaccacccggaccaatgggctatactggacgcccaggacccctggggcagcccggatctcctgggctgaagggcgaatctggcgacctggggcctcagggcccaaggggcccacaggggctgactgggcctccagggaaggccggacggagaggtcgagccggagcagatggtgcgcgaggtatgcctggggatcctggagtcaaaggagatagaggcttcgacggtctccctggcctgcccggtgagaaaggtcaccgaggcgatacgggcgctcaggggcttcctggaccccctggtgaagacggcgagaggggcgatgatggtgaaatcggaccccgtggtttgccaggcgaatctggcccacgagggttactgggtcctaagggaccccctgggataccgggtcccccatag

SEQ ID NO: 4745 - DNA, 873 bp, Artificial Sequence
  Description of Artificial Sequence: Synthetic coding sequence
atggagcgctgttcacgctgccatcgtctgcttctgcttctacctttggtgctgggattatccgccgcaccaggctgggcgggagccccaccagtggatgtcctgcgcgcattacgattcccctctctgccggacggagtgagacgcgcaaaaggtatttgcccagctgacgtggcgtacagagtggcgagacccgcacagctaagtgccccaacgagacaactcttccctgggggtttccccaaagacttcagcctgctgactgtggtgcgtacacggccagggctccaggccccactactaacactgtacagcgcccagggggttaggcagcttggcttggagctgggaagacctgtgcgctttctttacgaggaccaaaccggtcgcccacagcccccaagccagccagtattccggggtctgagcctcgcagatggtaagtggcatagagttgcagtcgccgtgaaagggcaatccgtcactctgatagtagactgcaagaaaagagtgacccggccactgccccgttcagcccgtcctgtccttgacacccatggagtcataattttcggagctcggatactcgacgaagaggtgtttgagggtgatgtgcaggagctggccatcgtgcccggagtgcaagctgcttacgagtcatgcgaacagaaagagttggaatgcgaggggggtcagcgggagcggccacagaatcagcagccacaccgcgctcagaggtctcctcagcagcagccctcgaggcttcatagacctcagaaccaggagccacagagccaggtacgcgaactgggcgagcccccaagtgcagctcatccacgagaggggaggcaccctggaatcagtcccccttag

SEQ ID NO: 4746 - DNA, 1875 bp, Artificial Sequence
  Description of Artificial Sequence: Synthetic coding sequence
atggagcgttgttcccggtgccacagactcctgctgctgctgcctttagtgctgggtctgtccgccgctccgggttgggccggagccccacctgtggacgttctcagggcccttaggttcccaagtctgcctgacggggtgaggagggcaaagggtatctgtcctgccgacgtggcctacagggtggcacgaccagctcaactctcagcacccaccaggcagctcttcccaggcggattccctaaggacttcagtctgctgacagtggtccgcactcgtcccggtctgcaagccccactgctcacactgtattcagcccagggcgtgcgacagttgggactcgaactcggcaggcccgtgaggtttctgtatgaggaccaaaccggcagaccacagccacccagccagccagtgtttagaggactgtctctggcggacggaaaatggcacagggttgcagtggcagtcaagggccagtcagtcacactgatcgtggattgcaagaagagagttacccggcctctaccacgatccgcacggcctgtgcttgatacacatggtgtgattattttcggcgcacgtatactggacgaggaggtgttcgaaggagatgtccaggaacttgccatcgtgcctggggtgcaggccgcatatgagagctgtgaacaaaaggaactagaatgcgagggaggacagagagaaagacctcagaaccagcagccacatagagcacagaggtctccccaacaacagccatcccggttgcacaggccacagaaccaggagcctcaatctcagcctactgagagcctgtactatgactacgaacccccatattacgatgtgatgaccaccggaaccacccctgattaccaggaccctaccccgggagaggaagaagaaatcctcgagtcttccctacttcctcccttagaagaggagcagacagacctgcaggtcccccctaccgcagaccgcttccaagccgaagaatacggggaggggggaacagatcccccagaagggccttatgactacacctacgggtatggagacgattaccgcgaagaaactgaactagggccagctctcagtgctgagacagctcacagtggagccgctgcacatggcccacgaggtttgaagggagaaaagggagaacccgctgtcctcgagcctggaatgcttgtggaagggcctcctggacccgagggccctgccggtttgattggtcccccaggaatccagggcaatccgggaccggtgggggatccaggcgaaagaggtcctcccggtagagctggactgcctggctctgatggcgcaccaggaccccctggaacctcactaatgctgcctttcaggtttggctccgggggaggagacaaggggcctgtggtcgcggctcaggaggcgcaagcacaggcaatcctccagcaggccaggctggcactgcgcggacccccagggcctatgggctatacgggaaggccgggacccctcgggcagcctggttctccagggctgaaaggcgagtctggcgatctgggccctcagggacctagaggaccccaagggctgaccggccctcccggtaaggctggcaggagaggacgtgccggagcagatggcgctcgcggtatgcctggcgatcctggagttaagggagacagaggattcgacggattacctggcctgcccggagagaaaggacatcgcggagacaccggcgctcagggtctgcctgggccacctggcgaagatggagagaggggagatgatggtgagattggacccagggggctgcccggagagtcaggaccgaggggcctgttgggtcctaagggtcccccaggcattcccggtccgccttag

SEQ ID NO: 4747 - DNA, 5069 bp, Artificial Sequence
  Description of Artificial Sequence: Synthetic coding sequence
atggagaggtgctctcgatgccaccgcctgttgttactgttgcctcttgtgctgggcctatcagctgcccctggctgggcgggtgctcctcctgtggatgtgctgcgagcccttagattcccatcactgcctgatggcgtgcggcgtgcgaagggtatttgtcctgctgacgtagcctacagggtggctcgaccagcccagctgagcgcacctactaggcagctcttcccagggggtttcccgaaggacttcagcctgctaacagtcgtgcggacccgccctgggctgcaagcccctttgctgacgctgtattcggcccagggcgtgcggcagctcgggttggagctcggccctccagttaggtttttatatgaggaccagacaggtaggcctcagcctccttcccagccggttttccgtggcctgagtctcgcagatggaaagtggcacagggttgccgtagcagtgaaaggtcaatcagtgacactgatcgtggactgcaagaaaagagttacccgccctctgccacgatcagcacgtcccgtgctcgatacccacggggttatcatatttggtgcgagaattttggacgaggaagtgtttgaaggcgacgttcaggaactggccatcgtcccaggagtgcaggccgcatatgagtcatgtgagcagaaagaattggaatgcgagggcggtcagagagagcgcccacagaaccaacagcctcacagagcgcagcggtctccccagcagcaaccctcccgcctgcacagacctcagaaccaggagcctcagtctcaggagcagactgatttacaggtgcctcctaccgcggaccgtttccaggccgaggagtacggggagggaggaacagacccaccagaaggaccatacgactacacttacggctacggcgatgattatcgcgaggagactgagctggggcctgccctgtcagcggagactgcacacagcggagccgctgcccatggccctcggggactcaaaggcgagaaaggagagccagccgttctcgagcctggtatgctggtggaagggccacccggaccagagggacctgccggtctgattggccctccaggcattcagggcaacccaggcccagtaggagatccgggagaaaggggacctcccggtcgagctggactacctggctcagacggagccccagggccacctgggacatctctgatgctgccctttagattcggaagcggtggcggtgacaaggggccagtagtcgcagcacaggaggctcaggcacaagcgatcctgcagcaggcgagattggccctgcggggtccacccggtccaatgggttacactgggaggcccggaccgctcggccagcccggatcacctggcctgaaaggggaaagcggcgacctcgggcctcagggtccaaggggccctcagggacttactggacccccaggcaaggccggaagacgaggtcgcgctggggcagatggcgcacgcggtatgccgggagatcccggtgtaaagggcgaccgtggcttcgatggcctccctggcctcccaggtgagaaagggcacaggggggacaccggtgcacaggggcttccgggaccgcctggagaggatggcgaaagaggtgacgatggcgagatcgggcctaggggcctgcctggcgaaagtgggcctcggggactgttgggacctaaggggcctcctggtattcccggtccgcctggggtccgcggtatggacgggccacaaggtccaaagggatctctgggaccccagggagagccaggccctccaggacagcagggcacccctggaactcaaggcttacccggtccccagggtgcaatcggcccacatggagagaagggaccgcaggggaaaccgggtctccccggtatgcccggatctgacggccctccagggcacccaggcaaagaaggccctccgggaacgaagggaaatcagggtccatctggccctcagggacccctcggctaccctgggcctcgtggagtaaagggagtggatgggatccgcggactgaaggggcataagggcgagaagggcgaagatggcttccctggttttaagggagacatcggggtgaaaggggaccgcggtgaggtgggagttccagggtctcgcggtgaagacggccctgaaggccctaagggacgaaccgggcctacgggagaccctgggccaccgggactgatgggcgagaagggcaaactgggcgtgcctggactgccgggatatcccggaagacaggggcctaagggtagtcttggattcccaggctttcccggtgcaagtggcgaaaaaggagctagaggtctgtccggcaagtccggacctagaggagaacggggtcccacaggaccccgaggccagcgcggacctcgtggcgcaactggtaagtctggcgcaaagggcacatccggtggagatgggcctcacggtccgcctggggagcgcggactgccgggaccacagggacccaacggattccccggacccaagggcccacccggacctcccggaaaggatggcctgccagggcacccgggtcagaggggggaagtcggtttccagggcaaaactggcccaccaggtccaccgggtgtcgtcggcccacagggcgcagccggtgaaaccgggcctatgggcgagcgaggtcaccctggtccaccagggccacctggtgagcagggcctgcccggtacagctggcaaagagggcacaaagggggatcccggtccacccggtgcacccggtaaggatggaccggcagggctgcgcggattcccaggagagcgtggactccctgggaccgccggtgggcctggactaaaaggaaacgaggggccatccgggcctcctggtcccgctggtagtccaggagagcgcggtgccgcaggctcagggggacctattggtcctcccggaagaccgggtccccagggccctcccggagccgcaggcgagaaaggcgtgcccggtgagaaagggccaatcggcccaacagggagggatggggtgcaaggccctgtgggcctgcccggacctgctggccctcctggagtcgccggagaggacggggataaaggagaagtgggggacccaggccagaaagggactaaaggaaataagggagaacatggtccacccggaccaccaggtcctatcggaccagttggccagccgggagccgctggcgcagacggagagcccggagcaagaggcccacaaggtcattttggagcaaagggtgacgagggaacaagggggttcaacggacccccaggcccaattggcctgcagggcctccctggaccctcaggggagaagggggagaccggagacgtagggccaatgggaccccctggacccccaggccctagaggtccggctggccctaatggggcagacgggcctcaagggcctccgggaggggtgggaaatcttggcccacctggcgagaaaggggagcccggagagtctggctcccccggtattcaaggcgaacccggagttaaaggccctcggggtgaaagaggagaaaaaggcgagtctggccaacctggcgagcctgggccacccggaccgaaagggcctacgggcgacgatggccctaaaggcaacccaggcccagtcggttttccaggggacccgggtcccccaggtgaagggggtcctaggggccaagatggagcgaaaggtgatcgcggagaagacggggagccaggacagcccggttcacccggtcccactggggaaaacggtcccccaggtcctctgggaaagagagggcctgcaggctctcctggaagcgagggtcgccaaggaggcaagggcgcaaagggggatccaggagctatcggcgctccgggaaagacaggacctgtcgggcctgctggccctgcaggcaagccgggaccagatggcctccggggtttacctggaagcgtggggcagcaagggaggcccggagccactggccaggctggcccaccaggcccagttggacctccagggttgcccggtctgcgcggagatgctggcgcaaaaggcgagaagggtcatccgggtcttatcggattgatcggaccccctggtgagcaaggcgagaaaggggaccggggactgccaggaccacaaggctccccgggtcaaaagggtgagatgggcatccctggcgcaagcgggccaatcgggcctggcggacccccaggcctacccggaccagcaggaccgaagggcgcaaagggtgcgaccgggcctgggggaccgaagggcgagaagggtgtccaaggaccacccggacaccctggcccaccaggcgaagttattcagccgctcccgatccagatgcccaagaaaacccggagatccgtggatggttccagactcatgcaggaggatgaggcaatccctaccggcggagctcctggatctcctgggggacttgaagagatttttgggagcctggattcgctgagagaggaaatcgagcagatgcggaggccgacgggtacacaagattcccccgcacgcacatgccaagacctaaagctgtgtcatcctgaactgccagacggggagtactgggtggaccctaatcagggatgcgccagggacgctttccgcgtgttctgtaatttcaccgccggaggcgagacatgtgtcactcctcgcgacgatgttacacagttctcctatgtggattcggaaggatctcctgtaggcgtggtgcagttgacatttctgcgcctgctgtctgtatctgcgcaccaggacgtatcatatccatgttccggagccgcacgcgacggaccgctgcgtctgaggggcgcaaacgaggatgagctcagtcccgagacatccccttacgtgaaggaatttagagatggctgccagactcagcagggcagaacagtactggaagtgagaactcctgtgctggaacagcttccggttctggacgccagtttctcagacctgggagctccgccacggagaggaggtgtactcctaggaccagtatgttttatggggta

SEQ ID NO: 4748 - DNA, 5132 bp, Artificial Sequence
  Description of Artificial Sequence: Synthetic coding sequence
atggagcgttgcagcaggtgtcaccgtctgctgcttctgctaccattagtcctgggacttagcgctgccccaggctgggccggtgcccctcctgtcgatgtcctgcgggcactgaggttcccatccttaccagatggagtgaggcgcgcaaaagggatttgtccagccgacgtagcttatcgggtcgctaggccagcccagctgtctgcccctacaagacagctcttcccgggaggcttcccaaaggatttcagtctgctcaccgtcgtacgaactcgccctggactccaagccccactgttgacgctgtacagtgctcagggggtgcgacagctcgggctggaattgggtccaccagtccggtttctgtacgaagatcagacgggaaggccacagccacctagccaacccgtttttaggggtctcagtctggctgatggcaaatggcaccgtgtcgccgttgccgtgaagggacagtcagtgactctgatcgttgactgtaagaagcgcgtcactcgccctcttcctcgctcagcccgtccagtgctggacacacacggggtcatcatcttcggtgctcggatcttagacgaggaagtctttgagggcgatgtgcaagagctagcaatagtgcccggagttcaggctgcttacgagtcctgtgagcaaaaagagctggagtgtgagggcggtcagcgcgaaaggccccagaatcagcagccgcaccgggctcaaagatctccccagcagcagccttctcgattacaccgcccacaaaaccaggagccgcagagccaggatcccacacctggagaggaggaagaaatactggaatcatcgctccttccaccattggaggaggaacagacagacctgcaagtgcccccaactgctgatagattccaagccgaggagtacggtgagggcggaaccgatccaccagaaggcccatacgattacacatacggctacggggatgactaccgcgaggagactgagcttggcccagcccttagcgccgagacagcccattctggcgctgccgcacatggtccgagaggtttgaaaggagagaaaggcgaacctgctgttctagagccgggtatgctggttgaaggcccacctgggccagagggaccggcaggtctgatcggaccaccgggaattcagggtaatcccggaccagttggagatcccggtgaaaggggacccccagggagggccggtttgcccggatctgacggggcacctggtccgccaggcacttcgcttatgttaccttttcgcttcggatcaggaggcggagacaagggacccgtcgtagcggcacaggaagctcaggcacaggccattttacagcaggcaagactggccctgcgaggacctcccggtcccatgggctatacagggcgacctggaccattgggccagcctggcagccctggcctgaagggggaatccggcgacctgggccctcaggggccacgtggcccacaaggcctaaccggaccacccggtaaggccggacgcaggggtcgcgcaggcgctgacggtgctcggggaatgccaggagatcctggcgtcaaaggggatcggggttttgacgggcttcccggtttgccaggcgagaagggtcacagaggcgacacaggcgcacaggggctgccagggccacccggagaggatggagaacgcggagacgacggagaaatcgggccacggggtctgcctggggagagcggccctaggggattgttaggtccaaaaggacccccaggtataccaggccctcctggggttcgtggaatggatggccctcaaggaccaaagggctccttgggaccccagggggagccaggtccccctgggcagcaggggaccccaggtacacaaggcttgcctggaccacagggcgctataggccctcatggagagaaggggcctcaaggaaagcccggactgcccggtatgcccggtagcgacggaccacccggacaccccggtaaagaggggcctccaggtacaaagggcaaccaggggccaagcggccctcagggtcccctggggtatcctggtcccaggggagttaaaggtgtggatggaattcgaggactgaagggccacaaaggagagaaaggagaagatggttttcctggatttaagggtgatataggcgtcaagggcgaccgtggagaggtgggagtgccaggaagcagaggagaggatggccctgaaggacccaagggccgaaccggacccacgggtgaccctggaccacccggactcatgggcgagaagggtaaacttggcgtgccaggacttcctgggtaccccggacggcagggtcctaaggggtcattaggatttcctgggtttccaggagcctccggcgagaaaggcgctaggggcttgtctggaaaaagcggcccacgaggcgaaaggggcccaacaggccctcgcggtcagcggggaccaagaggggctacgggcaagagcggtgctaagggcactagcggcggtgatggccctcatggtccccctggcgagagaggcctccccggaccccagggccctaatgggtttcccggtcctaaagggcctcccggacccccaggcaaggacggcctgccgggacaccctggtcagcggggtgaggtgggatttcaaggcaagacaggtcccccaggacctccaggtgtggttggtccacagggtgccgctggagagacgggcccaatgggagagcgtgggcaccctggtccccctggacccccaggcgagcaagggttgcccggaaccgccggaaaagagggaaccaaaggtgaccctggtccaccgggagcccctgggaaggacggcccagctggcttgagagggttcccgggtgaacgaggactccctggaactgcgggtgggccaggactcaaagggaatgaaggcccaagtggccctcccggtcccgcaggtagcccaggggaacgcggagccgcaggaagtgggggacccattggaccacccggacggccaggacctcagggtccccctggagcagccggagaaaagggggtccccggtgaaaagggacccataggcccaaccggtagagatggagttcaggggcctgtgggtcttcccggtccagcgggacctcccggagtggctggtgaggatggcgacaaaggcgaggtcggcgaccccggacagaaaggtactaagggcaacaagggggagcacggtccaccaggtcctccagggcctattggccctgtgggacagcccggagcagcaggagctgatggagagcccggagccaggggacctcagggtcatttcggggcaaagggcgacgagggcaccagaggatttaacggaccccctggccctatcggcctgcagggtctgcccggtccctctggcgagaagggtgagaccggggacgtggggcctatgggcccacctggcccacccggacctcgcggaccggctggcccaaatggtgcagatggaccgcaaggacccccagggggagtaggcaatctgggacccccaggagaaaagggggagcccggtgagtccggctccccaggaattcaaggcgaacccggtgtgaagggacctagaggcgaaaggggcgaaaaaggcgagtcgggccagccaggagaaccagggccacccggtcctaagggaccaactggcgacgatgggccaaaggggaatcccggtcctgtgggtttccctggcgaccccggtccaccgggtgaaggaggcccaagggggcaggatggggctaagggcgataggggcgaggacggagagcctggccagccaggctcacctggtccgactggtgagaatgggcctcctggacccttggggaaacgtggccctgcaggcagtcctggatctgagggccgacaagggggaaagggggctaagggagatcctggtgctattggagcaccaggcaaaaccgggccagtcggtcccgctggacccgctgggaaacctggtcctgacggactaaggggcctgcccggttccgtgggacagcagggtcgacccggagcgaccgggcaggctgggcctcccggtccagttggaccacctggccttcctggcctgcgcggagacgccggtgcaaagggggaaaaaggccaccccggtctcatcggcctcatcggtccaccgggtgaacagggagagaagggagacagaggcctccctggtcctcagggctctcctggacagaaaggggagatggggatcccaggagcgtcaggacctatcggtccaggcggaccaccaggacttccgggaccggctggccctaaaggcgctaagggcgcaaccggccctgggggaccaaagggggagaaaggtgtgcaagggccaccagggcatccaggacccccaggagaagttatccagcccctgcctattcagatgccaaagaagacacggagaagcgtggatggttcccggctcatgcaggaagacgaagccattccgactggtggagcccctggctcaccgggaggactggaagagatcttcggaagtctggattcactgcgggaagagattgaacagatgaggcgtccaactggcactcaggatagccccgcaagaacatgccaagacctcaagctgtgccatcccgagctccccgatggagagtattgggtggaccccaaccaaggctgtgcgagggacgcatttcgggtcttctgcaactttacggcgggtggagaaacatgcgtgaccccacgcgatgatgtcacgcagtttagttacgtggattccgagggctctccagttggtgtggtacagctaacttttctgagactgctgagtgtttctgcacaccaggatgtgagttatccctgctccggggctgctcgcgatgggccactgagactgagaggggcaaacgaggacgagttgagtcccgaaaccagtccttacgtcaaagagttcagagacggatgccagacccagcaaggcagaacggtcctggaagtgcgtaccccagtgttggagcaacttccagtgctagatgccagcttttctgacttaggggcacccccacgtcgcggtggggtgctgctgggccctgtgtgctttatgggata

SEQ ID NO: 4749 - DNA, 4968 bp, Artificial Sequence
  Description of Artificial Sequence: Synthetic coding sequence
atggaacggtgttccaggtgtcacaggctgctgctgttgctgccattagtcctaggcctttcagcagcacccggatgggctggagcaccccctgtcgacgtcttgagggctcttcgcttcccatcacttccagatggggtgcgcagggctaaagggatatgtcccgctgatgtcgcttatcgcgtggccaggcccgctcaattgagcgcccctacccgccagctgtttcccggtggattcccgaaggacttcagcctccttacagtagtgcgaactcgtcccggactgcaagcaccattgctaacattgtattcggcgcagggcgtgcggcagctgggactggagctggggcgaccagtgcgtttcctgtacgaagaccaaacggggcgaccacagccaccaagtcagcccgttttccggggacttagtttagccgatgggaaatggcatcgggtggcagtcgctgttaaggggcaaagcgttactttgatcgtcgactgcaaaaagagagttaccaggcccctgcccaggagtgctagacccgtcctcgacactcacggtgtgattattttcggagctcggattctcgatgaggaggtgttcgaaggcgatgtgcaggagctggctattgtgccaggggtgcaggccgcttatgagagctgtgaacagaaagagctcgaatgcgagggtggacagcgggaaagacctcaaaatcaacagccacacagagcccaaaggagcccgcagcagcagccttcccgactacacagaccacagaatcaagagccacagtctcagcctacagaaagcctgtactacgactacgagcctccctattatgacgtgatgaccaccgggacaacccccgattatcaggcagctcatggaccaaggggccttaagggtgaaaagggagaacccgctgtcctggaacctggaatgcttgtcgaaggcccacctggacccgagggtcctgctgggctcataggaccccctggtatacagggcaatcccggtcccgtgggcgacccaggcgagaggggtccacccggaagagccggactgccgggttcagacggcgctcccggaccccctggaacaagtttgatgctcccctttaggttcggcagcgggggtggcgataagggcccagtggttgctgcacaggaggcccaagcacaggccatcctacaacaagcgcgacttgcgttgagaggcccacctggacctatggggtacactggtagacccggaccactggggcagcctggttcccctgggttgaagggtgagtctggggatttggggcctcagggcccacgcggacctcaggggctgaccggcccacctgggaaggccggtaggcggggaagggctggggctgacggcgctcgaggaatgcctggggatccaggcgtgaagggcgaccgaggttttgacgggttgcccggactgcctggcgagaagggtcaccggggtgataccggagcgcagggcctgccaggaccgcctggcgaagacggcgagaggggtgacgatggagaaattggccctagaggacttccaggtgaaagcggccctcgcggtctgctaggcccaaaggggccacccggaataccaggtccccctggcgtccgtggcatggatggaccgcaagggcctaaaggctccctcggacctcagggcgagcccggtcctcctggtcagcaggggacgcctggcacacagggactaccaggacctcagggggcaatcggcccacacggagagaaggggccacaggggaaacctggacttcctgggatgcctgggtccgatggccctcctggacacccgggtaaagaaggcccaccaggaaccaaaggcaaccagggccctagtggtcctcaggggcctttgggctatccaggccctcgcggagtaaaaggggtggatggcatccgcggactgaaaggacataaaggcgaaaaaggcgaggatgggttccccggatttaaaggggatattggggttaaaggcgacaggggggaggtgggcgttcctggctctcgcggagaggatggacctgaagggccaaagggcagaactggaccgaccggcgatcccggaccgcctggactgatgggtgagaaaggcaagctgggggtgccagggctgccgggataccccggaagacaggggcctaagggctctctcggtttcccaggcttccctggtgcctccggcgaaaagggtgccaggggactgtcaggaaagagcggtccgaggggcgagagggggccaaccggaccacgaggtcagcgcggaccacggggtgcaaccggaaaaagcggcgcaaaaggcacctccggtggcgacggcccacacggccctcctggcgagagaggactgcctgggcctcaaggcccaaatggatttcctgggccaaaagggcctctggggcctcccggtaaggacggactgcccggtcacccgggtcagcgcggagaagtcgggttccaggggaaaactggaccaccaggcccaccaggcgtagtaggacctcaaggcgctgcgggagagacaggacccatgggcgagcggggacaccccggaccccctgggcctccaggagagcaaggactgcctggcactgctggaaaggaaggtaccaaaggagatcctggacctccaggtgcaccgggaaaagatggtcccgcaggactgcgtggttttcctggcgagcgaggcttgccaggaactgcaggtggccctggcttgaagggtaatgaaggacccagtggccctccgggacccgctggaagtcccggagaaaggggcgctgcagggagcgggggaccgattgggcctcccggacggccaggaccccaggggccaccaggcgctgccggagaaaagggtgtaccaggcgaaaagggcccaatcggtcctactggtagagatggggttcaggggcctgtggggttacccggtcctgctggaccacctggagtcgcaggtgaagatggggacaagggagaagtgggggaccctggacagaagggcacgaaaggaaacaaaggcgaacatggccctcccggtccaccaggaccaatcggtccggtggggcaacccggtgcagcaggcgcagacggggagcctggggctagaggtccgcaaggacacttcggtgccaagggagacgaaggtacgcggggattcaacggtcccccagggcctataggcctgcaggggctgcccggacccagtggggaaaagggagagactggcgatgtggggcctatgggaccgcctggcccacccggtcctcgtggaccagcaggcccaaacggggctgacggaccgcaaggaccccctgggggtgtcggcaacctgggcccaccaggagagaaaggagagcccggtgagtctggatctccgggaatccagggtgagccaggggtcaaagggccacggggagaacgcggagagaaaggcgagagcggacaacctggggagccgggacctcctgggccaaagggtcccaccggagatgacggtcctaaaggcaatcccggacccgttggcttccctggagatccaggaccaccaggtgaggggggacccagggggcaagatggagccaagggagaccgcggtgaagatggtgagccagggcaacccggaagccctggacccactggcgagaacggccctccgggaccattggggaaacgaggccctgccggtagtccaggctccgaaggacgccagggtgggaagggcgcaaagggcgaccccggtgcaatcggagcaccaggcaaaactggtccagtgggacctgcaggacctgcaggcaaacccggtcccgatggccttagaggcctccctggcagcgtgggccagcagggcagaccaggggctacaggtcaggcaggcccacccggtcctgttggtcctcccggattgccgggactgaggggggacgctggcgctaaaggggagaaaggccatcctggattgattgggctgatcggccctccgggagaacagggcgagaagggagacagaggtctgcccggtccccagggcagccccggacagaagggagaaatgggaattcctggcgcttccgggccaatcggcccaggcggtccaccaggtttgccgggaccagctggaccaaaaggggcaaagggtgcgaccggaccagggggtccaaagggcgaaaaaggcgttcagggccctcctggccatccaggaccacctggagaagttatccagcctctgccgatccaaatgccgaagaaaactcgcagatctgtcgacgggtcgagactaatgcaggaggacgaggcaattcccacaggcggagcgccaggtagtccagggggtctagaagaaatcttcgggtctctggatagcctgagggaggaaattgagcaaatgaggagaccaactgggacccaggattcacccgctaggacttgtcaggatctgaagctgtgccatccggagctgcccgatggcgaatactgggtcgatcctaatcaggggtgcgctcgggacgcttttcgggtcttctgtaactttaccgcgggaggcgagacttgtgttacgccacgtgatgacgtcacgcaattcagttacgtggatagtgaaggaagccctgtcggagttgtgcagctaacatttttgcgtctgctgagcgtatccgctcatcaagatgtgtcctatccctgctccggtgcggctcgcgatggacccctgagactccgtggggctaacgaagacgagctgagtcccgagacgtcaccatatgtgaaggaattccgtgacggatgccagacacagcaggggagaacagttctggaggttcggaccccagtgttggagcagctgccggttctggatgcctccttctctgatttaggcgctcccccacggagggggggagttctcttgggcccagtttgcttcatgggctag

SEQ ID NO: 4750 - DNA, 4968 bp, Artificial Sequence
  Description of Artificial Sequence: Synthetic coding sequence
atggagcgctgcagccggtgccaccggttactgttgctgctgccgcttgtgctggggctctcggcggcacccggttgggccggagctccacccgtggatgtgctgcgggctctccgcttcccctcattgccagatggggtgaggagagccaagggaatctgcccggcagatgtcgcatatcgtgtggcacgaccagctcagttgagcgccccaacaagacagctttttccaggtgggttcccaaaggatttttccctcctcactgttgtgcgtactcggccagggcttcaggccccactcctgactctttattctgctcaaggcgtacgccaacttgggctggaacttggaaggcccgttcgttttctgtacgaggatcaaacagggaggccccagcctccttcccagcctgtgtttagaggtctctcactggccgatggaaagtggcatagagtggctgtcgccgtcaagggccagtcagttacgctgattgtggattgtaaaaagcgggtcacgcgccctctgccccgaagcgcaagacccgtcctagacactcatggggtaattatctttggggcaagaatcctggacgaggaggtttttgagggggacgttcaagagctggcaattgtgccaggcgttcaggccgcatacgagtcatgtgagcagaaggaactcgaatgcgaaggaggccagcgagagaggccgcagaaccaacagccacatcgggcacaaaggtcacctcagcaacaaccttctcgactgcacaggcctcaaaaccaggagccccagagtcagccaactgaatccctctactacgactataagcctccgtactacgatgtgatgacgaccggaacaacgcccgattaccaagcggctcacggtccaaggggcctaaaaggggagaagggagagcctgctgtgttggagcccggaatgctagtcgagggacctcctggaccagaaggcccagccggacttattggcccacccggtattcaggggaatccgggaccggtcggagaccccggagagcgtggacccccaggaagagcagggctcccagggagcgacggggctccaggccctcccggaacgagcctcatgctgcccttccgcttcggcagtggaggcggagacaaggggcctgtggtggccgcacaggaagcccaggcgcaggctatccttcagcaggctagactggcactgaggggcccaccgggaccaatgggatacactgggagacctggccctctcggccagccagggtctcccggactgaagggcgagtcaggggacctcggccctcagggtcccaggggccctcaaggtcttaccggaccgccagggaaagccggacgaaggggcagggctggagccgacggggcacgcggtatgccgggagatcccggagtaaagggcgaccggggatttgacgggctgccagggctgcctggagagaaaggccataggggggacaccggcgctcaaggactgcctgggcctcccggagaggacggtgaacgaggcgacgatggggagattggcccacgcggtcttcccggagaaagcggacccaggggattgcttgggccaaaagggcctcctggaatccccggaccaccaggagtgcggggtatggacggccctcagggcccaaaaggttctctaggacctcagggggagcccggaccccctgggcaacagggaacccctgggacccagggactgcccggtccccaaggcgcaatcggcccacacggagagaaggggcctcagggcaagcctggactgccgggaatgcccggttcagacggcccaccgggtcaccctggtaaggaggggccacccggaacaaaagggaatcaggggccttctgggccacaaggcccactaggttatcccggaccgaggggtgtcaagggagtagacggtataagaggacttaagggacataagggcgaaaaaggtgaagacggttttcccggttttaaaggcgatattggcgtcaaaggagaccgtggcgaagtcggtgtcccgggttctaggggcgaggacgggcctgagggacccaagggaaggactggacctaccggagatcctgggcctcccggtctgatgggtgagaaaggtaagctgggcgtgccgggactccccggttaccccggtcgccagggcccaaagggctctttgggattccccggattccccggtgccagcggggagaagggcgctcggggacttagtggtaaatctgggccacggggtgagcgcggacctacaggccctagaggccagcgcggtccaaggggagcaactggcaaatctggcgcaaaagggaccagcggtggagacgggccacacggcccaccaggcgaaagagggctcccgggtccacaggggccaaacgggtttccaggaccgaagggccctccaggaccacctggaaaggacgggttgcctggacacccagggcaacggggagaagtgggatttcagggaaagaccggtccccctggccctccaggcgttgttggaccacaaggcgcagcaggagaaactgggccaatgggcgaaagaggccaccctggcccaccaggccctcctggcgagcagggcttgcccggaacagctggtaaggaaggcaccaaaggagaccctggcccaccaggcgcacccggtaaggatggaccagcgggactgcgcggtttcccaggcgagaggggcctgccaggaacagcagggggtcccggtttgaagggaaacgaagggccatctggcccacctgggcctgcgggttcccccggtgagaggggagccgcaggctccggcggacctatcgggcctcccggaagaccgggtccgcagggcccaccgggagctgcaggcgagaagggcgtgccgggagaaaaaggccctattggcccaactggcagagatggcgtccaaggaccggtgggacttccaggccctgccggtccccctggtgtggcaggggaggacggggataagggagaagtgggggatcctgggcagaagggcactaagggtaacaagggcgaacacggccctcctggccctcctggccctattggtccggtcggtcaacccggtgccgctggcgctgatggcgagcctggggctagaggtccgcagggacatttcggcgcaaagggagatgagggcacccgcggatttaacggtccgcctgggccaatcggcctccaagggttgcctgggccaagtggcgaaaagggagagaccggggatgtgggacccatgggcccaccagggcctcctggaccaagaggtcctgccggacccaacggggcagatggccctcaggggcctccaggcggagttgggaacctgggtccaccaggcgagaaaggcgaaccaggcgaatcggggagtcctggtatccagggcgagcccggtgtaaaagggcctcggggtgagaggggagagaagggggagtcagggcagccgggtgagcctggccctcccggacccaaggggcctactggtgacgacggtcccaagggtaatcccggtcccgtaggattccccggagaccctggcccaccaggagaagggggaccgagaggccaggacggagcaaagggggaccgcggtgaggacggcgagccgggacagcccggatcacctggccctaccggggaaaatggccctccaggccctctgggaaagcgaggtccagcaggcagccccggaagtgaaggtaggcagggaggcaaaggggctaaaggcgatccaggggcaatcggcgctcctggcaaaacgggcccagtcggcccagcaggaccagcagggaagcctggtcccgacggattgcgcggtctgcccggaagtgtgggccagcagggtaggcccggagcaacaggacaagcgggacccccaggcccagtgggacccccaggcctacccggtctgaggggggatgccggagccaagggcgaaaagggccaccctggcctgatcggcctcatcggtccaccaggggaacaaggcgaaaaaggcgacaggggccttcccggaccccaggggagccccggacagaagggcgaaatggggattccgggagctagcggacctattggcccaggaggcccaccagggctccctggacccgctggacctaagggcgcaaagggggcaaccggtcctggcggacccaagggcgagaaaggcgtgcagggcccacctggtcatccaggcccacccggtgaggtgatacagcccctgccaatacagatgcctaaaaagactcgacggtctgtagatggatcccggctgatgcaggaagacgaggcaatcccgaccggtggcgctccaggatctcccggtggactggaggaaatcttcggatccctggatagtctccgggaggagatcgagcaaatgcggcgacctaccggaactcaagactccccggctcgcacgtgtcaggatttgaagttgtgccaccctgaactccctgatggcgagtactgggtagaccccaaccagggatgcgcccgtgacgcattcagggtattctgtaattttactgccggaggcgaaacatgcgtgactccacgagacgatgtcacacagttcagctacgtcgattccgagggctcccctgtaggcgtggtgcagctgacattccttaggctcctctcagtgtcagcacaccaggacgtcagctacccttgctcaggcgcagccagagacgggccattacgacttagaggggctaacgaggatgagctttccccggaaacaagcccgtatgtgaaggagttcagagatggatgtcaaacacagcaggggaggacagtactggaagttaggacacctgtgttggaacaactgccggtcctggatgcttcattctccgatctgggcgctccaccaagaaggggaggcgtgctgctcgggccagtgtgttttatgggatag

SEQ ID NO: 4751 - DNA, 5030 bp, Artificial Sequence
  Description of Artificial Sequence: Synthetic coding sequence
atggaacggtgctccaggtgtcacaggttgctgttgctgctgcctcttgtcttggggttaagtgccgcaccgggatgggcgggagctcctcccgtggacgtcctgagggcactgaggtttcccagcctgcctgatggagtgcgacgcgctaaggggatctgcccagctgatgtagcgtatagggttgccaggcctgcacagctatctgccccaactcggcaactctttcctgggggatttccaaaagatttctctctcctcactgttgtgcggactaggcctggtctccaggccccactcctcactttgtattctgcccagggcgttcggcaactgggacttgagctggggcctcccgttcgtttcttgtatgaagatcagaccggcagaccacagccaccctctcaacccgtgtttaggggactgtccctagccgacggcaaatggcatagagtagccgttgccgtaaaggggcaaagcgtgacattaattgtggattgcaagaagcgggtcactagacccttaccccgtagcgccagacctgtgctggatacgcacggagtgattatatttggcgcaagaatactggacgaggaagtcttcgagggcgatgtgcaagagctagcaattgtgccaggcgttcaagccgcatatgaatcctgtgagcagaaggaattggagtgcgaaggcggtcagagggagagaccccaaaaccaacagccacacagggcacaacgcagtccccagcagcagcccagtagacttcacaggcctcagaaccaggaaccacaatcacaacccacagaaagtctgtactacgactacaagcctccctattacgacgtcatgaccacaggtacaaccccagactaccaagaccccacgccaggggaagaagaggagatactggaatctagtttgttaccaccactggaggaggctgcacacggaccacgaggacttaaaggggagaagggggagcctgctgtattagagccaggtatgctggttgaagggccaccaggcccagagggcccagctggactaatcggcccaccgggaatccagggaaatcctggacctgtaggtgatccaggggaaaggggcccaccgggaagagccggactccccggtagtgatggggctccaggcccaccagggacctccctgatgctgccctttaggttcggatccggtgggggtgacaagggccctgtggtcgccgcacaggaagcccaggcacaagcaatcctccagcaggcgcgtttggccctgcgcggacctcccggtccgatgggctataccggaaggcctgggccactcggccaacccggttcaccaggcctgaaaggtgagtccggcgaccttgggccacaagggcctaggggccctcagggcctgactggtcctcctgggaaagccggtaggaggggcagggccggtgccgatggagccagagggatgccaggggatccaggggtgaagggggacaggggctttgacggcctgccgggactgccgggtgaaaagggccatcgaggcgacactggagcacaaggactgccaggccctcctggagaagatggagagaggggggacgacggggaaattggccctcgaggcctgcctggcgagtcaggtcctagaggtcttctgggccctaagggccctccaggaatcccgggacctccgggagtcagaggcatggatggtccccagggcccaaaaggatcactgggccctcagggtgagcctggaccgccaggacaacagggcaccccaggtacccagggcttgcctgggccacagggcgctatcggccctcatggcgaaaagggccctcagggaaagcccggtctccccggaatgcctggttccgatgggccaccgggacatcctggcaaggagggaccccctggcaccaagggcaaccaaggacccagtggaccgcaagggcctctgggatacccgggaccacggggtgtaaaaggcgtcgatggtataaggggactgaagggacataaaggagagaaaggagaagatggcttcccaggcttcaagggagacatcggggtcaaaggggaccgaggtgaggtcggagtgccaggaagccgcggagaggatggtccagaaggccctaaggggagaactggacctactggcgatccagggccacccggactgatgggcgagaagggcaagctgggagtaccagggctgcccggatacccaggccgacagggtcccaagggaagcctgggttttcctggattccccggtgcctcgggggagaaaggcgcacgcggactgagtgggaaatccggccctaggggagagagaggacccactggacctagggggcaaagaggccctcgaggggctacagggaagagcggcgcaaaaggcacatccggcggagacgggccacacgggccacccggagaacggggtttgcccggtccacagggcccaaacggattccctggtcccaagggccctccagggccacctggcaaagatgggctgcccggacatcccggacagaggggcgaggttggctttcaagggaagactgggcctcccggaccccctggcgttgtgggccctcagggtgccgcaggtgaaaccggtcccatgggtgagcgaggccatcctggccctcccggacctcctggcgagcaaggcctacccggaaccgctgggaaagaaggaactaaaggagaccccggtcccccaggcgctccaggcaaagacggcccagcgggtctgaggggcttccctggggagcgcggactacccggaactgcaggcggtcctggcctgaaaggcaacgagggccctagcggccctcccggacccgctggttctcccggtgagcgaggcgcagctgggagcggagggccaatagggccacctggaagacctggaccccagggcccacccggtgcagccggtgaaaagggtgtgccaggcgagaagggacctatcgggcctactgggagggatggcgttcagggcccagttggcctgcccggtccggcaggaccacctggggtggccggagaggacggtgataagggagaggtcggcgatccagggcagaaaggaaccaaaggcaacaaaggcgagcatgggcctcctggcccacccggacccataggacccgtcggacagcctggtgccgcaggggcagacggcgagcccggagccagagggcctcagggccacttcggagctaaaggagatgaaggaactcgtggcttcaatggccctcctggacccataggtcttcagggacttcctggaccttccggcgagaaaggggagactggagatgtcggtcctatggggccaccaggccctccaggcccaagaggtcccgcaggacccaatggcgctgacgggccacagggcccaccaggcggtgttggtaaccttggcccaccaggcgagaaaggcgagcccggtgagagtggaagccctggcattcagggcgaacccggagtcaaaggcccaagaggagagcgaggtgagaagggcgagagcggacaacctggcgagcccggaccacccggtccaaaaggccctacaggtgacgacggacctaagggaaaccctggccctgtaggctttccaggcgatcccggtcccccaggcgaggggggtccaaggggccaagacggcgctaaaggggatagaggagaagatggagaacctgggcagcccggaagtcccggacccacgggagagaacggccctcctgggccacttggaaagcgcggtcccgcaggaagccccggtagcgaaggaaggcaggggggaaaaggagctaaaggagacccgggtgcaatcggtgccccagggaaaacaggacccgtgggtccagccggacccgctggtaaacccggaccagacgggctgcgaggactaccgggatctgtggggcagcaggggcgtccaggggctacaggtcaggccggaccacccggacccgtgggcccaccgggacttccgggactgcgaggcgatgccggagctaagggcgagaagggtcaccctggactaataggacttatcggccctcccggagagcagggggagaagggtgatcggggactgcccggaccgcagggaagtcctgggcagaagggcgagatgggcattcccggagcaagcgggcctattgggccaggcggtccgccaggactgcccggaccagccggtcccaagggcgctaaaggagcaaccggccctggcggaccaaagggagaaaaaggagttcaagggcctcctggccatccagggcctcctggcgaagtaatccagccactgcctattcagatgccaaaaaagactagaagatctgttgatggaagccgtctgatgcaggaggacgaagctattccaaccgggggtgccccaggctctcctggcggactggaagagatctttggaagcctggactcactgcgcgaggagatcgaacagatgagacggcctacaggaacccaggactcaccagcaagaacatgccaggacctcaagttgtgccaccctgagcttccagacggagagtattgggtggatccaaaccaaggatgtgccagggatgcttttcgagtgttctgtaacttcacagcaggcggagagacctgcgtcacccctcgagacgacgtaactcaattttcatacgtggactcagagggaagtccagtgggggtggttcaacttaccttcctgcggctcttgtccgtctctgcccaccaggatgtctcttacccctgttccggcgctgcacgagacggccctcttaggttaaggggagctaatgaagacgaattgtctcccgaaacgagtccctacgtgaaagaattcagggacggttgtcaaacacaacaggggcgaacagtgctcgaagttcggactcccgtgcttgagcagctgcctgtgcttgacgcatctttctccgatctgggggctcccccacggagaggcggagtgctactgggtccagtatgttttatggggta

SEQ ID NO: 4752 - DNA, 5031 bp, Artificial Sequence
  Description of Artificial Sequence: Synthetic coding sequence
atggaacgttgtagccgttgccatcggctgctcctgttgctgcctttggtgctggggctatcagctgcccctggatgggccggagcccctcccgtcgatgtactaagagcactgaggttcccgagtttgccggatggcgttcgacgagcaaaggggatttgtcccgcagacgtggcttaccgtgtggccaggccggctcagctctccgccccaacccggcagttgtttcctggaggattcccgaaagacttttctttattaactgttgtccggacaaggcctgggttgcaggcaccactcttgaccctctactctgcgcagggtgtgcggcagctgggactcgaactgggacgtccagtgaggtttctgtacgaagatcagactggtcgacctcagcctccttctcagccggtgttcagagggctgtccctcgccgatgggaagtggcaccgcgtggcagtggccgtgaagggccagtctgtgacgctaattgtcgactgtaaaaagagagtcacacggccactgcctcgctccgctcggcctgttctggatacacacggtgtgataatctttggcgctcggattctggatgaagaggtctttgagggggacgtgcaggaattggcaatagtgcccggagtgcaggcggcatacgagtcctgtgaacagaaagaactggaatgtgaaggcggacagagagagcgccctcagaatcaacagccccaccgtgcccagagatcacctcagcagcagccatcaaggctccatcggccacagaaccaggagcctcagagtcaacccacagagagcctatactatgactacaaaccgccatactacgacgtgatgactaccggtacaactcccgattatcaggatcctacacctggggaggaggaggagatactcgagtcctccctgctgcccccactggaagaagccgctcacggtccgcgtggccttaagggagaaaagggcgagccggctgtgctagaaccaggcatgctcgtcgagggcccacccggtcccgaagggcctgctggactgatcggtccacccggtatacagggcaaccccggaccggtcggggacccaggcgagcgaggcccacccggtcgggctggccttcccggaagtgacggggctcctggacctcctgggacatcattgatgttgccatttcgcttcggatcagggggtggcgataaaggtcccgtcgtggctgcacaggaagcccaggctcaggcaatcctccagcaagccagactggctctacgtggtcctccagggccaatgggatacactggtaggcccggaccactcggtcaacctggaagcccaggacttaaaggggagtctggcgatctgggcccacaggggcctcgtggaccccagggactgaccggtcccccagggaaagccggacggaggggccgagcaggcgcagacggagcaagagggatgcctggagatcctggggtgaagggcgatcggggatttgacgggttgccagggttacccggtgaaaaaggccatcggggtgacaccggcgctcagggcctgcctggtccgccaggggaggacggcgaacgaggagatgacggtgagataggtcctagggggcttccgggtgagtccggcccaagggggctgctcggccctaaagggccaccaggtatacccggtccccctggagtgcggggaatggatggtccacagggtcctaagggatccctgggacctcagggggagcccggacctccgggtcagcaaggcacccccggaactcaggggctgcctggaccacagggagctataggtccgcacggggaaaagggcccacagggaaagcccggtctacctggaatgcctggatccgatggaccacccggacatcccggaaaggaaggaccacccggaactaaggggaatcagggcccatccggcccacagggccctctgggataccctggcccaagaggagttaagggtgtcgacggaatacggggactgaagggccataagggtgagaagggggaggacggcttcccaggcttcaaaggggatataggcgtaaagggtgaccgaggcgaggtcggagtgcccggtagtaggggtgaagacgggcctgagggcccaaaaggaaggactggtccaactggcgaccccggaccacctggactgatgggagaaaaaggcaagcttggggttccgggtttgcccggatatcctggtaggcagggccctaaagggtctctaggattccccggttttcctggagccagcggcgagaagggagctagaggactgagcggcaagagcgggcctaggggcgagagaggtccgacaggacctcggggacagagaggtcccagaggcgctaccgggaaaagcggtgccaagggcacttcgggaggagatggcccacacggacccccaggagaacgaggcctcccaggaccccagggcccaaacggatttccaggtcctaaggggcctcccggacccccaggcaaagatggtctgcccggacatcccggtcagaggggggaggtcggcttccagggaaagaccggacctccaggaccaccgggtgtggtcggaccccagggagctgctggagaaacaggaccaatgggggagcgcggacacccgggtcccccaggaccccctggggaacaggggctccctggcacagccggaaaggaaggcactaagggcgaccccggtccgccaggggctcctgggaaggatggaccagccggtctgcggggtttcccaggtgagagggggttgccagggacagcaggcggtcccggattaaagggtaatgaggggccatccggtcctccaggaccggctgggtctcccggagaacgcggtgctgccggttccggtggtccgatcggaccacccggacgcccaggtcctcaagggcctccaggggcagccggagagaagggagtgccaggagagaaagggcctatcgggcctactggccgagacggggtccagggtcccgtgggcctccccggaccagcgggtccccctggagtggctggggaagatggggataaaggcgaggttggggacccaggtcagaaagggacgaaagggaataagggggagcatggaccccctgggccacctggacccattggccctgtcggccaacccggagccgcaggagcagacggtgaacccggagcacggggacctcagggccattttggtgccaaaggggatgaaggaactcgcggttttaacggtccgcctggtcccatcgggctccagggtctgccgggtcccagcggggaaaagggagagacaggagatgtggggcctatgggtccaccaggaccaccagggccaagaggacccgcaggaccaaatggtgctgatggtccccagggtccaccaggcggtgtcgggaatctgggaccacccggagaaaaaggtgaacctggggagtctggcagccccggaatacagggagagccgggtgtgaagggaccacggggtgagcgtggtgagaaaggtgagagcggccagcctggggagccaggaccgcctggccctaaagggccaacaggcgacgacggacctaagggaaacccaggacccgtgggattcccaggggacccagggcctccgggagagggcggtcctcgcggacaggatggagcgaaaggtgacagaggggaggacggcgaacccggtcaacctgggtctccaggtccgacaggcgagaatggacctccaggcccattggggaaacgcggaccggctggatcacccggaagcgagggtagacagggcggtaaaggggcaaaaggcgacccaggggcaattggcgcaccaggcaaaaccggccctgtcggacccgctggacctgcaggcaagccaggcccagacggcctcagggggctgcctggatccgtgggacaacagggtagaccgggagccacaggacaggctggccctcccggacccgtgggtcccccaggcctgcccggattaaggggtgatgctggcgcaaagggtgaaaaggggcaccccggtcttatcggcctgataggccctcccggagaacagggggagaagggagaccggggactccccggtcctcaggggtcacccggacagaagggggagatgggtatccccggtgcttccgggccaatcgggccaggaggaccgcctgggttgccgggtccagcaggacctaaaggggcaaagggagcaaccggtcccggtggccctaagggagagaaaggggtgcagggacctcctggtcatcctgggccacccggagaggttatccagccactgcccatccagatgcccaaaaagacacgtcgctcggtagatggatcccgcctgatgcaagaggatgaggctattccgacagggggtgcgcctggctcaccgggagggctagaagagatcttcggctcactggactcgcttagagaggaaatcgaacaaatgaggagaccaaccggcacacaggacagtcctgccaggacatgccaggaccttaagctgtgtcacccagagctacctgatggagagtactgggttgacccaaaccaagggtgcgcccgtgatgcctttcgcgtcttctgcaatttcactgccggtggagagacatgcgtcacccccagggatgacgttacacagttctcctacgtggatagtgagggctctcctgtgggtgtcgtgcagctgacttttttacggttgctctccgttagtgcccaccaggatgtatcttacccatgttccggggctgctagggacgggcctctccggctcagaggcgctaatgaggatgaattatcccccgagaccagcccctatgtgaaggagtttcgcgacggttgtcagacccagcagggtcgaacagtgcttgaagtgaggacaccagtgcttgaacaactgcctgtgctcgacgcttctttcagtgatctgggagctccacccagaaggggcggtgttctactgggtcccgtttgtttcatgggatac

SEQ ID NO: 4753 - DNA, 5031 bp, Artificial Sequence
  Description of Artificial Sequence: Synthetic coding sequence
atggagcggtgctcacggtgccatcggctcttactcctccttcccctagtcctggggctgtcagcagcccctgggtgggctggcgcaccaccggtagacgtactgcgggcactgaggtttccatctctccctgatggggtaaggagagccaaggggatatgtccagccgacgtggcctacagggtggccagacccgctcagctttccgcccctacacggcagctgttccccggtggctttcctaaagacttcagcctgctcacggtggtgagaactcgccctggccttcaggccccacttctcaccctgtacagcgcccagggtgtcaggcaactcggtctggagctcggccgaccagtgcgcttcttatatgaggatcagactggcagacctcagccacccagtcaaccagtgtttcgagggctttcactcgctgatggtaaatggcacagggtagcagtagctgtgaagggacaatccgtgactcttattgtggactgcaagaaacgtgtaacccgccctcttcctcgttcagcccgacccgtcctcgatactcacggggttatcatttttggagcaagaatcctggatgaggaggtgttcgaaggcgacgtgcaagagctggccattgtgccaggcgtccaggctgcctatgaatcttgcgaacagaaggagctagaatgcgaaggcggacagcgagaaagaccccaaaatcagcagccacaccgagctcaacggtcacctcagcaacaaccttcccgactccatcggcctcagaaccaggagccccagagtcaaccaacagaaagtctctattacgactacgaacctccatattacgatgttatgaccaccggcactacaccagattatcaagacccaacccccggagaagaagaagagatcctcgagtcgagcctgttgcctccactcgaggaagcagcacatggtcccaggggcttgaaaggagagaagggagagcctgccgttctagagccaggcatgctggtggagggccctcccggtccagagggcccagctggcttgatcggccctcctggaattcagggtaatcccggacctgtgggcgatccgggtgagagaggccctcccggacgagcgggactcccaggcagcgatggagccccaggccctcctggaacgtcactcatgctgccattccgcttcggtagtggtggaggggacaagggtcctgttgtggccgctcaagaggcacaagctcaggctatactgcagcaggcccgacttgcactcagaggacctcccggacctatgggatacacaggacggccaggcccactgggacagcccggaagtccgggactcaaaggtgagtctggggaccttgggccacaaggccctagagggcctcaaggtctaacaggccctccaggtaaggctggacggagaggtcgcgctggcgcagatggcgctcgtggaatgcctggggaccctggcgttaagggcgaccgagggttcgacggcttgcctggtctgccaggagaaaaaggccaccgtggcgatacgggtgcacaaggcttacccggtcccccaggcgaggacggagaacgcggtgacgatggggagatagggccacgcggactgcccggtgagagcggcccacggggattactggggccaaaaggccctcctggaatcccaggaccaccaggcgtgagagggatggacggcccacagggtcccaaaggctccctcggtccgcagggcgagcccggtccccctggacaacaaggaactccaggcacgcagggcctgccaggtcctcagggtgccatcgggcctcacggtgagaaagggcctcaagggaaaccaggcctgcccggaatgccagggtctgatggccctccgggacacccgggtaaagaagggcctcctggaaccaagggcaaccaggggccaagtgggcctcaggggcctttggggtatcctggcccaaggggcgtcaagggagtggacgggattcgcggactcaaagggcacaaaggggagaagggggaggacggtttccctggttttaagggcgatattggtgtcaaaggggaccgaggcgaggtcggggttccagggagccgaggagaagatggtcctgagggtccaaaaggcaggaccgggcctactggagacccaggacccccaggcctcatgggagaaaagggcaagctgggagtcccgggtttacctggctaccctggcagacagggccctaaaggctcactgggattcccaggcttccctggagctagcggcgaaaaaggtgccagaggcctgtcggggaagtctggaccaagaggggagcgaggtcctaccggtcccagaggacagcgcggtccaaggggcgctaccggaaagagtggagcgaagggaacctcaggaggcgacggtccacatggacccccaggggagcgcggacttccaggtccacaaggtccaaatggattccctggtccaaaaggcccacctgggcctccagggaaagatggcctacccggacatcccggacagcgaggggaagttgggttccagggcaagactggccctcccggacctcctggtgtggtgggtccccagggtgctgctggggaaaccggccctatgggagaacgcggacaccccggtcctcccggtccccctggcgagcaggggctgccaggcaccgcaggtaaagagggaacgaaaggcgacccagggcctccaggggcaccagggaaagacggccctgcaggcctgcgcggttttcccggagagcgcggattaccgggaacagccggagggccaggcctgaagggaaacgaagggccttccgggccacccggtccggcaggctcccctggcgaaagaggggcagccggaagcggcggtcccatcgggcctcctggacggcctggcccacaaggccctccaggcgcagctggggaaaaaggagtccccggagagaagggccctatcggaccgacggggagagatggtgtgcaaggcccagtggggctgcccggacctgccggacccccaggcgtggcaggcgaggatggggataaaggagaggtgggcgacccagggcagaagggcacgaagggcaataagggcgagcatgggccacctggtccccctggacccatagggccagtcggacaacctggggctgccggtgctgatggtgagcctggcgcaaggggaccacagggccactttggggctaaaggcgatgagggaacccggggatttaatggacctcccggacctatcggactccaaggccttccaggtcccagcggagagaaaggggagacaggagacgtcgggccaatgggtccacccggtccgccaggacctagagggccagcaggacctaatggggctgatggccctcaggggcctccaggaggagttggcaatttaggaccgcctggggaaaaaggtgagcccggtgagtcaggcagcccagggattcagggcgagcccggtgtgaaaggacctagaggagagaggggcgaaaaaggggagagcggccagcccggagaacccggtcccccaggccctaaggggccaaccggggatgatgggcctaagggaaacccaggacccgttggattccccggagatccaggtcctccaggtgaaggtggcccacggggacaggatggagcgaagggagatagaggcgaggacggtgagcccggacagccaggctcaccaggacccacaggggagaacggtcccccagggcctctgggtaagcgcggacccgctggaagcccaggaagcgagggcaggcaaggcggaaagggcgcaaaaggagaccctggcgctattggtgctcccggaaagacagggccagtggggccagccggacccgcaggaaaacccggtccagatggcttacgaggcctgccaggtagtgtcgggcaacagggaagacctggagcaacggggcaggcgggtcctcctgggcctgtgggcccacccggtttgcctggattgcgcggagatgcaggagctaaaggcgaaaaggggcaccctgggctcatcggcctgatcggcccacccggagaacaaggtgagaaaggtgatcggggattgccaggaccccagggctccccaggacagaagggggagatgggcatccctggtgcatccggtccaatcggtcccggtggcccaccagggttaccagggccagcaggcccaaagggggctaaaggcgcaaccggccctggcggtcccaagggcgagaagggagtgcagggcccacctggacatcctgggccacccggtgaggtgatacaacctctccctattcaaatgcccaagaaaacgagaaggtctgtggatgggtcccggctgatgcaggaggatgaagcaatcccaactggcggagcccctgggtcaccaggaggcctggaggagattttcggctcactagattctcttagggaagaaatagaacagatgcgcaggccaaccggcactcaagacagtccagcccgaacatgccaggatctgaagctttgccatcctgaattgcccgatggcgagtattgggtggaccccaatcagggctgcgcccgtgacgctttcagagtcttttgtaatttcaccgctgggggtgagacctgcgtcactcctcgcgacgatgtgacacagtttagttacgtggactccgaagggtcaccagtaggtgttgtccaactgacttttctgaggttgctcagcgttagtgctcaccaggatgtcagttacccttgttccggcgcagcacgcgatggaccgttgaggttgcgaggggctaatgaggacgaactttctccagaaacatctccatatgtgaaagagttccgcgacgggtgccagactcagcagggcagaactgtgctggaagtccgcacacccgtgctagagcagctgcccgtactcgacgcctccttctccgatctcggagctcccccacgtagaggaggggtgctgctcggacctgtttgtttcatgggctac

SEQ ID NO: 4754 - DNA, 5147 bp, Artificial Sequence
  Description of Artificial Sequence: Synthetic coding sequence
atggagcgatgcagcagatgtcaccggcttctgctcctgctgcccctggttctgggattgtctgccgctccaggctgggccggagctccacctgttgacgtcctgagggccctgcgattcccctcactcccagacggcgtcagaagggctaaggggatctgtcccgctgatgtggcataccgcgtggcaaggcccgctcagctgtccgcacccacaagacagctgtttcccggaggcttccctaaagattttagtctgctgaccgtcgttaggactcggcctggactccaagcgcctttgctgaccttgtactctgcccagggcgttcggcaacttggcctcgagctgggcaggccagtgcggtttttgtacgaggatcagaccggtcggccacagcccccttcacaacccgtcttcaggggattgtcactggctgatgggaaatggcatagagtggccgtcgcagttaagggacagtctgtcacacttatcgttgactgcaagaagcgagtgacccggccactgccccgatccgcacggcctgtccttgacacgcacggcgtgattatcttcggggctagaatactggacgaggaggtctttgagggggacgttcaagaactagcgatcgttcctggggtgcaagctgcctatgagtcttgtgaacagaaggagctggagtgcgagggtggccagagggagaggccccaaaaccagcaaccacacagagctcagagatctccgcagcagcagccttctagattgcacagaccgcagaatcaggagccacagagtcagcccacggaaagtctgtactatgattacgagcctccatattacgacgttatgactactggaacaacccctgattaccaggaacagaccgatctgcaggtgcccccaactgctgatcgcttccaggctgaggaatatggtgagggaggcaccgacccccctgaaggaccatacgattacacctacggatatggggacgattatcgggaggagaccgaactggggccagctctgtccgccgagactgcccatagcggcgcagctgcacacggacccaggggcctgaaaggagaaaagggcgaacccgctgtgctggagccagggatgctggtggagggacctcctggccctgaagggcctgccggtctgattggccctccaggcatccagggtaatcctgggccagtaggggaccctggcgagagaggtccacccggtcgggcaggcctgccaggcagcgacggcgctcctggcccacccggaaccagtttgatgctacccttccgttttggatctggcggaggcgacaaagggccagtggtagccgctcaggaagcccaggcccaagcaatactccagcaggccaggctggcgctgcgcggtccccctggcccaatggggtatacaggcaggcctggacctttaggccaaccgggatcccctggactgaagggtgaatcaggggaccttggcccacagggcccacgaggcccacagggactcaccggtccgccagggaaggctggacgtaggggccgtgccggagccgacggggcacgcggaatgccaggggatcccggtgtgaagggcgataggggctttgatggcctccccggactgccaggagaaaagggacatagaggagatactggcgctcagggactaccgggaccgccaggcgaagatggcgagcgcggagacgacggggaaattgggcctcgcggattgccaggtgagagcggcccacgcggattactgggcccaaaaggcccacctggcatccctgggcctccaggtgtgcgaggtatggacggacctcagggccctaagggttccttgggcccacagggcgagcctgggccacccggtcagcaaggcacacccggaacacaaggacttccaggccctcagggtgctattggaccgcatggtgagaagggcccacaggggaagcctgggttgccaggtatgcccggaagcgacggtcccccagggcacccgggtaaagaggggcctcctgggaccaagggaaatcaaggacctagcgggcctcaaggtcccctgggctaccccggacctcgcggtgtgaagggggtcgacggtatcagaggcctaaagggacacaaaggagagaaaggggaagacggattccctggcttcaaaggtgatatcggtgttaaaggtgatcgcggagaggtcggggttcccggttcccgcggagaggacggacctgaggggccaaagggcagaacaggaccgacaggggatccgggaccccctgggctcatgggcgagaagggcaagttaggcgtgcctggcctaccaggatatcctggcagacagggccctaaaggatctctgggattcccaggattcccaggtgcatccggagagaagggcgctcgcggactctccgggaagagcggaccacgcggagagcggggaccaacaggaccccgaggtcagcgaggtccccgaggagccacaggcaaatctggggcaaaaggaacctcaggaggcgatggaccgcacggcccacctggcgagcgaggactgcctgggcctcaaggccctaatggctttcccggaccaaagggtcctctgggccctcctggaaaggacggcctgcccggacatccaggtcagaggggcgaagtcggattccagggcaaaaccggaccccctggtcctcctggagtcgtaggccctcagggcgctgctggagagaccgggccaatgggagaaagaggtcatcctgggcctccaggccctccaggggagcaaggcctgcccggaactgctggcaaagaaggtactaagggcgatcccggaccaccaggagcgccagggaaggatggcccagccggtctgcgcggattccccggagaaaggggattaccagggactgccggaggccctggcctgaagggcaatgagggccctagcggtccgccagggccagctggaagccccggagagaggggggctgctggatcaggaggaccgataggcccacccggacgtcctggacctcagggcccaccaggcgctgcaggggagaagggggtgccaggcgagaaagggccaatagggccaaccggcagggacggtgtgcaggggcctgttggtctgcccggtccagccggtccccctggcgtagccggagaggatggggacaagggagaggtgggagaccctggacagaaggggacgaagggtaacaaaggagagcacggccctccgggtccacccggacctatcggcccagttggccaacccggagcagccggagctgacggagagcccggtgctcggggacctcaagggcatttcggtgccaaaggcgacgagggtaccagaggctttaacggaccaccagggcctatcggcctgcaaggtctccccggacccagtggagagaagggagaaaccggagacgttggtcccatgggtccgcctggcccacctggccctcggggacctgcaggccctaatggcgctgacggccctcagggccctcctggcggagtggggaacctagggcctccaggagagaaaggtgaaccgggtgagtcaggatcacctgggattcagggcgagccaggagtcaagggacccaggggggagcggggagaaaagggtgaatccggacagcccggagaaccaggccctcccggtcccaagggtcctaccggcgatgatggcccaaagggaaatcctggccctgttggttttccaggcgacccgggaccgcctggcgagggcggaccaaggggccaggatggcgctaaaggagataggggtgaagatggagagcccggacagcctgggtcaccgggacccaccggtgagaatgggccacctggcccacttggaaaaagagggccagctggcagccctggcagtgaaggtaggcagggagggaaaggagcgaaaggggaccccggagctatcggcgctcccggaaaaacaggacccgtgggaccagcaggtccagccggaaagcctggacctgatggactccgagggctgcccggaagtgttggccagcaggggcgacctggagcaaccggccaagccggaccacctgggccagtaggacctccagggttgcccggactgcgaggtgatgcaggcgcaaagggagagaagggacacccagggctgattgggttgattggccctccgggtgaacaaggtgagaagggtgacagagggctgccgggtcctcagggctcacccggtcagaagggcgagatgggcattcccggagcgtccggacccatcggacctggcggacccccaggcctgcccggtcccgcaggacctaaaggagccaaaggcgctacggggccaggtgggccaaagggcgaaaaaggagtacaggggcctccaggccatccgggtccccctggcgaggtcattcagccactgccaatccagatgcctaagaaaacgcgtagatctgtggacggcagcaggctgatgcaggaagatgaggctatccctaccggcggagccccaggatcccccggaggcctggaggagatcttcggcagcctcgatagtcttcgggaagaaatcgaacagatgagaagaccaaccggaacacaggattctcccgctagaacttgccaggacctgaaactctgtcacccagagctcccagacggcgagtattgggtcgatccgaatcagggctgcgcccgagatgcctttagagtgttttgcaatttcacggcgggtggtgagacatgtgtaacaccacgggatgatgtgactcaattcagttacgttgatagcgagggtagccccgtgggtgtggtgcagctgacattcctgcgactgctgtctgttagcgcacaccaagatgtctcctacccttgctctggagctgccagggacgggccattgcgccttagaggcgcaaatgaggatgagctctcccccgaaacttctccatacgtgaaagagttcagagacgggtgccagacccaacagggccgaacggtgctagaagttcggactcctgtcctcgagcagcttccagtgctggatgcgtccttcagtgacctgggtgctcccccaagacgcggaggggtgctgttaggacctgtgtgctttatgggtta

SEQ ID NO: 4755 - DNA, 4809 bp, Artificial Sequence
  Description of Artificial Sequence: Synthetic coding sequence
ggtgctccccctgtggacgtgttgcgcgctctgcggtttccaagcctaccggacggggtccggagagctaaaggtatatgtcccgcagacgtagcttaccgggtggcaagaccagcccaactgagcgcgcctactaggcagctttttccaggcggatttcccaaggacttcagcctactcacggtggtcagaacaagacccggtctgcaggcccctttgctcaccctgtattcagctcagggagtccggcagttaggcctggaacttggacgacctgtgcgcttcctgtacgaggatcagacgggcagaccgcagcctccttcccaaccggtcttccgagggctgtccctggccgacggaaagtggcaccgagtggctgttgcggtgaaggggcagagcgtgactcttatagtcgattgcaaaaaaagagtcactcgcccattacctcgaagcgccagaccggtgctcgacacacatggcgtgatcattttcggcgcacgcattcttgacgaagaagtgttcgagggggatgtgcaagagctggccatcgttcccggtgtgcaggcagcatacgaatcatgcgaacagaaggaacttgaatgtgaaggcggacagcgcgaacgcccacagaatcagcagcctcatagagcccagcgaagccctcagcaacaacctagtcggctgcatcggccacaaaatcaggaacctcagagtcaggcggctcacggccctcgagggcttaaaggggaaaagggggaaccggcagttctcgagcccggaatgttggtagaagggcctccagggcctgaaggcccagcaggtttgatcggccctcctggaattcagggaaatccagggcctgtcggtgatcccggtgagagaggacctcccggacgggcaggtctgcccggatctgacggtgcacctggcccaccgggaacatcccttatgctcccgtttcggttcggctccgggggaggtgacaaggggcctgtggtggccgcacaggaagcccaggcccaagctatcctgcagcaagcaaggctggctctccgcggtcctcccggtcctatgggatacaccgggaggcccggaccactgggtcagcctggttccccaggcctgaaaggggaaagcggtgacctggggccacaaggccctcgtggcccacaagggctcactggtccaccgggtaaagccggacgaaggggacgggctggcgctgacggggctagagggatgcctggggatcctggtgttaaaggcgacagaggatttgatggtctcccaggccttcctggcgagaagggtcataggggcgacactggggctcaaggcctgcccggaccgccaggcgaggacggagagcgaggagatgatggcgagatcggcccacggggtctccccggtgagtcaggcccacgtggattactcggtcctaagggccctcctggcattcctggcccacccggtgtgcgcggtatggacgggcctcagggtccgaagggctccctcggtccacagggtgaaccaggccctcctggtcagcaggggacacccggaacccagggactgccagggccacagggagcaattggtccccatggcgagaagggaccacagggtaagcccggactgcctggcatgccaggctcagacggtcctccaggtcaccccggtaaagaaggccctcccggaactaaggggaatcagggcccaagcgggcctcagggacccctcggatatcccggtccgagaggtgtgaagggagtggatggcattaggggtctaaagggacacaaaggtgagaaaggagaagacgggtttccaggattcaagggtgacataggggttaagggagaccgtggcgaagtgggggtgcctggcagccgcggtgaagacggcccagaaggccctaaggggagaactgggccaactggcgatccagggcctcctgggctcatgggcgaaaaaggcaagctgggagtcccaggtttgcctggttacccaggacggcagggacccaagggaagccttggctttcccggatttcctggtgcctctggtgagaagggggctcgcggactaagcgggaaaagcggcccacgcggagagcggggtcccacgggccctagagggcagcgaggccctcggggagccacagggaagtccggagcaaagggaacttccggcggtgacggcccacacggacccccaggcgagcgtggcctcccgggtcctcagggacccaatggatttccagggcctaagggccctccaggacctccaggaaaggacggtcttcccggacaccctgggcagcgcggtgaggtgggctttcagggaaagaccgggcctccagggcctcctggagtggtaggcccacagggagcagcaggagagacagggccaatgggcgagcgagggcaccctggaccccctgggccacccggtgagcagggtctccctgggacagcaggaaaagaaggcactaaaggggatcctggacccccaggcgctcccggaaaagacggcccagctggcttaagaggattccccggtgagaggggcctgccaggcacggctggaggccctggactcaaaggaaacgagggcccatcgggaccaccaggccctgccggatcacctggggaacgtggcgctgctgggagtggcggacctattggcccaccagggagaccgggtcctcagggtccacctggggctgcgggtgagaagggggtgcccggagaaaaaggcccaattggaccaactggccgtgacggtgtccaaggcccagtcggcctgccgggtccagcaggccctccaggagtcgccggtgaggacggggataagggcgaggttggagatccgggtcagaagggaacaaagggcaataaaggagagcacggaccgcctggtccaccgggtcctatcgggcctgtgggacaacctggcgcagctggcgctgacggtgagccgggtgctagaggtccgcaggggcacttcggtgctaagggagatgagggcaccagggggtttaacggtcctccgggacctattggacttcaaggcctgcctggaccgagcggagagaaaggcgaaacaggagatgtggggcctatgggcccacctggtcccccaggcccaagagggcctgcagggccaaacggcgcagatgggcctcaagggccacccggaggggtgggcaatctgggaccacctggggaaaaaggagagccaggagaatccggttcccccggtatccagggtgagcccggagtgaaggggccacgcggtgagcggggtgagaagggcgaatccggacagccgggagaacctggccctcctgggcctaaaggacccacaggcgacgatgggcctaaaggaaatcctggcccagtagggtttcctggcgaccctggcccaccaggcgagggcggtccgagaggtcaggacggagctaagggcgacaggggagaggatggagagccgggtcagccaggctcccccggtcctaccggggaaaacggtcctccaggaccgttgggcaaaagagggcctgcaggatcaccgggatccgagggaaggcagggcggtaagggagccaagggggatcctggggcaattggggctcctggcaaaactggccctgtgggacccgctgggcctgccggaaaaccaggacctgatgggttacggggattacctgggtccgtaggccagcaggggcgaccaggcgctacaggtcaggccggaccgcctggtccagtgggcccacccggactgccagggctccggggagacgccggagcgaaaggagaaaaagggcatcccggacttataggactgatcggaccaccaggtgaacagggggaaaaaggcgaccgcggactgcccggaccccaggggtcacccggacaaaagggtgaaatgggtataccaggcgcatctgggcctatcggccctgggggaccaccaggcttacccggaccggctggaccaaagggcgctaagggtgctaccggtcccggaggcccaaaaggcgagaaaggggtccagggccctccaggtcaccccggtccccctggagaggtgattcagcctttaccaattcagatgcctaagaaaacccggcgatccgttgacggctcccgtctgatgcaggaggacgaagccattcccactggaggagctcctgggagccctggcggtttagaggaaatctttggctccctcgattcactgcgagaagagattgagcaaatgcggaggcctacgggaacccaagacagcccagccagaacgtgtcaggacctcaaattatgtcacccagaactgcccgacggggagtattgggttgatccaaatcaggggtgcgcgagggacgccttcagagttttctgtaatttcacagctggtggggaaacgtgcgtgacacctagggatgatgtgacccagttttcttatgtagattcagaaggatcacccgtgggtgttgtgcagctgactttcctacggctgctctctgtttcagcacaccaagatgtcagctatccttgcagtggtgcagcgagagacggacccctgcggctaagaggcgcaaatgaggatgaactgtcccccgagactagcccatatgtaaaggagtttagggatggctgtcagacacaacaaggtaggaccgtgctggaagttcggactcctgtgctcgagcagctcccagtattggacgcaagcttcagtgaccttggcgctcctccacgcagaggtggggttctgttgggcccagtctgtttcatgggatag

SEQ ID NO: 4756 - DNA, 5051 bp, Artificial Sequence
  Description of Artificial Sequence: Synthetic coding sequence
ggagctccccctgtggatgtgctgcgcgctctgcgcttcccatcactgcctgatggtgtgagaagggccaaggggatttgtcctgctgatgtggcctaccgggtggctcgacccgctcagttgtccgcccctaccaggcagctgttcccaggcggtttccccaaggatttctccctgctcacggtcgtgcgcacaagacccggtttacaggctcccctgctcaccctctattccgctcaaggtgttcgccagttgggactagagctggggcgacctgttcgctttctctatgaagatcagaccggccgacctcaaccccctagccagcccgtgtttcgagggctgagtctcgcggatggcaaatggcatcgcgtagccgtagccgtgaaaggccagtccgttacgcttattgttgattgcaagaaacgggtaacgcgcccacttcctaggtctgctcggccagttctcgacacccatggggtgattatatttggcgctagaatcctggatgaggaagtgttcgaaggagacgtgcaggagcttgcgattgtacctggagtccaggccgcatatgagagctgtgagcaaaaagagttagaatgtgagggaggccagcgagaacgccctcagaatcagcagcctcaccgtgcacaacgatcacctcagcagcagccaagtagattgcaccgaccccagaaccaagagccacagtctcaggaccccacgccgggtgaagaagaggaaattctcgagagcagcctgctgcctcctttagaagaagagcaaactgacctgcaagtgccaccaaccgccgacaggtttcaggcagaggagtacggtgagggcggtactgacccgcctgaaggcccttacgactatacatatggatatggtgacgactacagggaagagacagaacttggtccggcactatccgccgagacggcgcactcaggagctgccgcacacggtccacgcggactgaaaggtgagaagggtgaacccgcagtcctggaaccgggtatgctggtggaaggaccacccggtccagagggcccagccggattaattggacccccaggcattcagggcaaccccggacccgtgggtgatcctggcgagcgtggcccaccgggacgggcaggacttccaggcagcgacggagctcccggtccaccaggtaccagcttaatgctgccctttagattcgggagcggcggtggcgacaaaggtcccgtcgttgctgcccaagaggcacaggcccaggccatccttcagcaggctagacttgcattacgagggcctcctggccctatgggttacaccggaaggccagggcctctgggccagccaggctctcccggactcaaaggggagtcaggcgacctagggcctcagggaccacggggaccccagggtttaactgggcctcctggcaaggctgggagacgtgggcgtgcgggagctgatggcgcacgcggaatgcctggagatcccggagtgaagggcgatagaggtttcgacggtttacccggactgcctggagagaaagggcaccggggtgataccggagctcagggtctgccaggcccacccggtgaagacggcgaacgcggagatgatggagaaataggtccccgaggccttcccggtgagtcaggcccacgtggcttgctcggtcctaaagggcctcctggtatacctggccctccaggggtcagggggatggacggaccccaaggccctaagggcagcctcggaccccagggggagcccggtcccccaggccagcagggtacaccgggtacccaggggctgccaggccctcagggcgctatcggaccacatggtgagaagggccctcaaggcaaaccgggactgccaggcatgcccggaagtgacgggccaccgggtcacccaggcaaagaaggccctcctggaaccaaaggcaatcagggaccatccggtccccagggacctctgggatatccaggccctcgaggcgtaaaaggtgttgatggcatcaggggactgaagggccacaaaggcgagaagggagaggacggattccccggattcaaaggagacattggggtaaaaggggaccgtggagaggtaggtgttcccggatcaaggggtgaggatggacccgaggggcctaaaggaaggaccgggccaacgggagaccctggaccgcctggccttatgggggagaaggggaagttgggggtccctggtttgcccggttacccaggaagacagggccctaagggaagcttgggatttcctggatttccaggggcttctggcgagaaaggagcacggggattgtccggcaagagcggccctaggggcgaacgtggtcccacgggccctagagggcaacgcggtccccgtggtgctacaggaaaatccggcgctaagggcacaagtggaggcgatgggcctcatgggcctccgggagagagaggcctgccaggacctcaggggccaaacggattccctggcccaaaaggccctcccggtccacctggaaaagatggactgcccggacaccccggtcaacggggtgaggtcgggtttcaggggaaaactggtccgcctggcccaccaggtgtagtcggcccacagggagctgcaggcgaaactggcccaatgggagagcgtggccacccaggaccgccaggccctccgggtgagcagggtctgccaggaacagctgggaaagagggcacaaagggagatccgggtccaccgggtgctcccggtaaggacggcccagctggcctgcggggatttcctggcgagaggggtttgccaggcacagccggtggaccaggcctgaaaggcaacgagggtcccagcggccctccaggccctgccggatcccccggtgagcgcggagccgcaggctctggagggcctattggtcccccaggtagaccaggaccgcagggccctccaggcgctgccggagaaaaaggtgtcccgggagagaaaggcccaatcggtcccactggtagagatggggtgcagggacctgtgggactgccagggccagcgggaccaccgggtgtggcgggagaagatggcgataagggcgaggtgggagacccgggacagaaggggacaaagggcaataaaggagaacatggaccaccgggacccccaggccctattggtcccgtggggcagccgggagcagccggagccgacggcgaaccgggagcacgtggaccacaggggcacttcggagccaaaggagacgaagggacccggggattcaacggccctcccggacctattggcctgcaaggactccctgggccaagtggtgagaagggcgagacaggtgatgttggtccaatgggccctcccggacctccagggccacgcggtccggcaggtccaaacggagcagatggacctcaggggccaccaggaggagttggcaacttagggccacccggagagaagggggagcccggagaaagcggatcccccggaatccagggagagccaggggtgaagggccctcggggagaacggggtgagaagggcgagagcggacagccaggagaaccaggaccgccaggacctaagggacccacgggagacgatgggccaaaggggaaccccggtcccgtgggctttccgggagatcccggaccgcctggggaaggcggacctcgcggacaggacggtgctaagggagaccgaggcgaggacggcgaaccaggacagcccggttcacccggtcccaccggcgaaaacggaccgcctggacccctggggaagcgtggaccagccggttctcctggatcagagggaaggcaggggggtaagggcgctaagggcgatccaggcgcaatcggtgccccaggaaaaaccggaccggtcggccctgcaggccctgctgggaagcctggaccagacggcctccgcggattgccgggaagcgtgggtcagcagggacggccaggtgctacaggccaggcgggtccccctggtcccgtcggtcctcctgggctgccaggcctccgtggcgatgccggtgcaaagggtgaaaaaggccatcctggtttgatcggcctgatcggcccacctggggagcagggagaaaaaggtgatcgtggactccccggaccgcagggtagtccgggacagaagggcgaaatgggaatccctggagcaagtgggccaatcggccctgggggaccccctgggctgccgggtccagccggtcccaaaggtgctaagggagcaaccggcccaggtggtccaaagggcgagaagggcgtgcaaggcccacctgggcacccgggacctcccggagaggtcatccagccgcttcctattcaaatgcccaagaagactagacgaagcgtagatggctccagactaatgcaggaggacgaggcaattcccactggcggtgcgccaggctcccccggaggactggaagaaatcttcggttccctagacagtttgagagaagagatcgagcagatgagacgccctactggtacccaggatagtcccgctcgtacctgccaggaccttaagctttgccacccagagctgccagacggcgagtattgggtggatcccaaccaaggatgtgccagggatgcgttcagagtgttttgcaacttcaccgccggaggggagacctgtgtcacacctagggacgacgtaacccagtttagttatgtggatagcgagggctcaccggtgggagtagtgcagctgacgtttttgcgtctgctgtctgtgtcggcacaccaagacgtttcctacccttgctcaggagctgctcgagacggaccgctgaggcttcgaggagccaacgaagatgagctgtctccggagacttctccctacgttaaggaattcagggatggatgtcagacacaacagggcagaactgtgctggaggtacgtactcctgtattggaacaactacccgtcctggatgcctcatttagcgacttgggcgctccgccaaggcggggtggagtgctgctcgggccagtctgctttatgggata

SEQ ID NO: 4757 - DNA, 5132 bp, Artificial Sequence
  Description of Artificial Sequence: Synthetic coding sequence
atggagaggtgttctcgttgtcaccggctgcttctcctgcttcctttggttttagggctgagcgcagccccaggttgggcaggagctcccccagttgatgtacttcgcgcattaaggtttccttccttgcccgatggcgtgagacgggcaaaggggatttgcccagccgatgttgcatacagagtggcccgacccgcacaactgagtgccccaacaaggcagctgtttccaggcggattccctaaggacttctcactccttaccgttgtcaggacgcgcccaggcttgcaggctcccctgttaaccttatacagcgcccaaggagtgagacaactggggctcgagttggggaggcctgtcaggttcctatacgaagaccaaacggggagaccccaacctccatcccagccagtctttcgcggactttcactggccgacggtaaatggcaccgggtggcagtggccgtgaaaggccagtctgtgaccctaatcgttgattgcaaaaagagagtgacaagaccactgcccagatctgcgcgaccagtacttgacacccacggtgtgattatctttggggcacgcatccttgacgaagaggtcttcgaaggcgacgtgcaagagttggcaatcgttcccggagtgcaggccgcttacgaatcatgtgagcagaaggaattagaatgcgagggcggacagcgcgagcggcctcagaatcagcagcctcatcgagctcagaggtcaccccagcagcagccaagcaggcttcaccgcccacaaaatcaggaaccccagagccaggaccccacgccaggtgaggaggaggagatcttagaatccagcttgctacctcccctcgaggaagagcaaaccgatctccaggtccctcctacagcagaccgattccaggcagaggagtacggcgagggtggaaccgatcccccagaaggcccatacgattacacttacggctatggagatgactatcgagaagagactgagctgggcccagccctgtccgctgagaccgcccactccggggcagcagcacatggaccgaggggactgaagggtgaaaagggggagccagctgtactagaaccaggaatgctggtggaggggccaccagggcctgagggccctgcaggactcatcggcccacccggtatccagggcaaccctggacctgtcggcgatccgggagagcggggtccccctggcagagctgggcttcccggaagtgacggagcccctggcccaccagggactagcctgatgctcccgtttagattcggcagcgggggtggggataagggtccggttgtggcagcccaggaggctcaggcccaggccatcctgcaacaggccagacttgccttgagaggcccacctgggcctatgggctatacaggccgacctgggccactgggtcagcctggttcaccaggcctgaagggcgagtctggtgacctgggaccccaaggcccacggggtccgcaaggattaactggtccacccggaaaggccggacgccgtggcagggcgggagccgacggcgctagaggaatgcccggagaccctggtgtgaagggcgacagaggcttcgatggcctgcctgggcttcctggggagaaaggacataggggggacaccggtgcccaggggctgcctggaccccctggtgaggacggcgaaaggggcgatgacggcgagatcggaccaaggggtctcccaggagagtctggtcctagaggcctgctgggcccaaaggggcctcccggaatccctggcccaccgggagtacggggtatggatggaccacaggggccaaaaggaagcctcgggccacaaggcgagcccggtccgccagggcagcagggcacgcccggtacacaggggctcccaggtccacagggtgccatcggaccccacggagagaaggggccacagggcaagcctggactaccgggtatgcccggaagtgatggccctccgggacatcctggtaaggagggaccacctggaacgaagggcaatcaagggccatctgggccacagggtcccctaggatacccaggcccaagaggcgttaagggcgtcgatggaataaggggcctgaaaggacacaagggagagaagggcgaagatggctttcccggtttcaaaggcgacattggcgttaaaggcgatcggggtgaggtcggcgttccaggatcaagaggagaggatggaccggaaggcccaaagggacgcactggaccaaccggtgatccaggaccacctggcttgatgggggaaaaaggtaagcttggggtgccaggcctacctggctacccgggacgacaaggtcctaagggcagcctgggattcccgggttttccgggtgccagcggagagaagggtgcacgcggactatccggtaagagtggccctaggggcgaaagaggccctacgggtccacgtggacaacgaggacccaggggagctactggcaaaagtggagctaaaggaacaagtggtggcgacggcccacatggcccacctggcgagcggggactgccaggccctcagggacccaacgggttccccggacccaagggcccacccggtccccctggcaaagacggtctgccaggacaccctggacagcggggagaagtgggctttcaaggtaaaaccggacccccaggaccacccggagtagtcggccctcagggtgcagcgggagagaccggccctatgggtgaaaggggacatcctggccctccagggccacccggagagcagggactgccaggcactgccggaaaagaagggacaaaaggtgatccaggacctccaggtgccccaggcaaggatggacctgctgggctgcggggttttccgggagagaggggactgccaggaaccgccggaggcccagggttaaaaggtaatgagggcccttccggaccccctggcccagctggcagcccaggtgagaggggagctgccggtagcggcggtccgattggtcctccaggacgtcctggcccacaggggcctccaggcgctgcaggcgaaaagggagtccctggagaaaagggacccatcggacccacggggcgtgatggcgtccaaggtccggtgggactccctgggccagcaggccctccaggcgtagccggtgaagacggagataagggtgaggtcggcgaccctggccagaaggggactaaaggcaacaaaggagaacacggtcctcccggaccccctggaccgatcgggcctgtgggccagcccggtgcagccggagcagacggagaacccggagctagaggtccccagggccactttggcgctaaaggagatgaggggaccaggggctttaatggtccacccggaccgatcggcctgcagggtctgccaggaccgagcggagaaaaaggcgagacaggcgacgtgggacctatgggcccacctggcccaccgggacctcggggacccgctggaccaaacggcgctgacgggccacaaggccctcctggcggagtgggaaacttgggtcccccaggagagaaaggagaaccgggagaatccggatcacctggcatacaaggagagcccggagtgaagggaccaagaggcgaacgtggggagaagggcgagagtggtcagcccggtgaacctggccctccagggccaaaaggtcccactggtgacgacgggcctaaaggaaacccaggccctgtcggcttcccaggggaccctggtccgccaggagagggcggtcctcggggacaggacggggcaaagggggatcgtggtgaggacggggagccaggacagcctgggtcaccaggaccaacaggcgaaaacggcccaccaggtcctctggggaagcgtggcccagccggatcacctggatccgaaggtaggcaaggcggaaagggagcaaagggagaccctggggctataggggcaccaggcaagacagggccagtagggccagctggtcctgcaggcaaacctggcccagatgggttgaggggcctgcccggtagtgtcggccagcaaggtaggccgggtgcgactggacaggcaggaccgcctggcccagtcggcccacccggactgcccggattaagaggagatgcaggggctaaaggagagaagggccatcctggacttataggtctgattggccctccgggagagcaaggcgagaagggcgatcgcggtttgccaggccctcagggatcgccgggacaaaaaggggagatgggcataccgggtgcaagcggacccatcggaccaggtggtccgccaggattacccggaccagccggaccgaagggcgcaaagggcgcaaccgggccaggtggtcccaagggggagaagggcgtccagggacctcctggccacccagggccacctggggaggtgattcagcctctcccaatccagatgccgaaaaagacaaggcgtagcgtggacggctcgagactgatgcaagaagacgaagctatcccgaccggaggagctccaggaagtcctggcggacttgaggaaatctttggcagtctggatagtctcagagaagagatcgagcagatgaggcgcccaacaggtacacaggacagtcccgctcggacatgccaggatctgaaactgtgtcaccccgagcttcccgacggagaatattgggtggacccaaatcagggttgtgcgagggacgcgtttcgagtcttttgcaactttacggccggaggcgagacttgcgtgacacctcgggatgacgtgacacagttttcctacgtggactcagagggctctccagtgggcgtggtgcagctcacctttctgcggctgttgtcagtaagcgcccaccaggatgttagctatccatgctcaggcgcagcacgagatggacctctccgcttgcggggagctaacgaggacgagctttcacctgagacttccccctatgtgaaggagttcagagacggctgccagacccagcaaggtcgcacagttctcgaggttaggacccccgtgctggagcagcttcccgtgttggatgcttccttttcagacttgggagctccccctaggcgcggaggagtgctcttggggccagtgtgctttatgggcta

SEQ ID NO: 4758 - DNA, 5133 bp, Artificial Sequence
  Description of Artificial Sequence: Synthetic coding sequence
atggaacgttgttcccgctgtcataggctgctcctcctgctgccattagttctgggtctgtctgccgctcccggttgggccggagccccacccgtcgacgttctgcgagctctgagattcccttccttacccgatggggtccgtcgtgccaaaggaatctgtccagccgacgtggcgtacagggtcgcgagaccggctcagttgtccgcccctacgaggcaactgtttcccggtggctttccgaaggatttttctctcctgaccgtggtaaggactcgccctggactgcaggcccctctccttaccctctatagcgctcagggcgtccggcaactggggctcgagttaggtaggccagtgcggtttttgtatgaagaccaaactggaagaccccaacccccatctcagcctgtattccggggtttatccttggccgacggcaaatggcaccgcgttgccgtcgccgtcaagggtcaaagtgtcacccttattgttgattgtaaaaagcgggttacacgccctctgcctagatcggcccgtccagtccttgatacacacggagtgatcatattcggagccaggatattggacgaagaggtgttcgagggcgatgtgcaagagctggccatcgtgccgggtgtgcaggccgcatatgaaagttgtgaacagaaggagctggaatgcgaggggggtcagcgcgagaggccccagaaccagcagccacatagagcccagagatctcctcagcagcagccatccaggctacaccgtccccagaaccaggagccccagagtcaggacccaaccccaggggaagaggaggagatcttggagagctcactgttgccccctcttgaggaggaacaaaccgaccttcaggtgccgccaaccgccgaccgcttccaggccgaggagtatggggaaggcggtaccgaccccccagagggtccgtacgactatacatacgggtacggcgatgattaccgggaggaaacggagctgggcccagccttgtctgccgagacagcccatagcggtgcagcggcacatgggccacgtggccttaagggcgaaaagggggaacccgctgtgctggaacctggtatgcttgtggaaggacctcctggcccagaggggcctgcaggtctaattggaccccctggtatccagggaaacccaggcccagtgggagaccccggagaaagagggcctccaggtcgggcagggctgccagggtcggatggcgctcccggtcctccagggacatcactcatgctaccctttagattcggctctggcggaggagacaaaggcccagttgtggcagctcaagaggcacaggcgcaggccatactccaacaggccagacttgctttaagggggccaccgggacctatgggatataccgggaggccgggacctctgggtcagcctggaagtccgggactgaagggcgagtcaggagacctcggcccacaaggcccacggggtccacagggccttacagggcctcccggtaaggcgggaagaagggggagagctggggctgacggtgccagagggatgcccggagatccaggagtgaaaggagaccggggatttgacggcctgcctggactcccaggggagaaaggccatcggggtgacaccggtgcacaaggcttacccggtcctcctggcgaagatggcgagcgtggtgacgacggggagattggccctcggggtctcccaggcgagtctggcccaagagggcttctagggccaaaaggcccacccggaattcccggaccgcctggcgtcagaggcatggacggccctcaaggccctaaaggatctctgggacctcagggggaaccagggccaccaggacagcaaggcactcctggaacccagggattaccaggaccgcaaggggctattgggccacacggcgagaagggtccccagggaaaaccaggactgcctggcatgccagggagtgacggacctcccggacaccctgggaaggaaggtcctcctgggaccaagggaaaccagggaccttccgggccacagggacccttggggtaccccggtccccgaggggttaagggggtcgatggcattaggggcttgaaaggacataagggggaaaaaggtgaagacggattccctggcttcaaaggggatattggagtaaaaggggaccggggagaagtgggcgtccctggatcacgaggcgaggatggaccagagggaccaaagggacggacaggtcccaccggtgaccccggaccccctggcctgatgggagaaaaaggaaagctgggtgtacccggacttccaggttatcctggcaggcaggggccaaaggggtctctgggtttcccaggcttccccggtgcctccggcgagaagggggcaagagggctgagcggtaagagcggacctcgcggagaaaggggacccacagggccaagaggacaacgtgggccacggggagcaaccggtaaaagcggcgcaaaagggacatctggaggagacggcccacacgggcctccaggagagcgcggactgcccggtccacaggggcctaatggctttccaggaccgaagggccctccgggaccaccaggcaaggatggcttgcccggacaccctggccagcgcggtgaagtggggtttcagggcaagacgggtccacctggtccacctggggtcgtaggaccacagggcgctgcaggggagaccgggccaatgggggagagaggtcatcctggcccacccggtccaccaggagagcaggggctccctgggaccgcgggaaaagagggcactaagggtgatcccggaccccctggggcacccggaaaggatggacccgctggtttgaggggctttcctggcgaacgcggactacctggaactgcgggaggacctggactgaaaggcaacgaagggccaagcggacctccgggaccagccggatcgcctggggagcggggagccgcaggttcagggggacccatcgggccaccaggccgtcctggtccccaagggccacccggagcggctggcgagaagggcgtgccaggggagaaggggccaattggcccaacgggccgagacggtgtgcagggacctgtgggactgccaggccctgccggaccgccaggtgttgccggtgaggacggcgataagggagaggtaggtgatccaggacagaaggggaccaaaggaaacaagggagagcacggtcctccagggcctccaggcccaattggtccagtcggtcagcccggagcggctggcgcagatggggaaccgggagcaaggggcccacagggtcatttcggggcaaaaggagatgaggggaccagagggtttaatggcccaccaggtccaatcggtcttcaggggctgccgggtccatccggtgaaaagggggagactggcgatgttggtccaatgggaccacccggacctccagggccaaggggccctgccggacctaacggtgccgacggaccccaggggcctcctgggggtgtcggaaacctgggccctccgggtgagaagggggagcctggagagtccgggtccccaggcatccagggagagccaggggtgaagggacccaggggtgaacgcggtgagaaaggcgagtcgggccaacccggagagcctggcccaccagggcctaagggacctacgggggatgatggccctaagggcaatcccggacccgtcgggtttcccggtgaccccggaccaccaggggaaggcggtccacgaggacaggatggtgcgaaaggggatcggggtgaggatggggagccgggacagcctgggtctccaggcccaactggggagaacggtccacccggacctctgggcaagcgcggaccggctggaagcccgggtagcgagggtcggcagggcggaaagggcgctaaaggggatcccggtgctattggggcaccgggaaaaacgggcccagtcggacctgccggaccggctgggaaaccgggtccggacgggttaaggggcctgcccggatctgtcggccaacagggacgacccggtgccaccggacaggcaggtccgcctggtccggtggggcctcccggactacccggactcaggggagacgccggtgccaaaggtgaaaaagggcaccctggactgattggtctcattggaccaccaggcgagcagggggagaaaggcgacagggggctgccgggtccccagggctctcccggtcagaaaggggaaatgggaattccaggcgctagtggccctatagggccaggtgggccaccaggtctcccaggcccagctggaccaaaaggagccaagggagccactggcccaggtggacccaaaggcgagaagggggtccagggtcccccagggcacccaggccctccaggcgaggtcatccaaccattgccgatccagatgccaaaaaaaacccggagaagtgtagatgggtcccgtcttatgcaggaagatgaagcaatccccaccggcggagctccagggagcccaggtggcttggaagaaatctttggatcattggatagtttgagagaggaaatcgaacagatgcggaggcccaccgggacacaagattcacctgcccgtacctgtcaagatctgaagctttgccacccagagttaccagatggagagtattgggtggatccaaatcagggttgcgctcgggatgcctttagggtgttctgtaacttcacagcaggaggtgaaacttgtgtcactcccagggatgatgtgacacaattttcatacgttgacagcgagggctcacctgtaggggtggtgcaactgaccttcctgagactcctgtctgtcagcgcccatcaggacgtgtcgtatccatgcagtggcgctgcgcgagatggtccgttgcgactgcgcggagccaacgaggacgaacttagccctgagacctccccatacgtaaaagaatttcgtgacggatgccaaacacagcaagggagaaccgtgctcgaggtgcgtacccctgtgctcgagcagctcccagttcttgacgctagcttctctgatctgggtgctccccctcgccgaggaggtgtcttgctgggtccagtatgtttcatggggtar

SEQ ID NO: 4759 - DNA, 5030 bp, Artificial Sequence
  Description of Artificial Sequence: Synthetic coding sequence
atggagagatgctcacggtgtcatcggctgctgttgctgctgccactggtccttggcctgagtgccgcaccaggctgggccggtgcccctcccgtcgatgtgttgcgagcactgcggttccccagtctgcccgacggtgtgcgcagggctaaggggatctgcccagcagacgtggcatatagagtggccagaccagcgcagctgtcagctcccacccgccagctatttcctggaggcttccccaaggactttagtcttttgactgtcgtgcgcactcggccagggcttcaggcccctctgttgacattgtacagcgcccagggagtccgtcaactgggacttgaacttgggcgacctgtgagatttctgtatgaagaccaaacagggagaccacagcccccatcacaacccgtcttccggggtctttcgcttgctgatggcaaatggcacagggttgccgtggctgtgaagggccaatccgttactcttatcgtggactgtaaaaagagagttactaggccgctgcccagatccgccaggcccgtactcgacacccatggagtcatcattttcggcgcacgaattcttgacgaagaggtatttgagggagacgtgcaggagctcgcgattgtgcctggtgtgcaagctgcctatgaaagctgcgagcagaaggagctcgaatgtgaagggggacaacgtgagcgtcctcagaaccagcagccacatcgggctcaacgatcaccccaacagcaaccttccaggttacatcggccacagaatcaggagcctcaatcacaaccgacagaatctttgtattatgattatgaaccgccatactatgatgtcatgaccacaggaaccacccctgactaccaggacccaactccaggagaggaggaagagatcctggaatcctccctgttacctcccttagaggaggctgcccacggccctcgtggccttaagggcgagaagggcgagcccgctgttttagagcctgggatgttagtggaggggcctcccggacccgaaggccctgctggcctgataggcccacctggcattcaaggaaaccctgggcctgttggtgaccccggagagaggggacctccgggtagagctggcctacccggatcagatggagctcctggtccgccagggactagcctcatgcttccttttcggtttggctccggtggtggcgataagggacccgtagtcgcggctcaggaggcacaagctcaagcgatcctgcagcaggccagactcgcgttgagggggcctccaggtcctatgggttacaccggcagacccggtcccctcggacaaccaggctcaccgggtctgaagggtgaaagcggagatctcggaccacaggggcctcgagggcctcagggtctaactggacccccaggaaaggcaggaagaagaggacgagccggtgccgatggcgcacggggaatgcccggtgatcccggagtgaagggcgatcggggtttcgacggcctgccagggttaccgggagaaaagggacaccgcggagataccggcgctcagggcctccctgggcctcctggtgaagacggcgagcgcggagacgatggggaaattggccctagaggcctgcctggtgaatctgggccaaggggactactggggccaaaggggcctccgggtatccccggaccccctggtgtcaggggcatggacggccctcaaggacccaaaggttcactagggcctcagggcgagcccggtccacctggtcagcaagggacccccggtactcagggcctcccaggcccacagggcgcaatcgggcctcatggagagaagggaccccagggcaaacccggtctccctggaatgccaggatcagatggcccacctgggcatccaggcaaggaaggtcccccaggaacgaaagggaatcaggggccttccggcccacaagggcctctcgggtatccaggccctaggggggtaaagggggtggatggtatccggggacttaaaggccataaaggcgagaaaggagaggacgggttcccaggatttaaaggggacatcggcgtgaaaggcgacagaggtgaagtcggtgtaccgggaagccggggagaggatgggccagagggacctaaggggaggactggacctactggggacccgggaccaccgggacttatgggcgaaaagggaaaactaggagtgcctggcctgccaggctatcctggcaggcagggccctaagggcagcctgggttttcctgggttcccaggagccagcggggaaaagggggctaggggtctgagcggcaaaagtgggccacgcggagagagaggcccaaccggacccagagggcagaggggtcctcgtggcgcaactgggaagagcggcgcaaaagggacatctggcggtgacggaccacatgggcctcccggtgaacgcggtctgccaggaccccagggccctaacggattccccggtccaaagggacctctgggtccaccaggcaaggacggtctgcccggacatccagggcagcgtggagaagtgggttttcagggcaaaaccgggcctccaggcccacccggtgtggttggcccacagggcgctgctggtgagactgggccaatgggcgaacgcggtcacccagggccacctggtccgcctggggaacagggtctgcccggaaccgctggcaaggaggggactaagggggatccaggcccacccggagccccaggtaaagatggccctgcagggctccgcggatttcctggggaaagaggactgcccggaaccgcaggcggacctggacttaaaggaaacgaaggcccatcgggcccacctggccctgcaggctcaccaggagaacggggagctgctggctctgggggacccatcggacccccaggaagacccggaccgcaaggccctcccggtgcagccggagaaaagggcgtgcccggagagaagggcccaatcgggccaaccggcagggatggggttcagggacccgtagggctgcccggacccgctggtcctccaggtgtggccggtgaagatggcgacaaaggcgaggtcggggaccccggacagaagggaacaaagggcaacaagggcgaacatgggcctccagggcctccaggccctatcggccctgtggggcagcctggcgcagccggagcagatggagagcctggggctcgcggtccacaaggccatttcggcgctaagggagacgaaggtactcgcggattcaacggcccacccggaccaatcggattacaaggacttcctggcccatcaggcgagaagggcgagacgggggatgtggggcctatgggaccaccagggccacctggtcctcgcggacctgctggacctaatggagctgacggccctcaagggccacccggaggcgtggggaaccttggccctcccggtgaaaagggcgaacctggtgagagtggatcccctgggatccagggggagcctggagtgaagggcccacgaggggagcggggtgaaaaaggcgagtccgggcagcccggtgagcccggaccgcctggacccaaaggcccaacgggggacgatggcccaaagggaaaccctggacccgtaggattcccaggagatcctgggcctcccggagaaggaggccctagaggacaggatggagccaagggggaccgcggagaggacggcgaacctggccagccaggaagccccggaccgactggagagaacggacctccaggcccattgggtaaaagaggtcctgccggttcacctggcagtgaaggtcgccaggggggtaagggtgctaagggcgaccccggagccatcggggctccagggaagaccgggccagtcggcccagcaggcccagcaggcaaacccggacccgatggcctaaggggtctgccgggatccgttgggcagcaggggaggccaggagctaccgggcaggccggaccccctggaccagtgggcccaccaggtcttccgggactgagaggcgacgccggagcaaagggcgagaaaggtcaccctgggttgatagggctcattggccctccaggcgagcaaggagagaaaggggacaggggactacccggtccgcagggctctcccggtcagaaaggagagatgggaattcccggtgcctcaggtccgatcgggcctggcggaccccctggacttcctggcccagccggtcccaagggcgcaaaaggggcaaccggccctggcggtccaaagggggagaaaggtgtgcaagggcctccgggtcatccgggacccccaggagaagtcattcagcctctgcctatccaaatgcctaaaaaaacacgcagaagtgtcgacggctctagattaatgcaggaggatgaggccatcccaaccggtggcgcacccggtagtccgggtggactggaagagatattcgggagtcttgacagcttgcgggaggaaattgaacagatgcgacgccctacaggcactcaggactcccctgctagaacatgtcaggacctgaaattatgccacccagagcttccggacggtgagtattgggtagatcctaaccagggatgcgccagggacgctttccgggtgttttgcaattttaccgccggaggggagacctgcgttaccccacgggacgatgtgacccagttttcttacgtagacagtgaaggcagccccgtcggggtggtgcagcttaccttcctgcggttgctttccgttagtgcacaccaggacgtgtcttacccttgcagcggcgctgcccgagacggcccactcaggctccgaggagctaacgaagatgagttgagtcccgagacctctccctatgtgaaggagttcagagacggatgccagacccagcagggcagaaccgtgctggaggtccgaacgcccgtcttggaacagcttcccgttcttgacgcatccttctccgacctgggagcaccacctaggagaggcggagttctactgggcccagtttgcttcatgggata

SEQ ID NO: 4760 - DNA, 921 bp, Artificial Sequence
  Description of Artificial Sequence: Synthetic coding sequence
atggattggcgcgcaagcgaagcgtggatggttcctagggcccctaaaggtgcctgggatccaagagagtctcaggacctactcgataatagagccccacttgggcctcgcgtattccccggaccgagagttccaagcgccctgatggagcgtagagtactgaagggctcgcaaggatcgcctgcttgtcccggtccccctggagaagtcattcagcccctgcccatccagatgccaaagaagacccggagaagtgtggatggctctagattaatgcaggaggatgaggctattcccactggcggtgctccaggatcacctggcggtttagaggaaattttcggcagtctggatagccttagagaagagattgagcagatgcgccgacccacagggacccaagacagtcccgcaaggacttgccaagatctcaagctttgccatccagagcttcccgacggcgaatattgggtcgaccccaatcaaggctgtgctcgcgatgcatttcgggtcttctgcaacttcaccgccggaggggaaacttgcgttactccgcgagacgacgtcacccagttctcttacgtagactccgagggctctcctgttggagtcgtgcagctgacatttctccgccttcttagcgtcagcgcgcatcaggatgtttcatacccttgttctggcgcagccagggacggcccacttcgcctccgaggggcaaatgaggacgagttgtctcccgagacctccccctatgtcaaagaattcagggacggatgccagacccagcagggtaggacggtcttggaggtgagaactcccgtgttggagcagctgcccgttttagatgcttctttcagtgacctgggagcccctccccgtcgaggtggagtgttattgggacccgtgtgcttcatgggctag

SEQ ID NO: 4761 - DNA, 5069 bp, Artificial Sequence
  Description of Artificial Sequence: Synthetic coding sequence
atggagcgatgctcaagatgtcatcggcttctgttgcttttaccgctcgtgcttgggctgagcgccgctccaggttgggctggagcccctcctgtagacgtcttgcgcgctctgaggtttccatctctccccgatggtgtgcgtagagccaaagggatctgccctgccgacgtggcgtaccgagtggctaggcccgctcagttgagcgcacctacccggcagctgtttcccggtggatttccgaaggatttctccctgttgaccgtcgtgcgaactcgacctgggctacaggccccactactgaccctctattccgcccagggcgtgcgacagctcggcctcgaactgggcagaccagtgcgctttctgtatgaagaccagacaggacggcctcagcccccaagtcagcctgtctttagagggttgtcacttgcggacggcaagtggcacagagtcgccgttgcagttaagggacagagtgtcacactgattgttgattgcaaaaaaagagtgaccaggcccctgccccgatccgcgagaccggtgctcgatactcatggagtgatcatttttggcgctcggatcctggatgaagaggtctttgagggtgatgtccaggaactcgccattgttccaggggtgcaagctgcatacgaaagttgcgagcaaaaagagttagagtgtgaaggcggtcaacgggagagaccacaaaatcagcagcctcaccgcgctcaaaggtccccccagcagcagccttctaggctacaccgtcctcagaaccaggaaccgcagagtcaggaacaaactgatctgcaggttcccccaaccgccgatcgctttcaagccgaggaatacggcgaggggggaaccgacccaccagaaggtccatatgactatacttacggttacggtgatgactacagggaggagactgaactgggacctgccttgtctgctgaaacggcacattctggcgcagctgcccatggccctagagggctgaagggagaaaagggggagcctgctgttctcgaaccaggcatgctggtggaggggccaccaggacccgaagggccagctggcctgatcggtcccccagggattcagggcaacccaggtcccgtaggcgaccccggagagcgcggaccacccggtagggcgggtcttcctggaagcgatggggcaccaggcccaccgggaacctccttaatgcttcctttccgctttggttctggtggaggagataagggccctgtggtggccgcacaggaagcgcaagcacaggctatattgcaacaggcgagacttgccttaagaggcccacctggacccatggggtacacaggcaggccgggtccgctgggacagccaggctcacccggactcaagggggagagtggcgatcttggtccacaggggccacgcggtccacagggcctcacagggcctcccggtaaggccggaagacgcggaagggcaggagccgacggagccagagggatgccaggagacccaggcgttaaaggggacagggggtttgatggactccccggactgcccggagagaaaggccaccgaggggatactggggcacaggggcttccagggccacctggtgaagacggtgagaggggggatgacggggagatcggccctcggggacttccgggtgaatcaggtcccagaggcctcctggggccaaagggaccacccggtatcccaggcccacctggtgtccgaggcatggatggaccccagggcccaaaggggtcattggggcctcaaggtgaacctggccctcctggtcagcagggcactccaggtacccagggtctgccagggccacagggtgctatcgggcctcacggggaaaaagggcctcaaggaaagcctggccttccaggcatgcctggaagcgatggccctcccggtcaccccggaaaggagggcccaccaggcacgaaaggcaaccaagggcctagcggaccccagggcccattgggataccccggtccccgaggggtgaagggggtcgacggcatcagaggacttaagggacataagggggagaagggggaagatggctttccaggatttaagggcgatatcggggtcaagggcgacaggggagaggtcggggtgcccggttctcgtggggaagacggccctgaggggccaaagggcaggacggggccaactggagatcccggacctccaggcctgatgggagaaaagggaaagctgggggtgccagggctgccgggttatccagggagacaggggccaaagggcagccttggcttcccaggatttcctggagcctctggagaaaaaggagcaagaggactgagcggcaaaagcggccctagaggcgaaaggggtccaactggccctagagggcagcgcggacccaggggtgccacgggcaaatcaggcgctaagggaacatctggtggtgacggaccgcacggtcccccaggcgagagaggcttaccagggcctcaggggcctaacggctttcctggacccaagggtcctctgggtcctccgggtaaagacggtcttccagggcatccaggccaacgcggagaagttggattccagggcaagacaggaccacccggtccaccaggcgtggtgggccctcagggagcagcaggtgaaactggccctatgggcgagcggggtcacccagggcctccaggcccacccggtgagcagggcctgcctggaacagccggtaaggagggcactaaaggtgacccaggccctcctggggctccagggaaggatggcccagcagggttacgagggttccccggtgagaggggccttcccggtacagccggtgggccaggtttgaaaggaaatgaaggacctagcggcccaccaggacctgctggaagcccaggcgagagaggagccgcagggtctggcggacccatcggaccgccaggtcgtcctggaccgcagggaccgcctggcgcagccggtgagaaaggagtccccggtgagaaaggacctatcggaccaaccggtcgagatggggttcagggacccgtaggcctgccgggacccgcaggcccaccaggcgtggccggtgaggacggcgataagggcgaggtgggcgaccccggtcagaaaggcactaaaggaaataaaggggaacacgggcctcccggacctcctggtcctatcggtcccgtcggccaaccgggagccgcaggggcagatggcgaaccgggagcgcgtggtcctcagggtcacttcggggcaaaaggcgatgaggggacccgaggctttaacgggcctcccggtcctatcggactgcaaggacttccaggccctagtggcgaaaagggggaaacaggggatgttgggccaatgggtcctccagggcctccaggtcctcgcggtccagctggcccaaacggagctgacggccctcagggacccccaggcggagtggggaaccttggccctcccggagagaagggggaacctggggagagcggcagtccagggattcagggggaacctggagtcaaggggccacgaggggagagaggggagaaaggagaaagcggacagcccggtgaacctggtcccccaggccctaagggacccactggcgatgatggacctaagggcaatccagggcctgtgggcttcccgggtgatcccggaccacctggagaagggggaccaaggggacaagatggggcaaagggggatcgaggggaagatggcgaacctggacagcctggatcccccggacctactggggaaaatggtccgcctgggcctctggggaaaagggggcctgctgggagtccagggtccgaaggacgccaggggggtaagggtgctaaaggagatcctggggcaattggagctcctggcaagactggacctgtgggcccagccggtcctgctggaaagcccggacccgatgggctgcgcggtctgcccggttcagtgggccagcagggtaggcctggcgctaccgggcaggcgggacctcctggtccagtggggccacctggcttgccagggcttcgaggggacgctggtgctaagggcgagaaggggcatccaggacttataggcctcattggaccacctggagagcagggcgaaaaaggcgatagaggccttccaggtccccaagggtctccaggtcagaagggcgaaatgggaattcccggtgcctcaggccctatcggacctggagggccacctggtctgcctggccctgcagggcctaagggagccaagggggcaactggcccaggaggccctaaaggcgagaagggcgtccagggtccgccaggacatcctggcccacccggagaagttatacagcctttacctatccagatgccaaaaaaaacccgtcgctcggttgacggctcccgactgatgcaagaagatgaagcaatccccacaggtggcgctcccggaagccctggaggtctcgaagaaatcttcggaagtctcgactccttgagggaagaaatcgaacagatgcgtcgcccaacaggaactcaagattcaccagccaggacctgccaagatttaaaactgtgccaccctgagttgcccgatggtgaatattgggtggaccctaatcaggggtgcgcgcgtgatgcttttcgtgtattttgcaactttacagccggaggagaaacttgtgtgactccacgcgacgacgttacgcaattttcctacgtcgactcagagggctctccagtgggcgtagtgcagctgacattccttcgcctacttagtgtctcggcacaccaagatgtctcctatccctgcagcggtgccgcaagagatggacctctgcgtctgagaggcgctaatgaggacgagctgtcaccagagacatccccgtatgtgaaagagttcagggatggatgccaaacccaacaaggtcgtaccgtccttgaggtgcgtaccccagtccttgagcaactgccagtcctggatgcttccttctccgatctgggagcaccgccaagacgaggcggagttctgttaggtcctgtgtgcttcatgggcta

SEQ ID NO: 4762 - DNA, 4890 bp, Artificial Sequence
  Description of Artificial Sequence: Synthetic coding sequence
atggaacgatgctctaggtgccatcgcctacttcttttgctccccctggtactcgggctcagtgctgcccctggctgggctggcgcacccccagtcgatgtccttcgggcattgagattcccgagtctccccgatggagtgcggagggccaaggggatttgtcccgcagatgtggcctaccgggtggcaaggcctgcacagctgtcggctccaaccagacaactgtttcctgggggtttcccaaaggatttttcactgttaaccgtggttcggacaaggccaggattacaggcccctcttctaacgctatatagcgcacaaggcgtcaggcagttaggcctggagcttggcaggcccgtgcgctttctatatgaggatcagaccggcagaccacagcccccatctcaacccgtgttccgaggactatcactggccgatggaaagtggcaccgggtggccgtcgccgtgaagggacagtcagtcactttgatcgtggactgtaaaaagagggtgacccggccacttcccaggtccgcacgcccagtcctcgacacacacggagtgattattttcggtgcgagaatcctggacgaggaggtgtttgagggggacgtgcaggagctggcaattgtacctggcgtgcaggcagcctacgagtcatgcgaacagaaggagcttgaatgcgagggaggccaaagagagcgccctcaaaaccagcaaccccatcgggcacagcgcagcccacagcagcagccctcgcgcctccataggccacagaaccaggaaccacaatctcaagccgctcatggcccacgcggtttgaagggggaaaagggggagcccgctgttctggaacccggtatgctggtagaaggcccaccgggtccggagggacccgctggactcataggtccacctggcatccaagggaatccaggacccgtgggcgacccaggtgaaaggggccctccaggccgtgcaggcctgcccggatccgatggcgctcctggtcctccaggaaccagtctgatgctcccattcaggtttggttctggaggcggtgacaaaggacctgtggtggctgcccaagaggcacaagcgcaggccattctgcaacaagccagactggcactccgtggacctcccggacccatgggctacactgggcgtcccggacctcttgggcagccaggaagtcctggactcaagggagagtccggggacttaggccctcagggcccaagaggtccacagggcctgacaggacccccagggaaggccggaaggcgcggtcgggcaggcgcagatggcgctcggggaatgccgggagatccaggggtgaagggagatcggggttttgatggactgcctggcctccccggtgagaagggtcatcgcggagatacaggtgcccagggccttcctgggccacctggtgaagatggagagcgcggtgacgacggtgaaattggtcctagaggactgcctggagagagtggtcctcggggactccttggtcctaaggggccacctggcattcctggcccaccaggggtgcgaggtatggacgggccacagggacccaaggggagcctggggcctcagggcgagcccggtccccctggccaacagggcacaccaggaacacaaggcctgcctgggccacaaggcgcaattggtccccatggagagaagggccctcaaggaaaacccggtctgcctggaatgcccggaagtgatggccctcccggtcaccccggtaaggaaggcccaccgggaactaagggcaaccaaggcccatcagggcctcaagggccactagggtatccaggcccacggggagtaaagggagtggatggcattagagggctcaagggccacaagggcgagaaaggcgaagatgggttcccagggttcaaaggcgacattggagtcaagggggatcgtggggaagtcggagtacctggttccagaggcgaggacgggcctgagggacccaaaggcaggaccggtcctaccggggatccaggccctccaggactgatgggggaaaagggaaagctgggagtcccgggactccctggctatcccggtcgtcagggtccaaaaggcagcctggggtttcctggctttcccggagcctcaggcgagaagggggctcggggactgtctgggaaatcagggccacgcggagagcgagggcctacagggccacgaggccaacgcggtcctcgaggagccacggggaagagcggggcaaaaggcactagcggaggagacgggcctcatgggccacccggtgagcgcggactccccggaccccagggacccaatggtttccctggtcctaaaggtcctcccggaccccctggtaaggatgggctccccggacaccctggccagaggggggaggtaggttttcagggtaagactgggccaccaggccctcctggagtggtggggcctcaaggggcagccggagagacgggacccatgggcgagagagggcatcctggtccacctggccctccgggagagcagggcctgcctggtaccgccggtaaggagggcacaaagggcgacccaggaccccctggggcacctggtaaagacggcccagccggtctcagaggattccctggggagcgtgggctgcctgggaccgcaggaggccctgggctgaagggcaacgaaggtccatcgggtccaccgggaccggctggctcaccgggagagaggggcgcagctgggtcgggagggcctattggtcctccaggacgacctggtccccagggacctccaggggctgccggagagaaaggtgttccgggtgagaagggaccgattggcccaactggccgtgacggtgtccagggcccagttgggttgcccggtccagcgggaccccctggggtggctggagaggatggagataaaggagaggtcggagaccccggtcaaaaaggaaccaaggggaacaaaggtgaacacggtccaccgggtcctcccggaccaatcgggcctgtcggacaacctggtgccgctggcgctgacggggagccaggagcccgaggccctcaggggcattttggggctaaaggggacgagggcacccgaggttttaacggtccacctggcccaattggcttacagggccttcccggaccctctggggaaaagggcgagaccggcgatgttgggccaatgggacccccaggtccgcctgggcctagggggccagctggaccaaacggcgcagatggacctcaggggcctccgggaggtgtagggaacttgggacctcctggcgagaagggagagcccggagagagcggttctcctggaatccagggcgagcctggagtaaaagggcctcggggtgagcgaggtgagaagggcgaaagcggccaacccggagaacccggtccacccggacccaaagggccaacaggggacgacggccctaaaggcaatcccggaccagtgggatttcccggtgacccaggcccacccggtgaaggaggccctcgaggccaggatggggcaaagggagacagaggcgaagatggcgaacctggccagccagggtcccccggacccaccggggaaaacggtccacctggacctctgggaaaaagaggaccagccggatcacccggaagcgagggcagacaaggaggcaagggcgcaaaaggagatcctggggctatcggggctcccggaaaaaccggtcctgtgggacctgcaggaccggcaggtaagcctggcccagacggactccgaggtctccctggaagcgttggccagcaaggtaggcccggtgcaactggtcaagcaggaccccctggcccagttggaccacccggtcttcccggattaaggggtgacgcaggcgcaaagggcgagaagggtcatcctggactgattggattgatcggaccacctggggagcaaggagagaaaggtgataggggattgccaggccctcaggggagccccggtcagaagggcgagatggggatcccaggcgcaagcggcccaattggtcctgggggtcccccaggactccctggcccagcaggaccaaagggcgctaaaggagctaccggaccaggagggccaaagggcgagaagggtgttcaggggccacctggccacccaggacctccgggagaagtcatacagccgctcccaattcagatgcccaagaagaccaggcggtccgtggacgggtcccggctgatgcaagaggacgaggccatacctacagggggtgcacctggctcccccggaggcctcgaggagatctttgggagtctggacagcctgagagaagagattgagcagatgcgcaggccaaccggaacccaggactcccctgctagaacctgtcaagacctgaaactgtgtcaccccgagttgcccgatggtgagtactgggtcgaccctaatcaaggctgtgctagagatgccttccgggttttttgcaatttcacagcgggtggagagacttgcgtgacgcccagagatgacgttactcaattcagctatgtggattctgagggttcgcctgtcggcgtcgtgcagctaacattcctgcgtctgctgagtgtgagcgcacaccaggacgttagctacccttgctcaggagcagcaagagatgggccactacgtctacgaggagctaacgaagacgagcttagtccagagacatccccctacgtgaaggaatttcgtgatgggtgtcagacacaacaaggaaggaccgtgttggaagtgaggacccccgtgctggagcaactgcccgtgctcgacgcttctttctctgatctgggagccccacctaggcggggtggcgtgctgctggggcctgtgtgctttatggggtag

SEQ ID NO: 4763 - DNA, 5210 bp, Artificial Sequence
  Description of Artificial Sequence: Synthetic coding sequence
atggaacggtgctcccgatgccaccggttgctcctcctgctcccgctagtccttggactttccgcagcaccaggctgggccggagccccacctgtcgacgtgctgcgagctctgcggtttccaagcttaccagatggtgtgcgcagggctaaagggatctgtcccgctgacgttgcgtatagagtggctcgccctgcacagctcagtgctcccacccgccagctgtttcctgggggattccccaaggacttcagcttgctgacggttgtcaggaccaggcccggactgcaggctccactactgacactctactccgcacaaggcgtccgacaacttggacttgagcttggtaggcccgtacgatttttatacgaggatcagaccggacggccacagcctccaagccaacccgttttccgtgggctttcactggccgacgggaagtggcacagagtggcggttgccgtcaagggacagtcagtcacgctcatcgttgactgcaagaagcgggtgaccaggcccctccctcgctccgccagaccagtcttagatacccacggagtcattatatttggtgcacgtatactcgatgaggaggtgtttgagggggatgtgcaggaactggcgatcgtgcctggagtgcaagccgcttatgaatcctgtgagcaaaaggagcttgaatgtgaggggggacagagggagcggcctcagaaccagcaaccacacagggcccaaagatctccacaacagcaacctagcaggctccatagaccccagaatcaagaaccccaatcacagcccacagagtccctttactatgattatgagcccccatactacgacgtgatgaccacaggaacgaccccagactatcaggatcccacacccggagaggaagaagagattttggaaagctcactgcttcctccactcgaggaggagcaaaccgatctccaggtgcctcctacggctgatagattccaggccgaagaatacggcgaggggggtaccgatcctcctgagggcccttatgactacacctatggttatggtgatgactatcgggaggagacggagctcggacctgcactaagcgcagaaaccgctcattctggcgcagccgcacatggcccacgaggtctcaaaggcgagaagggtgagccagccgttttggaaccgggtatgctggtagaggggccaccaggcccagaaggcccagccggactgataggccctccaggcattcagggtaaccctggacccgttggggatcccggtgagcggggacctcctgggagagctggactgcccggtagtgatggggcaccaggaccacctggcaccagcttgatgttgccttttcgttttggttccggcggaggggacaaagggcctgtggtagctgcccaggaggctcaggcccaggcaatcctccagcaggctagactggctctgcggggaccacctgggcctatggggtacactggccgtcctgggccactcggccagccgggaagccccggtctgaagggtgaaagtggggatctgggcccacagggcccaaggggtcctcagggactgacgggtcctccgggaaaagctggccgtcgaggtagagcaggcgctgatggggctcgaggaatgcctggagaccccggtgtgaaaggtgatagaggcttcgacggactgcctggactgcctggcgagaaagggcacaggggcgacaccggcgcacaaggcctaccaggacccccaggcgaggacggtgaacgcggagacgacggggagatagggccacggggacttccaggagagagcgggcctcgcggactcctgggtcccaaaggacctcccggaatacccggaccacctggcgtccgcggaatggacggaccacaaggccctaaaggctcccttggaccacagggagagcctgggccacctggccagcagggcacccctggtacccagggtttgcccggtccccagggcgctatcgggccacatggcgagaaaggaccccagggaaagcccggtttgcccggaatgccaggttcggatggaccccctgggcatcccggtaaagaaggcccacctggcaccaaagggaatcagggaccttcgggaccacaggggccattgggctaccctggacctcgaggagttaagggcgtagacggaattcgcggactcaagggacacaaaggagaaaagggcgaagatggatttcccggattcaaaggcgatatcggtgtgaagggtgaccggggtgaagtgggagttccagggagccggggagaggacggaccagagggaccgaaggggaggacgggccctactggcgatcccggtcctccaggactcatgggggaaaaaggcaaactcggagtgccaggactgcccggatacccaggccgtcagggccctaagggatctcttggcttccccggtttcccaggcgcatctggcgaaaaaggagctaggggcctcagcgggaaaagcggcccacgaggggagcgcggtcctactggtcctcggggtcagaggggaccaaggggggcaactggcaagtcgggggctaagggaactagtggtggagacggcccacacggaccccctggagaacgagggcttccgggtccccaggggccaaacggatttcctgggcctaaggggcctctaggccctcccggaaaagacggactccctggccaccccggacaacggggtgaggtcggcttccaggggaaaacgggaccgcctgggcctccaggtgtggttgggcctcaaggagcagcaggggagacgggacccatgggggagaggggccacccagggcctcccggacctccaggcgagcaagggttaccaggaacagcgggaaaggaaggaacaaaaggcgacccaggacccccaggcgctcccggaaaagatggtcccgcagggctgcgcggatttcctggagaacgtggattacccggaaccgccggtggtcccggactgaagggcaacgagggcccaagtggtccacccggacctgcaggaagcccaggagaaaggggcgctgccggatccggtgggcctataggaccccctggtagacccggaccacaggggccaccgggagctgccggtgagaagggagtccctggtgagaagggtcctattggccctactggaagagatggtgtgcaggggccagtgggtctcccagggcctgctgggcctcccggagtggccggagaagatggtgataaaggggaagtgggcgaccccggacagaagggaactaagggaaataaaggtgagcacggccctcccggaccccctggcccaattggaccagtggggcagccaggggcagctggagctgacggagagccaggagccagaggaccacaaggccattttggcgcaaaaggcgacgaaggcacccgcggatttaacggaccacccggaccgatcggcctccaagggttgcctggtccgtcaggggaaaaaggcgaaacaggcgacgtcggtcccatgggtcctcctggccctccaggcccaagagggcctgccggtccgaacggtgccgacggcccacaaggaccccctggaggagttggcaacctgggccctcctggggaaaagggggagccaggcgaatctggatctccaggcatacagggagagcctggagtaaagggccctcgcggtgagagaggtgagaaaggagagagcggtcagcccggagagccaggccctcccggacctaaagggcctactggcgatgacggcccaaagggcaacccgggtcccgtggggtttccaggggaccctggcccacccggagaggggggtcctcgcggacaggacggtgcaaaaggcgatagaggcgaggacggagagcctgggcagccaggctctcccggacccactggtgagaatggccctcctggcccactgggaaaacgcggacccgctggaagccctgggagcgagggtagacaaggaggaaagggagctaaaggggacccaggcgcaatcggcgcacccggtaagacgggaccagtaggccctgccggaccagccggaaagcctgggcctgatgggctgagagggctcccaggaagtgttggacaacaggggaggcccggtgccaccgggcaggccggtccacctgggcctgtagggccacccggattgcctgggcttcgcggagacgccggagctaaaggtgagaaaggccaccccggtcttattgggcttatcggaccccctggcgaacagggcgagaaaggggacagagggcttccgggacctcaggggagccccggacagaaaggagaaatgggtatacccggagccagtggaccaattggtcccggaggaccaccaggcctgccaggaccggcaggcccaaaaggcgcaaagggcgctacaggtcccggagggcctaaaggagaaaaaggggtccaaggcccaccaggacaccccggacccccaggggaggtgatccagcctctgcctattcagatgccaaagaagaccaggagatcagtggatggaagcaggttaatgcaggaggatgaagctattcccaccggtggcgctcccggatcccctggagggcttgaagagattttcggttcacttgacagcctcagagaggagatagaacaaatgcgacgccctactggaactcaggacagtcccgctcgcacatgccaggatctcaaactgtgccacccagaattgcccgatggagaatactgggtggaccccaatcagggatgcgccagggatgcattccgcgttttttgcaactttacagccggaggagaaacctgcgtgacacccagggacgacgtaacccaattcagctacgtggactctgagggttcacccgtgggagtggtccagctcacattcctccgtctactgagtgtgtctgcgcatcaggacgtgagctatccttgctctggcgctgccagggatggtcccttgcgcctgaggggtgcaaatgaggacgagttgtcgcctgaaacctcgccttatgtaaaagaatttagggacgggtgccagactcagcaggggaggactgtccttgaagtgcgcactcctgttctcgagcaactccctgtccttgacgccagtttcagtgacttgggagcacctcctaggcggggaggggtgctgcttgggccagtctgtttcatgggcta

SEQ ID NO: 4764 - DNA, 5210 bp, Artificial Sequence
  Description of Artificial Sequence: Synthetic coding sequence
atggagaggtgttctagatgtcacaggctcttgctgctgctcccactagtacttgggctcagcgccgctcccggatgggcaggtgcccctcctgttgatgtcctgcgggctttacgcttccccagcttaccagatggagtcagacgggctaaggggatctgccccgcagacgtggcctaccgggtcgcgaggcccgctcagctatcagctcccacgaggcagctgtttcccggagggtttcccaaggactttagtttactaacagttgtacggacgagacctggtcttcaagctcctctgctgactctgtattcggctcagggggtgcgccagctggggctggaattaggcagaccagtaagatttctgtatgaagaccagactgggaggccccagccgccttcccagccagtgtttcgcggtctgtcactggctgacggcaagtggcatcgagttgctgtcgccgtcaagggccagtcagttaccctgatagtggattgtaaaaaaagggtaacccgtcctctgccgagaagcgctcgtcctgtactcgatacccatggggtgataatcttcggggctcgcatcctcgacgaagaggtgtttgaaggcgacgtgcaggaattagcaattgtacccggtgtccaggctgcatacgagtcatgtgaacagaaggaattagaatgtgagggcggtcaaagggaaaggccgcaaaaccagcagccccatcgggctcagcgctccccccaacagcagccttcacgcctgcatcgtccacaaaaccaagaaccacagagccagcccacggaaagcctctactatgactacaaacccccttactacgatgtgatgactacaggcaccaccccagactaccaggatccgacgcccggagaggaggaagagatccttgaaagcagtttacttcctccacttgaggaagaacagactgaccttcaggtgcctcccactgccgatcggtttcaggctgaagagtatggtgaagggggaactgacccgccagaaggaccctatgattacacctatggttacggagatgattatcgagaggagactgaactgggcccagcattaagtgcagagactgcccattccggagccgcagcccatgggccaagaggcctaaaaggcgaaaagggtgaacccgcagtccttgagcccggaatgctcgtcgagggtccccctggccctgagggccctgcgggtctgattggacctcccggaattcaggggaatccaggtcctgtgggcgatccaggtgaacggggaccccctgggagagctggcttacctgggtcggatggcgcaccgggtccaccagggacgagccttatgttgccgttccgtttcggctcaggcggaggggacaaggggcctgtagtcgctgcccaggaagcgcaggcacaggccattttacaacaggcaaggctggctctaaggggcccacctggaccaatgggttatacaggacgtcccggacccctcggacagcccggatctcccggactgaagggagaatcaggcgatcttggacctcaggggcctcggggtcctcagggattaacaggtccccctggcaaggcgggtagacggggtcgtgctggagcggatggcgcaagaggaatgccaggtgaccccggtgttaagggggataggggcttcgatggcctccccggtctgcccggtgaaaagggccatcggggtgacactggtgctcagggtctccccggtccccctggagaagacggggagcgtggcgatgacggagagatcggcccacggggactgcctggagagtccggacccagagggctcctcggccctaaaggccctcccggtatcccgggacccccaggggtcagggggatggacggaccccagggaccaaaggggagtctaggccctcagggcgagcccggtcctccagggcaacagggaacccccggaactcaggggcttccgggacctcagggcgctatcggtccacatggcgagaaaggtccgcagggtaaacccggactacctggcatgcctggctccgatggacccccagggcaccccggtaaagagggaccccctgggacaaaggggaaccagggaccttcgggcccacaggggcctctgggctaccctggcccaagaggggtgaaaggggtcgatggcatccgcggattgaaagggcacaaaggggaaaagggagaggacggatttccaggatttaagggcgatatcggagtgaagggtgatcgtggagaagtgggcgtgcccggaagtcgcggagaagacggaccggagggtccaaaaggcagaaccgggcctaccggcgacccgggtccgcctgggctcatgggcgagaaagggaagctcggggtacctgggctgccagggtaccccggtaggcaggggccaaaaggctcacttgggtttcccggattcccaggcgcttctggagagaagggcgctcgcggacttagtggcaaatccgggcctcgcggagagagaggacccactggcccacggggacagcgtggtccacgcggagccacggggaagagcggcgctaaaggaaccagtggaggtgatggacctcacggcccacccggagaacggggtctgcccggaccccaagggccaaatggattcccagggccaaagggaccacccggacctcctggcaaagatggattaccgggacatccaggacagcgcggagaggtgggatttcagggaaaaaccggccctcccggaccgcctggagtcgtcggaccccagggagccgcaggggagaccgggcctatgggtgagcggggacaccccggtcctcctggccctcccggagaacaaggcctgcccggaactgcaggaaaggaaggcactaaaggcgatccagggccaccgggtgcccctggcaaggatggaccggcaggcttacgtggatttccaggcgagcgaggcctacccggaacagcgggtggccctggcctcaaaggcaacgagggcccttccgggccacccggtcctgccggttctcccggtgagcggggagccgcaggctctgggggacctatcggccctcctggtagaccgggacctcaagggcctccgggagccgctggtgagaaaggtgttcccggagagaaaggcccaattggaccaaccggacgagacggggtccaaggtcctgtgggcctgccaggacctgcagggccacctggtgttgccggtgaagatggggacaagggcgaagtgggagaccccggacaaaagggaaccaagggcaacaaaggcgagcacggaccaccaggccctcccggtcctataggcccagttggtcaaccaggagccgcaggggctgacggcgagcccggagccagaggccctcaaggccactttggtgcaaaaggggatgaagggactcgaggattcaacggaccccctggacccataggccttcagggactccccggaccttctggggagaagggcgaaactggagacgtgggtcccatgggccctccaggaccaccagggcctcgcggtccggcagggccaaacggggcagatggtccccagggccctccaggtggtgtgggcaacttggggcctcctggcgaaaagggcgaaccgggagagagtggctctcccggaattcagggcgagccaggggtgaaaggccctcggggagagcgcggagagaagggcgagtccggccagcccggagagccgggaccacccggtcctaaaggcccaacaggagatgacggcccaaagggcaacccaggcccagtaggctttcccggtgacccaggcccacctggtgaagggggacctaggggccaggatggcgctaaaggtgatcgtggggaagacggggagcctggacagcctggctccccaggccctacaggtgagaacggtcccccaggacccctcggtaagcgcggacctgccggatctccaggatctgagggtagacagggcggaaaaggtgcaaagggtgaccctggggcaattggtgcacccggtaagaccgggcctgtgggtccagccggtccagcaggaaagccaggtcctgatggactgcgtggcttgcccggttcggtgggacagcagggaaggcctggcgcaacaggtcaggccggacctccaggaccagtcggccctcccggattgccaggcctcagaggagacgcgggagcaaaaggcgagaaaggacatcccggtcttatcggactgattgggcctcctggggagcagggagaaaaaggggatcggggtctcccaggcccacagggctcccccggacaaaagggggaaatgggaattccaggtgcatccggcccaataggcccaggaggacccccaggattgcctggccctgccggaccaaagggtgcaaaaggagccactggcccagggggaccgaagggggaaaaaggagtgcagggccctcctggccatcctggtcctcctggcgaagttatccaacctctgcctattcagatgcctaaaaaaactcgcaggtcagtcgatggatccagacttatgcaggaggatgaggcgatcccgactggcggtgcccctggtagccccggaggtctagaagagattttcgggagcctggatagcctgagagaagaaatcgagcagatgagacgacccacgggtacgcaagattctcccgcacggacatgtcaggatctgaagctctgccatccggaacttccagatggcgagtattgggtagatcccaaccaggggtgcgctagggacgctttccgggtcttttgcaatttcactgcaggtggtgaaacttgcgtgactccaagggacgatgtcactcaattttcgtacgtggactccgaaggatcccctgtgggagtggtccagctgaccttccttcgtcttctgtccgtttccgcccatcaggacgtctcttacccatgctctggcgctgcccgtgatggaccacttcggcttcggggtgccaacgaagacgagctctcgcccgagacctccccatacgtaaaagagttccgagatggatgtcagacccagcagggtagaacggtactggaggtacgtaccccagtgctggagcagctgcccgttctggacgcaagtttcagcgatctgggggcaccacccaggcgaggaggtgtgctattggggcctgtttgcttcatgggtta

SEQ ID NO: 4765 - DNA, 5211 bp, Artificial Sequence
  Description of Artificial Sequence: Synthetic coding sequence
atggagaggtgtagtcggtgtcatcgactgctcttactgctgcctcttgtgttaggcctaagcgctgccccaggttgggctggggcacctccagtggacgtgttgagagctcttcggtttccctcacttccggatggtgtgcgcagagcaaaaggcatctgcccggctgatgttgcgtaccgcgtcgcacggccagctcaattgtccgcacccacccgccagctcttcccaggcggttttccaaaggacttctccctgctgaccgtagtgaggactaggcctggactccaagcacctctgctcaccttgtattccgctcaaggggtaagacaactcggactggagcttggcagacccgttaggttcttgtacgaggaccagaccgggagacctcagcccccttctcagcctgttttcagagggctgagcctcgcagatggtaagtggcatagagtcgcagtcgcagtgaaggggcagagtgttacattaatcgtagactgtaaaaaaagggtaactcgcccactgcctcgatctgctcggcctgtgctagacacccacggagtaataatattcggtgccaggattcttgacgaagaagtgttcgagggtgacgtccaagaactcgccattgtgccaggagtgcaagctgcttatgagagctgtgaacagaaggagctggaatgcgagggtggacagcgcgagaggcctcaaaatcagcagcctcatcgcgcacagagatcaccccaacagcagccttctcgcctgcaccggccacagaaccaggagccgcaatcacagcccactgagtccctgtactacgattataagcctccatactatgatgtgatgaccaccggaaccaccccagactaccaagaccctactcctggggaggaagaagagattctggagagctcgctgctgccgccactggaggaggaacaaaccgatctacaggtccccccaacagcagaccgttttcaggcagaggagtacggcgaaggagggaccgacccgcctgaggggccatacgactacacctacggatatggtgatgattaccgggaagagacagagctggggcctgccctctctgccgagactgctcatagcggggctgcagcacatgggcctcgcggtctaaagggggaaaagggcgagcctgcagtcctggaaccagggatgctcgtggaagggcctcccggtccagaggggcctgcgggtctgatcggccctcccggtattcagggaaatccgggtcccgtgggggacccaggggaaagagggccaccaggccgagccggtctgcctggctcagatggggctcccggaccccctggtacttctctgatgttgccatttcggtttgggtccggcggaggagataaggggccagttgtcgcagcccaagaagctcaggcccaggccattctgcagcaggcgaggctggcacttcgaggccctccgggtccaatgggctacaccggacggcctggccctcttggacagcctgggtcccctggactgaaaggagagtccggagatctaggccctcagggcccaagggggccacagggactgactggtcccccaggtaaggcgggtcgaaggggcagggcaggcgctgatggcgctaggggaatgcccggagacccaggtgtgaaaggagaccggggtttcgacggcctgcccggactccccggagaaaagggacatagaggcgatacgggggcacagggtctgccgggtccacccggtgaggatggagagcgcggtgacgatggcgagattggcccaagaggtctgccaggtgaaagcggaccccgaggcttactcggccctaagggaccgccagggatccccggacctcctggtgttagaggcatggatggacctcaaggcccaaaggggagtcttggccctcagggcgaacccggaccaccaggccagcaagggacccccggtactcaaggcttacctggaccacagggagccatcggccctcacggggagaaagggcctcagggtaagcctggcctgcccggaatgcctggttccgatggaccccctggccacccgggaaaagagggacctcctggaactaagggtaatcagggtccaagcgggcctcagggtcccctggggtatcccggtccaaggggcgtgaaaggcgtagatggcatccgtggtctgaaaggacacaaaggagagaaaggagaagacggcttccccggttttaaaggcgatatcggtgtgaagggggatcgcggagaggttggcgttcccggttcgaggggggaagacggtcctgagggtccgaagggcagaactgggccaacaggtgacccgggacccccagggcttatgggagagaaaggtaagttgggtgtgcctggcttacccggatatccgggtcggcaaggccctaaggggtcactgggattcccgggtttccctggcgcttctggcgaaaagggagcacgcggtctgagtggcaaatccggaccacggggagaacggggacctaccggtcccagggggcaaaggggtccacggggagctaccgggaaaagtggggcaaaggggacatcaggcggagacgggcctcacgggcctccgggtgaaaggggattgccaggcccacagggtcccaatgggttccccggacccaaagggcctccaggtccgcctggaaaggatgggctgccagggcacccgggacaacgcggtgaggtaggtttccagggcaaaacggggccaccaggccctcctggcgtcgtgggcccacagggagccgctggcgaaacaggccctatgggtgaacggggacaccctgggccacctggccctccaggcgagcaggggctccctggaacagccggtaaggaggggacaaagggggacccaggccctcccggagccccaggaaaagacggacccgctggtcttcgcggatttccaggggaacgaggattacccggaaccgctggtggtcctggattgaaaggtaacgaaggaccaagcggcccacccggaccagcgggaagccccggagaacggggagcggcaggcagtggcggtccaatcgggcctcccggaagacccggacctcagggacctcccggagccgctggggagaagggagtgcctggcgagaaggggcctatcggcccaacaggcagagatggtgttcagggcccagtaggtctacccggtcctgctggaccccctggggtcgcaggggaggacggtgataagggggaagtgggcgaccccggacaaaagggtaccaaggggaacaaaggagagcatgggccaccgggaccacccggaccgataggtccagtaggacaacctggcgctgctggcgctgatggagagccaggggcacgcggaccgcaggggcactttggagccaagggtgatgagggcactcggggtttcaatggaccaccagggccaataggactccaaggcctcccaggaccttctggggaaaagggcgaaaccggggacgtcggtcccatgggaccccctgggcctccgggaccacgcggtccagccggtccgaatggggcagatgggcctcaagggcctccgggtggagttggaaacctggggcctccgggagagaagggcgagcccggagagtcaggttctcccggaatacaaggtgaacctggcgtaaagggcccacggggagagcgcggtgaaaaaggggagtccggtcagcccggagagccagggcctcctggcccaaaaggacctaccggcgacgatggtcccaagggcaaccctgggccagtcggatttccgggagaccctggaccaccaggagaaggaggcccacgagggcaagatggggcaaagggagaccgaggtgaggacggagagcctggtcagcccggatcgcctggcccaactggcgagaacggaccccctgggcctcttgggaagagggggcctgctggctcccccggaagtgaaggtagacagggcggaaaaggcgcaaaaggtgaccccggagcgattggcgctccaggcaagaccggaccggtaggcccagcaggtcccgctgggaagcctggtcccgatggccttcggggtctcccagggtccgtgggacagcagggacgtcccggagcaacaggacaagccggtcctccagggcctgtcggaccccctggtctcccaggcctccgcggtgatgctggggctaagggcgaaaaagggcatcctggcctgatcggcctgataggccctccaggcgagcagggcgaaaagggggaccgcggattgcctgggcctcagggaagcccaggacagaaaggcgagatgggcataccaggagcctctgggcctatcgggccagggggacccccaggtctccccggaccggcagggcctaagggagccaaaggcgctaccgggccaggaggacctaagggagaaaagggggttcagggacccccaggccacccgggacctccaggggaggtgattcagccattgccaatccagatgcctaagaaaactagacgttctgtggacggatccaggctgatgcaggaagatgaggctattcctacaggaggcgcacctggttcccccggaggattggaggagattttcggatccctggatagcctgcgcgaagagatcgagcagatgagacgccctacaggcacacaagatagtcctgcgcgtacctgtcaagacctcaagctgtgccacccagagctgccagatggggaatattgggtagacccaaaccagggctgcgcccgtgacgcattcagggtcttctgcaatttcaccgctggcggagaaacatgcgtgacgccccgagacgatgtcacacagttttcatatgtagatagtgagggatcacccgtaggcgttgttcagttgacattcctacggctcctgagcgtctccgcccatcaagacgtctcatacccctgctctggcgctgcacgtgatgggcctctgcggctgaggggcgcaaatgaagatgaactgtctcccgagacgtctccttatgtcaaggagtttcgcgatggatgtcagactcagcaaggaagaacagtccttgaagtgcgaactccggttctcgagcaactgccagtgctggatgcctccttctctgatctgggagcgccaccccgacggggaggcgttctcctgggccctgtgtgtttcatggggtag

SEQ ID NO: 4766 - DNA, 5069 bp, Artificial Sequence
  Description of Artificial Sequence: Synthetic coding sequence
atggaaagatgtagcaggtgtcaccgtctcttgttacttctgcccctggtgctaggtctgagcgcagcgcctggctgggccggagctcctcctgtagatgtactgcgggcacttcggttcccatccctaccggacggggtgagaagggcaaaaggcatttgtcctgcagacgtcgcttaccgggtggcgagaccagctcagctctcagctcccacacgacagctatttcctgggggttttcccaaggacttcagtctcctgaccgtggtcaggacaaggcccggacttcaggccccactcctcacgctgtacagtgcacagggcgtgcggcagctgggcctagagctcgggcgtccagtgcggttcctctatgaggaccaaaccgggcgaccgcagcctccttctcagcccgttttccggggtttatctcttgctgacggaaagtggcaccgagtggccgtcgcagtgaaaggccagagcgtgacacttatcgtggattgcaaaaaaagggtgacaaggccacttccaaggagcgccagacccgtgctggatacacacggagtgattattttcggggcacgtattctagatgaagaagtcttcgagggcgatgtccaggagcttgccatcgttccaggtgttcaggccgcatacgagtcctgcgagcaaaaggaactggagtgcgagggcggacaaagggaacgcccacagaaccagcagccgcatagggctcagcggtctccccagcaacaaccatccaggctccatcgccctcagaatcaggaaccccagtcccaagaacaaaccgacctccaggtgccacctactgccgatcgctttcaggccgaggaatacggcgaggggggtacggaccccccagaaggcccttacgattacacatatgggtacggtgatgattaccgcgaggagaccgaactcggaccggctctcagcgcagaaacagcccactcaggagccgctgctcatggacccagaggacttaagggagagaaaggtgagcctgctgtgctcgaacctgggatgctcgtcgaggggccaccaggaccagaggggccagccggactgatcggaccgccaggcatccagggcaatccaggacctgtgggagatccaggagaacgcggtccaccaggcagggccggtcttcctggatctgacggggctccagggcctcccggtactagcttgatgttgccgttccgcttcgggtcaggcggaggagacaagggacccgttgtcgctgcgcaggaggctcaagcacaggctatcctgcagcaagctcggctggccctcaggggccctcctggccctatgggttataccggcaggccaggccctctagggcagcccggttcaccaggcttgaagggcgagagcggggatttggggccacagggacctcgcggaccccagggactcacgggacccccagggaaggccggacgaaggggtagagctggggctgacggggcaagaggtatgccaggcgaccctggagtgaaaggcgatcggggattcgatggattacctggactgcctggcgagaagggacatcgcggtgacaccggtgcccaggggctgcccggacccccaggtgaagacggagagcggggagacgacggagagataggccctcggggtctgcctggagagagcggccctagaggactcttggggccaaagggccctccaggaatccctggtccgcctggggtgcgaggcatggatggaccccaaggacccaaaggcagtctgggcccacaaggagagcccggacctcccggacagcagggtacacctggtacacagggcttgcctggaccccagggagccatcggccctcacggcgagaagggcccacagggaaagcctgggctccccggaatgcctggctcagacggccctccgggacatccgggtaaagaaggcccacccggtacaaaagggaaccagggaccctcaggacctcagggtccgctgggatatccaggtcctagaggcgtgaagggtgtagatgggattcggggtctgaaaggtcataagggcgagaagggtgaagacgggtttccaggctttaagggcgatattggggtgaaaggagaccgcggagaggtaggagtgccagggagtcgcggagaggatggtccggagggaccgaagggtcgaactggaccgaccggcgatcctggccctccaggccttatgggcgaaaaagggaagttaggagtccctggtctcccaggctaccccggtaggcaaggtcctaaaggtagccttggatttcccggatttcccggtgccagcggcgagaagggggcacggggtctgtccgggaagagtggcccacggggagagcgcggacccactggaccgaggggacagcggggtccaagaggcgctactggcaaatcaggagcaaaaggtacctctggcggtgacggtccacacgggcctccaggcgaacgtggtcttccaggtcctcaggggcctaatgggtttccaggccctaaggggccacctgggccaccaggcaaggacggattgcccggacatccaggccaacgcggtgaggttggattccaggggaaaaccggccctcccggaccccctggggttgtgggccctcaaggggcagcgggagaaacaggccctatgggcgaacgcggacatccaggtcctcccggtccaccaggcgaacagggcttacctggcacagccggtaaggaaggcacgaagggcgaccccggtcctccaggcgcaccaggtaaggacggaccggcaggacttagagggttccccggagagcgtggcctccctgggaccgccggaggccctggactgaaagggaacgagggtcctagtggccctcctggaccagcaggctctcctggagaacgaggcgcagcgggatccgggggacccatcggtcctccaggaagaccaggcccacaaggtccgccaggcgctgctggcgaaaaaggggtccccggagaaaaaggtccaattggtccaaccggcagagacggagtgcaggggcctgtcggtctgcccggaccggcagggcctcctggggtggctggcgaggatggggacaaaggcgaggtcggagaccctggtcagaagggaaccaaaggaaataaaggtgagcatggccctcccggaccgcctggtccgattgggccagtggggcagcccggagcggcaggagccgatggcgagcccggagctagaggtccccaagggcacttcggggctaagggagacgaaggtacacgcggttttaatgggcctcctgggccaattggacttcagggacttccaggcccttctggtgaaaagggcgaaaccggtgacgtgggccctatgggtcctccaggccctcccggtccacggggaccagcaggacccaacggagcagacgggcctcagggcccacccggaggagttggcaacctcggcccaccaggcgagaagggagaacctggagagtcaggaagccccggtattcagggagagcccggagtgaaaggcccacggggtgagcgcggtgaaaagggcgaatcaggtcagccaggggagcccggtccgccaggaccaaaggggcctaccggtgacgacggccctaagggaaacccagggccagtcgggttccctggtgatccagggccacccggagagggcggtccgcgtggtcaggacggcgcaaagggcgataggggcgaggatggcgagcccggacaacccggtagccccggtccaaccggggagaatggacccccaggcccactgggcaaaaggggcccagctggcagtcctggcagcgaaggcaggcaggggggaaagggagctaagggggatcctggtgcgattggcgctccgggaaaaactggccctgtgggtccggcagggcctgcgggtaagcctggccctgacggcctgagaggcctaccgggaagcgtggggcagcaaggaaggcctggcgcaaccggacaagctgggccacccggacccgtggggcctccaggactgcctggactgcgaggagatgcaggagcaaaaggggagaaaggccatcctggactgatcgggctgattggcccacccggtgagcagggcgaaaagggcgaccgcggacttcctggcccacagggctcaccagggcagaagggagagatggggattcctggcgcaagtggcccaatcgggcctgggggacctcctgggctacccggtccagctggacctaaaggagccaaaggtgccaccggccctggcggaccaaagggtgagaaaggggtgcagggccctcctggtcaccccggtcctcccggagaggtgatccagccccttccaatccaaatgcctaagaagacacgcagatcggttgatggctcaaggctgatgcaagaggacgaggccatcccaactggaggtgcacccggtagtccaggagggctggaagaaatcttcgggtccctggattccctccgagaggagattgaacaaatgcgacggcctacaggtacccaagacagtcccgcaagaacatgccaggacttaaagctgtgccaccctgagctgcccgatggcgaatattgggtggatcctaaccagggatgcgccagagacgcgttcagggtgttctgcaacttcacggcagggggtgagacgtgcgtcactccaagagacgacgttacgcagttcagctatgtcgacagcgagggcagccccgtgggggtcgtgcaactgacgtttttgagactcttatccgtgagcgcccatcaagatgtgagttacccgtgctctggggcagctcgagatgggccactgcggctgcgtggtgcgaacgaggatgagctgtcgcccgaaacatccccttacgtaaaggagtttcgggacgggtgccagacacagcaaggaaggacagtgctggaggtacgcacgccggtgctggagcagctgcccgtattggatgcaagtttctccgacctgggggcaccaccaaggcggggtggcgtcctcttaggcccagtgtgcttcatggggta

SEQ ID NO: 4767 - DNA, 921 bp, Artificial Sequence
  Description of Artificial Sequence: Synthetic coding sequence
atggactggcgggcttccgaggcttggatggtgccacgcgctcctaagggcgcatgggatccccgagagagccaagacctgctggataacagagctccccttggaccacgggttttccctggacccagggttcccagcgcattgatggagagacgggtgctgaaagggagccaaggttcgccagcctgccctgggcctcccggagaggtgattcaacctctccccatacaaatgccgaaaaagactagaaggtccgtggatggctctcgactcatgcaggaagacgaggccataccaacagggggagccccagggagtccgggtggcctcgaagagatcttcggaagccttgattcactccgggaggagatcgagcaaatgcgcagacccactggtactcaagactcgcccgctagaacatgccaggaccttaagctctgccacccagaattacccgatggcgaatactgggtggaccccaatcaggggtgcgcaagagacgcattccgtgtgttctgcaatttcactgccggaggagaaacttgcgtgacgcctcgggacgacgttacacaattctcttatgtggacagcgagggctcccctgtgggcgtggtgcagctgactttcctgagacttctgagcgtcagcgcgcaccaggacgtaagttatccttgctcgggtgccgctagagacggcccactgcggctcagaggggctaacgaggacgagctgagccctgaaacaagtccttacgttaaggagttccgggatggctgccagacccagcagggtcgtacagtgctggaagtccgaacacctgtcctggagcagctgcccgtgctcgatgcaagcttttccgacctcggagctccccctcgtagaggcggagtgcttctggggcctgtttgcttcatgggctag

SEQ ID NO: 4768 - DNA, 5132 bp, Artificial Sequence
  Description of Artificial Sequence: Synthetic coding sequence
atggagcgctgtagcagatgtcacaggctcttactgttacttcctttggtcctcggtctgtccgcagcgcctgggtgggctggcgctccccctgttgacgtgctgagggcgctccgcttcccatctctgcctgatggggtcagacgcgcaaaagggatctgcccagccgatgtggcgtatcgagtcgcgagacccgcacagctgagtgcccctacccgacaactgttcccagggggatttccaaaggatttctctctgcttactgtcgtaagaacaagacccggtctacaggcccctctcctgaccctgtacagcgcccagggagtgcgccagttgggactggagcttggcaggcccgtaagattcttgtacgaggaccagacaggccgtccgcaaccgcctagccagccagtgttcaggggcctgagtctagccgacggtaaatggcaccgagtggccgtggctgtcaagggacaatctgtgaccctcatagtcgactgcaaaaagcgcgtaactagaccccttccaaggtccgcacgcccagtcttagacacgcatggggtgatcatctttggggctcgtatcttggatgaggaggtttttgaaggagacgtgcaggaattggcaattgtcccaggagttcaagccgcatatgaatcctgcgaacagaaagaactcgagtgcgagggcggacagcgtgaacggcctcagaaccaacaaccccaccgcgcacagaggtctcctcagcagcagccatcgcgcttacatagacctcagaaccaggaacctcaatcccaggaccctactccaggggaggaagaagagatcctggaatccagtctgctccctccgctggaagaagaacagaccgacctgcaagtgccccctaccgctgataggtttcaagccgaagaatacggggaaggaggaaccgaccctcccgagggaccctacgattacacctacggctacggagacgattacagggaggaaactgagttgggcccagccttgtctgccgagacggcccactcaggtgctgctgctcatgggcctaggggcttgaagggggagaaaggcgagcccgctgtgctcgaaccaggcatgctggtagagggccctcctggaccagagggtccggctggtctcattgggccacctggtatccagggcaacccagggccagtgggggaccccggagaacggggacctcctggcagggctggactgccaggatcagacggtgctcctggaccaccaggtactagcctcatgctgccgttccgcttcggaagcggaggcggagataagggcccagtggttgccgctcaagaggcccaggcacaggccatcctgcagcaagccagattggcactgcggggaccacccggtcccatgggctacacaggccgaccgggacccctcggccagcccggatcgcctggactgaagggagaaagtggagatctgggtccccaggggccaagagggccacaaggtttaacaggcccaccagggaaagcaggaaggcggggtagagctggggctgacggggctcgaggaatgccaggggaccccggtgtgaagggggatagaggcttcgatgggcttcccggattgcctggggagaagggacaccggggagacacgggggctcaaggcctgcctggccctcctggcgaagacggggaacgaggcgatgacggcgagattggcccacgcggactcccaggggaatcagggccacggggactcctgggccctaaaggaccacctggcattccgggacccccaggagtgaggggcatggacggaccccagggccctaagggctctctgggtccgcaaggggagccaggccctcctggccagcaggggacccctggtacgcaggggctgcccggaccccagggggctattggccctcacggcgagaagggccctcaaggcaaaccgggactacctggtatgcctgggtctgacgggcctccaggacatccgggaaaggaagggccaccaggcacaaaaggaaatcagggaccttcgggtccccaaggtccgcttggataccctggaccaaggggagtgaagggggttgacggcattagggggttgaaggggcacaagggcgaaaaaggggaggatggattccccggttttaaaggcgatattggagtcaagggtgaccgcggagaggtcggcgtcccgggatctaggggggaggacggcccagagggtcccaaagggagaactggccctacaggcgatccgggacccccaggattgatgggagagaaaggaaaactcggcgtacctgggctacctgggtacccagggcgacaggggccaaagggatctcttgggtttccaggatttcccggagcatctggcgagaagggggcaagggggcttagcggaaaaagcggcccacgcggagagcggggtcccacaggacccagaggacaaaggggcccaaggggagccaccggcaaatcaggagcaaagggaactagcggcggagatggtccccatggaccccctggagaacggggtctaccaggtcctcagggccctaacggctttcctggccctaagggccctctgggcccacccggtaaagacgggctgcccggacacccgggacagcgaggtgaagtcggcttccaggggaagaccggccctcctggcccaccaggcgtggtaggccctcagggggctgcgggtgagaccggtcctatgggggagcggggacaccctggcccacccggtccccctggcgaacaaggcttacctggtactgccggtaaggaaggaaccaaaggtgaccctggaccccctggggcacccggtaaggacgggccagcagggctgcgaggattcccaggcgagaggggtctgccaggtactgctggaggaccaggccttaagggtaacgagggcccttcaggacctcctgggcctgcaggaagcccaggtgaaaggggtgccgcaggcagcggcggacctatcggaccccctggccgtccaggaccgcaaggcccaccgggtgcagccggtgaaaagggggtcccaggtgaaaaaggacctataggtcccacagggagggatggggttcaaggacccgtcggtctgcccggacccgctggccctcctggggtcgctggggaagacggggacaaaggggaggtcggggacccaggccagaaaggcacaaagggtaataagggggagcatggcccaccagggcctcccggacctatcgggcctgtgggccagcccggagccgctggagccgacggagagcctggtgctcgtggacctcaaggccattttggcgcaaagggggacgagggaacccggggttttaatggacctcctggcccaattgggcttcaaggcctgccaggcccatcaggcgagaagggggagacgggcgatgtgggtcctatgggcccacctggccctcccggtccccgtggaccagcaggaccaaacggagccgacggtccccaaggaccacccggaggagttgggaaccttggccctccaggggagaagggcgagcctggagaatcagggtcccccggaatccaaggcgagcctggcgtgaaggggcctcgaggggagagaggggaaaagggggaatcaggccagcctggtgaaccgggaccgcctggccctaaaggacctaccggagacgacggccctaaagggaacccgggtccggtgggattccctggcgacccagggccaccaggagaggggggtcctagaggtcaagatggagctaagggcgatagaggcgaggacggcgaacctggccagccaggaagtcccggacccaccggcgagaatggcccacctggacctctggggaaaagaggtccagctggatcccctggcagcgaggggcgacagggaggtaagggcgctaaaggggaccctggagcaattggtgccccaggcaagaccggcccagtaggcccagctgggccagcgggaaagccaggccctgatgggcttcgcggtctaccaggaagcgtggggcagcagggacgccctggagctacaggtcaggcaggtcccccagggccagtgggccctccgggactgcccggacttcggggagacgccggagctaaaggtgagaaggggcaccctggcctgattgggctcattggcccacctggtgaacaaggagagaagggagaccggggtctcccgggacctcagggctccccaggccagaaaggcgagatgggcatcccaggtgccagcgggccaataggccctggaggccctcctggactgcccggacctgccggacctaagggtgcaaaaggtgcgaccggccctgggggtccaaagggcgagaaaggagtccaggggcctccgggtcaccctggtcctcctggcgaggtgattcagccgctgcctattcagatgcctaagaagaccagacggtcagtcgatggtagcagattaatgcaggaggatgaggctatacccacgggaggcgcacccggaagtcctggaggactagaagagattttcggtagcctcgactccctgagggaagaaatcgaacagatgaggcgcccaacggggacgcaggactcacctgcacgaacttgccaggacttaaagctttgtcatccagagctgccagatggagagtactgggtggatccgaatcaagggtgtgctcgcgacgctttcagggtgttctgtaatttcacggcagggggtgaaacttgtgtaaccccgagagatgatgtaacccaattttcttacgtggattcggagggcagcccggtgggcgtggtccaacttacttttctcaggctgctgtcagtgtcagctcaccaagatgttagctatccctgttccggcgctgcaagggatggccctctgcgattgaggggagccaatgaagacgagctctcacctgaaacaagtccttatgtcaaagagtttagggacggctgccagacccaacaggggagaaccgtcctggaggtgcgtacacctgtcttggagcagctcccggtgctggatgctagcttcagcgatctgggggcaccccctcgtcgcggtggtgtcctcctgggcccagtgtgtttcatgggata

SEQ ID NO: 4769 - DNA, 5070 bp, Artificial Sequence
  Description of Artificial Sequence: Synthetic coding sequence
atggagagatgctcacgctgtcatagactgctgttgctgttacctctagtgctgggactgagcgcagccccaggttgggctggtgctcccccagtggatgtgctgcgtgcacttcggttcccctcacttccagacggggtgagacgagcaaagggtatatgtcccgctgacgttgcctacagggtggctagacctgcccaattatctgctcctacccgccagttgtttcccggtggctttcccaaggatttcagtctcctgactgtggttcgtacacgccctgggctccaggcccctctgcttacgctgtacagcgcacaaggagtgagacagctcggcttggagctgggaaggcctgtccggtttctgtacgaggaccagacaggcaggcctcagccgccatcacagcctgtattccgcggactgagcctggcggacggcaagtggcatagggttgctgtcgcagtgaaagggcagtcagttaccctgatcgttgattgcaagaaaagggttacacgaccgttacctagatccgctagacctgttctggacacacacggcgtgataatatttggcgcacggattctcgacgaggaggttttcgagggggatgtgcaggagttggccattgtgcctggagtgcaggccgcatacgagtcatgcgaacaaaaagaactggagtgcgaaggcggacagcgagagagaccccagaatcagcagccccatagggcgcaaaggtccccacaacagcagccaagtcgactgcatcgtccccagaatcaagaacctcagtcccaggagcaaactgacctgcaggtccctcccaccgccgacaggtttcaggctgaggagtatggtgagggtggtacagacccccctgaggggccatatgactacacttatgggtacggagatgattatagggaagagaccgagctgggacccgcactgtcggctgaaactgcacattccggggctgctgcccatgggccacggggtctcaagggcgaaaaaggcgagcccgcagtactcgagccaggaatgctggtcgaagggcctcctggcccagagggccctgcaggactgattggccctccaggaatccagggcaaccccggtcccgtcggcgaccccggagaaagaggaccccctggacgggctggcttgcctggctcagacggtgctcctgggccaccagggacatctctgatgttacccttcaggtttggatccgggggaggcgacaaaggtcccgtggtggccgctcaagaagcccaagcccaggccattctccagcaggcgagacttgctctccgcggtcctccaggccctatgggttacaccgggaggcccggtcccctcggacagcctgggagcccgggtctaaagggagagagcggcgatctcggaccacagggtcctagaggccctcaaggcttgacaggacctccgggaaaggctgggcgaagaggacgcgcaggagcagatggcgctcggggaatgcctggagatccaggggtcaaaggcgataggggattcgatggtctcccaggattaccaggagagaagggacacagaggcgacaccggcgcacagggcctgccagggccacctggagaagacggcgagaggggagacgacggcgagataggcccacgaggcctgccgggtgaatcagggccaagaggactgctgggtcccaagggcccaccgggaataccaggacctcccggtgtaagagggatggacgggcctcagggaccgaagggatctctcggccctcagggagaacctgggccaccaggtcagcaaggtactcccggaacccagggtctgcccggtcctcagggcgctattggcccacatggcgaaaaaggacctcagggcaaaccgggactccctgggatgcctggttctgacggcccacctggccaccccggtaaggaaggcccaccaggcacaaagggtaaccaaggcccatctggtcctcaggggcctctggggtatccaggccctaggggagtgaagggggttgatggtataagaggtctgaagggccacaagggggaaaaaggggaggatggatttcctggttttaagggcgacatcggtgtcaaaggggacagaggagaagtgggtgtgccagggtcccgaggcgaggatggacccgaggggccaaagggacggacagggcctacaggagaccctggaccaccaggcctgatgggggaaaagggtaaactaggcgtgccgggtctgcccggatatcccggtcggcagggacctaagggcagtctcggattccctggcttcccaggagcctccggagagaaaggggcaaggggactgagcggcaaatccggtccacggggagaacgcggacccaccgggccacgaggccaaaggggccctagaggcgctacgggcaagagtggcgcaaagggaaccagcggcggtgacgggcctcacggacctccaggtgaaagaggtctgcctggaccccagggacctaacggctttccaggccctaaagggccaccaggccctccaggcaaagatggcttacccggacaccccggacagagaggcgaagtcgggttccagggaaaaacgggacctcctggacctcccggtgtggttggcccacagggcgctgccggtgagactggacccatgggtgagcggggacaccctggaccaccgggtcccccaggagaacaggggctgcccggaacggcaggaaaggagggaaccaagggagacccaggtccccctggagcccctggcaaggacggccctgcaggcctgcggggatttcctggcgagagaggactgcccggaactgcagggggacccggattaaaaggcaatgagggcccttccggccctcccggacctgccggatcacctggggagagaggcgcagccggaagcggaggaccaatcggtcccccaggccgaccagggcctcagggtccacctggagccgcaggcgaaaagggtgtcccgggtgaaaaaggcccaatcggacctaccggacgggatggagtccagggtccagtagggctccctggtcctgctgggcctcccggagtggctggcgaggatggtgacaaaggggaggtcggcgaccccggacagaaggggacaaagggcaataagggggagcacggacccccagggcctccgggacctatcggccctgtcggacagcctggagccgctggggcagacggcgagccgggagcacggggtccccagggtcattttggggctaagggtgacgagggtacccgcggattcaacggccctcccggacctataggcttgcagggccttcctgggccaagcggcgaaaaaggtgaaacaggcgacgtcggtcccatgggccctccaggcccaccaggacctcggggtcccgctggaccaaacggcgcagacggtcctcagggaccacccggaggcgttggcaacctgggcccacctggcgagaaaggtgagccaggggagtcaggcagtcccggaattcagggcgaacctggcgtcaagggtcccagaggggagcgcggtgagaaaggggaatctgggcagccgggagaacctgggccacctgggcctaagggtcccacgggggacgatggcccaaagggaaacccaggacccgttggctttcccggagatccaggccctcctggagagggaggacccagaggccaggatggagccaagggagacaggggtgaagatggagaaccaggtcaacctggatcccccggtcctactggtgagaacggccctcccggaccgttaggcaagagagggccagccggatccccgggatcagaaggcaggcagggtgggaaaggagcaaaaggcgacccaggggctataggagcgccagggaagacgggcccagtggggcctgccggacccgctggcaagccaggcccagatggtcttcggggactacctgggagtgtaggacagcagggcagacctggcgcaacgggccaggctgggccacccggaccggtaggaccgcctggcctcccaggtctgaggggtgacgcgggagccaaaggtgaaaagggccaccctggactgatcggtctaattgggccaccgggagagcagggcgagaagggcgacaggggcctgcccggtccccagggatcccctggccaaaagggcgagatgggtattcccggtgctagtgggcctattggacccggaggcccacctggactgcccggtcccgcagggcctaagggagccaaaggagccacaggtcccggtgggcctaagggcgagaagggggtgcaggggcctccaggacaccctggaccacctggagaagtgatccagcccctgccaatccaaatgccaaagaagactcggagaagtgtagatggcagcagactgatgcaggaagacgaagccatccctacaggcggagccccaggtagccctggcggattggaagaaatattcgggagcctggacagcctgcgtgaagaaatcgagcagatgcggcgaccaacaggtacacaggactcgccagcaaggacgtgccaggaccttaaactgtgccatccagaactccctgacggcgagtactgggtggaccccaatcaggggtgtgccagagatgcctttcgggtgttctgtaattttaccgccggaggtgagacctgtgttacccccagggacgatgtcacgcagttctcctacgtggactctgaagggagccccgtgggggttgtgcagcttacatttttaagactgctgtccgtgtccgcacatcaggacgtctcgtacccatgctccggggcagccagggatgggcctctacgcctcaggggagcgaacgaagacgagctgagtccagagacttcaccatacgttaaggaattccgagatgggtgtcaaacacagcagggcagaaccgttttggaggttcggacaccagtcctggagcaactacctgtgctcgatgccagcttcagcgatctgggggcaccacctcgcaggggtggcgtcctactcggaccggtgtgtttcatgggctaa

SEQ ID NO: 4770 - DNA, 4890 bp, Artificial Sequence
  Description of Artificial Sequence: Synthetic coding sequence
atggaaagatgcagtaggtgccaccgcttactactcctcttgcccctcgtgctgggactgagtgcggctcccggatgggccggagctcctcctgtagacgtgcttcgagctctccggtttccatccctcccggacggagtaaggcgcgcaaaggggatttgtcccgctgacgtggcctatcgggtggccaggccggctcagctgtccgcgccaacgaggcagcttttccccggtggcttccccaaagacttctccttgctcactgtggttcgtacccgcccaggactgcaggcgcctctcttgaccttatattcagctcaaggggtccgccagctgggactggagctgggacggccagttcgcttcctctacgaagatcaaaccggacgccctcagcccccaagccagcccgtgtttcgcggtctgtcattagctgacggtaagtggcacagggtcgctgtggccgtgaaaggccagtctgtaactctcattgttgattgcaaaaaaagggtgactcggccacttccgaggtctgcccgacctgtcctggacacccatggcgtgatcatttttggcgctcgaatccttgacgaagaggtcttcgagggagacgtgcaagaactcgccattgtgcctggcgttcaggccgcatacgaatcctgcgaacagaaggagctagaatgcgagggcggacagagggagcgccctcagaatcaacagccccatagggcacaacgctccccccagcagcaaccttcaagactccatagaccccaaaatcaagaacctcagtctcaagctgcccacggaccaagaggtctcaagggggagaagggagaacctgccgtgctggagcctggtatgctggtggagggccctcctgggcctgagggcccagcaggcttgatcggacccccaggcatccaagggaatccaggccctgtgggggaccctggtgaacgaggacctccgggacgggcaggtctcccaggtagcgatggcgctcctgggccacccggtaccagcctcatgcttccctttcgcttcggaagcggcggaggcgacaaaggtccagtcgttgcagcccaagaggcacaggctcaggctattctgcagcaggctagactggcgttgagaggccctccagggcctatgggctacacgggacgccctggccctctcgggcagcccggatctccgggattgaaaggcgaatctggggatctgggaccacagggacccagaggccctcaggggctcactggaccgccaggaaaagcgggaaggagaggtagagccggagcagacggggcaagaggaatgcctggcgatccaggcgtgaaaggcgacaggggattcgatggcttgccagggcttccaggcgaaaaaggacaccggggagatacaggggctcagggcttacctggacctcctggagaggacggagagcgcggagacgatggcgagatagggccaaggggcttgcccggtgagagcggccctcggggactgctggggcctaagggtccacccggaatccccggaccccctggtgttcgcggaatggacggcccacagggacctaaaggatccttaggccctcagggggaacctgggcctccaggccaacaaggcaccccaggcactcagggcctccccggtccacagggcgcaatcgggccacatggggagaaggggccacagggcaagcccggtctgcccggaatgcctggctctgacggtccccctggccatccgggaaaggagggcccacccggaaccaagggcaaccaaggacccagcggtccacagggaccccttggctaccctggcccacggggtgtgaagggggttgatgggatcagaggccttaaaggtcacaagggtgaaaagggggaggatggattcccagggttcaaaggcgatataggggtcaagggagataggggcgaggtcggagtcccagggtcgagaggcgaggacggaccggaagggccaaaggggaggactggacccaccggtgatccaggcccacctgggcttatgggggaaaaaggtaaactcggtgtgccaggactgcctggctatcccggaagacagggtccgaagggcagtttgggtttcccaggctttccaggagcctcaggggaaaagggtgcgaggggactgtctgggaaaagcgggcctcgcggagagcggggacccacaggaccaagggggcagagaggcccaagaggcgcaacaggaaagtccggtgccaagggtacttcaggaggtgatggacctcatggccctccaggcgaacggggacttccgggtccacaggggccaaacggatttcccggtccaaagggaccaccaggcccacccggaaaggatggactgcccggtcaccccggacagaggggcgaggtggggttccagggcaagacaggcccaccgggtcccccaggtgttgtgggtcctcaaggcgcagcaggggaaactggaccgatgggcgaacgaggccatccgggaccacccggaccgccaggggaacaagggctacccggaaccgcgggaaaagaagggaccaaaggcgaccccggtcctccaggtgcccctggaaaagacggtcccgcaggcctgagaggatttcccggagaaaggggtctaccaggcactgcaggaggtccaggtctcaaggggaatgagggaccgagcggaccgcctgggccagcgggatctccaggcgagagaggtgccgcagggtccgggggacctatcggcccacccggtcgccctggaccacaaggacctcctggcgctgccggtgaaaagggggttcctggagagaaaggccctattggcccaactgggcgtgacggggttcaggggccagttggactccccggtccagccggaccacctggtgtggctggggaagatggggataagggcgaagtgggcgaccctggtcagaaaggcactaagggcaacaagggggaacacggacccccagggcctcccggacctatcggcccagttggacagccgggagcggctggggctgatggagaacccggagctcggggacctcaggggcacttcggcgcaaaaggtgatgagggcactagggggttcaatggacctcccggtccaattggtttgcagggactgcctgggccaagtggcgaaaagggggagaccggcgacgtaggacctatggggcctcctggaccgcctggcccacggggtcctgctggccctaacggagctgatggccctcaaggcccaccaggaggggttgggaatctgggacctccaggagaaaaaggagagcctggggaatctggtagccccggaattcagggagagcccggtgttaaaggccctcggggtgagagaggcgagaaaggtgagtctggccagcctggagaacccggacctccgggaccaaagggcccaactggggatgatggcccaaaggggaatcccggtcccgtaggctttcctggtgaccctggaccaccaggggaaggcggtccaaggggtcaagatggagccaagggagaccgcggagaggatggcgaaccgggacagcccggttctccgggaccaaccggggaaaacggacctcccggtcctttagggaagcgaggcccagcaggatcaccaggctcggaaggcaggcaaggcggaaagggagctaagggtgatcctggagcgatcggcgctccaggcaagacaggacccgtgggcccagctggaccagcagggaagccaggccctgatgggctgcgaggccttccagggtcagtcggacagcagggcaggcctggagctacaggacaagcagggccaccagggcctgtggggcctcctggcctccctggtttgagaggcgacgccggtgctaaaggtgagaaaggccacccaggtcttatcggtttgatcggcccaccaggcgagcagggggagaagggtgacaggggcttgcccggaccacagggaagtcccggtcagaaaggtgaaatgggaattcctggagcgtctggccctattggacctggaggtccacccggtttaccagggccagcgggacccaaaggcgcaaaaggagcgacagggccaggcggacccaagggagagaaaggcgtgcaggggccaccaggtcaccccggtcccccaggcgaggttattcagcccctgcctatccaaatgcctaaaaagacgcgcagaagtgtggacgggtctcggcttatgcaggaggacgaggcaatccctacagggggagctccgggttccccaggcggacttgaagagattttcgggagtctggacagcttgcgggaggagatcgaacagatgcgaaggcccaccgggactcaggattcgcccgctcggacttgccaagacctgaagctgtgccaccctgagctgcctgatggggagtattgggtggatcctaaccagggttgcgccagggatgctttcagagtgttttgcaacttcaccgctggcggtgagacctgtgtgacccccagagacgatgttacacaattttcttacgttgacagtgagggctcacctgtcggggtcgttcagctcacgtttctaagacttctttccgtgagcgctcaccaagatgtcagctacccttgttctggagccgcacgagacggcccactcagattaaggggcgctaacgaagacgagctgtctcccgaaacatctccctacgttaaagaatttcgtgatggctgtcagacgcaacaagggcgtaccgtcttagaggtccggactcccgtactcgaacaattgcccgtgttggatgcatcatttagcgaccttggggcaccaccaagacggggaggagtactgctggggcctgtgtgtttcatggggtag

SEQ ID NO: 4771 - DNA, 921 bp, Artificial Sequence
  Description of Artificial Sequence: Synthetic coding sequence
atggattggcgagcgtcagaggcctggatggtcccccgagctcccaaaggtgcctgggaccctagggaatcgcaggacctgttggataacagggctccacttggccctcgagtttttcctggtccccgtgttccttccgccttgatggaaagacgggtgctaaaaggatcgcaagggagcccggcttgcccagggccacctggagaagtaatccagccccttccaatccaaatgcctaagaaaacccgtcggagtgtcgatggcagtaggcttatgcaagaggacgaagccatccctacagggggagccccaggctcgccaggtggcctggaggaaatctttgggagtcttgactcactccgtgaggagatcgaacaaatgcgcagaccaaccggcacacaggactcgcccgcacgtacttgccaggacttgaagctgtgtcaccccgaactcccagacggtgaatattgggtagatcccaatcaaggatgtgccagagacgcattccgcgtgttctgcaactttactgctggtggcgagacatgcgtgaccccacgcgatgacgttacccagttcagctatgttgactccgaagggagccctgtcggtgtggtgcagctcacatttctgcggttgttgagtgttagcgcccaccaggatgttagctatccttgctctggcgctgcacgcgatggacctctccgtctcaggggcgcaaacgaagatgagctgtcgcccgagacatccccctatgtgaaagaattccgtgatggctgccagacacaacaggggagaactgtgttagaggtccgtaccccagtgctggagcagctacctgttttggatgctagcttctcagacctgggcgcacctcctaggagaggtggtgtcctcctggggcctgtgtgcttcatgggatag

SEQ ID NO: 4772 - DNA, 4968 bp, Artificial Sequence
  Description of Artificial Sequence: Synthetic coding sequence
atggaaaggtgttctaggtgtcataggctactgttactgctccccctagtgctaggtctatctgcggctccgggatgggctggcgctccccctgtggatgtgttgcgggcattgcggtttccttctctgccagatggcgtgcgcagggccaagggtatctgccctgctgacgtggcctaccgcgttgcaagaccggctcagttgagcgcccctacacgacagttgttcccaggaggattccctaaggatttctcattgctcacggtggtgaggaccagacctgggctgcaggctccactgctgactctgtattcagcgcaaggggtgcgacagctggggctcgaactggggccaccagtgaggtttctttacgaagaccagactggcaggccgcagcccccaagccaaccagtattccgcggactctctcttgccgatggtaagtggcacagagttgctgtggcggtaaagggtcaatcggtcactctcatcgtagattgtaaaaagagagtcactcgtcctttgccccgatctgctaggcccgtgttggacacccatggagtaatcatcttcggagctcgcattctagacgaggaggtttttgagggagacgtccaagagctggcaatcgtacctggagtgcaggctgcatatgaatcatgcgagcagaaggagctggagtgtgaaggaggccagcgcgagcggcctcagaaccaacagccgcatagggcgcaacgaagcccccagcagcaacccagccgcctgcacaggcctcaaaatcaggaaccacagagccagcccaccgagtccttgtattacgactacaaaccaccctactacgatgtaatgactactggaacaactcctgactatcaggccgctcatgggcctcgtggcctgaagggggagaaaggggaaccagcagtgctggaacccggtatgctggtggagggtcctcctggcccagaaggacccgcaggactcattggacctccgggaatccagggaaaccctggcccagtgggagacccaggagagcggggacctccgggacgcgctggtctgcctggatccgatggagctcctggaccacctgggacttcactcatgttgccatttcgattcggcagcggagggggagataagggcccagtggtggccgctcaggaagcgcaggcacaggcaatcttgcagcaggctcggctggcgctcaggggacccccaggcccaatgggatacactggcaggccagggccattgggccagccgggatctcccggattgaaaggtgagagcggagatctggggcctcagggccctagaggcccacaaggcctaactgggcctcctgggaaagccggaagacggggtagagctggcgcagatggcgctagaggcatgccaggtgacccgggtgtgaagggcgaccggggtttcgacggcctaccaggacttcctggtgaaaaggggcacagaggcgatactggtgcccagggactgcccggacctcccggagaagatggtgaaagaggagatgatggagagatcgggccacggggtctcccaggtgagtctggccctcgaggcctcttaggccctaagggtcccccaggcattcccggaccaccaggggtgcgagggatggacgggccacagggtcccaagggttccctaggccctcagggcgaacccggtccacctggccaacaaggcactcccggtactcagggacttcctggacctcaaggcgcaatcggaccacacggtgagaaaggaccccagggaaagccaggactacctggtatgccaggatcagatggaccccctggccaccctgggaaagagggtccacctgggacgaaaggcaatcaaggtccttcaggcccacagggccctctggggtatcccggacccaggggagtgaaaggagtcgatggcatccgcggactgaaaggacataaaggggagaagggtgaggatggcttcccagggttcaagggcgatattggagtgaagggagacaggggagaggtcggtgtaccaggcagtaggggagaggacggtcccgaagggcctaaggggagaacgggacctacaggggaccccggaccgccagggttgatgggagaaaaaggaaaactcggcgtgcccggtcttcctggctatccaggtaggcagggtcctaagggttccctcggtttcccaggctttcctggtgcaagtggggaaaaaggagccagagggttatccgggaaaagtggccctaggggggagagaggacctaccggccctcgaggtcagaggggacctagaggggctacggggaagtccggggctaaaggtaccagtgggggtgacggaccccacggaccccctggagagcggggattgccagggcctcagggcccaaacggcttcccgggaccaaaggggcctcccggaccccctggcaaagatggcctccccggacacccaggccaacggggagaagtcggtttccagggcaaaacaggccctcccggaccgcctggcgttgtgggaccgcaaggcgcagccggagaaactggacctatgggcgaacggggtcaccctggaccgcctggccctccaggcgagcagggtttgcccggaacagccggaaaagagggaacaaaaggggaccctggacctccgggagctcccggtaaggacggacccgctggtctgcgcggtttccctggagagcgaggcttacccggtacagccggagggcctggccttaaaggtaatgagggtccatcagggcctcctggcccagccggtagtccgggagaaagaggcgctgccggtagcggaggtcccatcggaccaccaggccgaccgggtccccaaggaccaccaggtgccgcaggggagaagggcgtgcccggtgagaagggaccgatcggaccgactggccgagatggtgtgcagggtcccgtaggcttacctggtccagctggcccacctggtgtagcgggtgaggacggggataagggcgaggtcggagatcccggacaaaaaggtactaaaggtaacaagggagaacatgggccacctggaccgccaggccctataggaccagtgggtcagccgggagctgcaggggctgacggcgagcctggggctcggggaccccaagggcactttggcgcaaaaggggatgaaggtacccggggttttaatggaccccctggtcccattggtctgcagggcctgccaggcccttcgggtgagaaaggtgagaccggcgatgtggggcctatgggccctccaggaccgcctggcccaaggggtcccgctggaccaaatggggctgacggcccacagggtccacccggaggcgtaggaaacctgggaccccctggagaaaagggggaaccaggcgagtccggctctccaggcatacagggcgaaccgggagtgaagggacccaggggcgaacggggagagaagggagaatccggccagccaggagaaccaggtccacctggtcccaagggacccaccggagacgacggtcctaagggtaacccaggcccagtggggtttccaggcgatccagggcctcccggagaagggggacctcgcggtcaggacggggctaagggagaccggggagaggacggagagccaggccaacctggctcacccggtccgacgggagagaacggacctcctggtccattgggaaaacggggaccagctggaagccccggatcagaaggcaggcagggcggaaagggcgctaagggagatcccggtgctatcggcgctccgggtaaaacgggccctgtgggaccagcaggcccagctgggaagccgggacctgacggacttcgaggtcttccgggaagtgttggccagcaagggaggcccggagccactgggcaagccggtcctcccggacctgtggggccacctggcctgcccggactaaggggtgatgcgggtgctaagggcgagaaaggccacccagggctgataggcctcattggaccacccggagagcagggcgagaaaggtgaccgcggtctgcccggaccccagggctctcccggacaaaaaggggaaatgggcattccaggcgcttccgggcctatcggtccgggtggacctcccggacttccaggccctgctggtcctaaaggtgctaagggagcgactggtcctggtgggccaaagggggaaaagggcgtacagggtcctcccggacaccccggaccccctggagaggtgatacagcccctgcctatacagatgccgaaaaagacacgacgaagcgtcgacgggtcccgactgatgcaggaggatgaggctattccaactggtggagcccctggcagtcctggcggactggaagaaatctttggcagtctggattctcttcgggaggagattgaacagatgcggaggcctaccgggacgcaagattctccggctaggacgtgtcaggacttaaaactgtgtcatccggaattgcctgacggcgagtattgggtggatccaaaccaaggctgcgctcgcgacgccttcagagtcttttgcaactttacagcagggggtgaaacatgcgtgacacccagagacgatgtgactcagttcagttacgtcgatagcgagggctccccagtgggtgtagtgcaactcacgttcctgaggctgctgagtgtatccgcccaccaggacgtgtcctatccttgctccggcgcagccagggacgggccactgagactgaggggggctaatgaagacgaactgagcccagagacttcaccttatgtgaaagagtttcgcgatggctgccagacgcagcaagggaggactgtcctggaggtgcgcacacctgtccttgaacaactgcctgtattagacgcctctttcagcgacctcggggctccccctaggagaggaggggtgctgctcggcccagtctgcttcatggggtag

SEQ ID NO: 4773 - DNA, 5210 bp, Artificial Sequence
  Description of Artificial Sequence: Synthetic coding sequence
atggagaggtgttcccgatgtcaccggctgcttcttctgctcccgctagtgttggggttgtccgccgcacccggatgggctggtgccccaccagtggacgtattgagggccttgagattcccaagccttccagatggcgtccggagggctaaaggcatctgtcctgccgacgtggcttaccgggttgcgaggccggcacagctcagtgcacccacgcggcagctgttcccgggaggattcccgaaagacttttctctcctcactgtggtgagaacgagaccaggactgcaggcccctttgttgaccctctactcagcacagggtgttagacagctgggcttggagctggggcctcccgtgaggtttctgtacgaggaccaaaccgggaggccacagccaccgtctcagccggtgttcaggggcttgagcctggccgacggcaaatggcacagggttgcagttgctgttaaagggcaatctgtgaccctcattgttgactgcaagaagagggttactaggcctcttcctagatccgccagacccgtgctggacactcacggggttatcatttttggcgcacgaattctggatgaagaagtgttcgagggtgacgtccaagaattggctatcgtcccaggagtgcaagcagcttatgagtcctgtgaacaaaaggaactagagtgtgaagggggacagcgagaacggccacaaaaccagcaacctcatcgtgcccagagaagcccccaacagcagccgagccgactgcacagacctcagaaccaggagccacagtcccagcccacagagtccctttattacgattataaacccccttattatgacgtaatgactacaggcacaaccccggactatcaggatccaacccccggtgaagaagaggagattttggaatcaagtttgctgccacccctcgaggaggagcagacagacttacaagtcccaccaactgcggaccgatttcaggcggaagaatacggcgagggcggaactgatccgccagagggcccttacgactatacttatggatacggagatgactaccgggaagagaccgagctgggacccgctctatctgctgaaaccgcccattccggagccgctgcccatggcccaaggggactgaaaggtgagaagggcgaacctgcggttctcgaacctgggatgcttgtggagggtccacccggaccagagggccctgcagggctcattgggcctcctggaatccagggaaatcctggcccagtcggggaccccggtgaacgcggtccccctggcagggcaggtctgccaggttccgatggagcacccggacccccagggacatccctgatgttgccctttagatttggcagtggcggaggcgacaagggcccagtggtcgccgctcaggaagcccaggctcaagcaattctccagcaggcacggctcgccctgcggggtcctccagggcctatgggctacacggggaggcccggacccctgggccagcctggctcacccggactgaagggggaatctggagacctgggcccacaaggtccacgtggaccacaaggtttgaccggcccacccggaaaggcaggcagacggggaagggccggtgccgacggtgccagaggtatgccgggagacccaggcgtgaaaggagatcgcggtttcgatggcctcccagggttaccaggcgaaaagggccatagaggcgatacaggagctcagggcctacccggtcctcccggagaagacggcgagcgtggcgacgatggtgaaataggacctcgaggattgcctggggagtcaggcccacgtggcctgctgggacctaagggcccaccgggaatcccaggccctcccggagtgaggggaatggacggccctcaggggcctaagggctcattagggcctcagggagaacctgggcctcccggacagcagggaactccaggcactcaaggtttgcccggaccacagggggctatcggcccacatggcgaaaagggtccccagggcaagccaggccttccagggatgcccggatccgacggtcccccaggtcaccccggaaaggaaggacctcctggaacaaaaggaaatcagggtccatcaggaccccagggacccttgggctacccagggcctaggggggtcaaaggggttgatggaattagaggactcaaaggccacaaaggcgagaaaggcgaagacgggttcccgggatttaagggcgacattggagtcaaaggcgacagaggcgaggtcggggtccctgggtcgaggggggaagacggacctgagggccctaaaggccgaaccggcccaaccggagatcccggaccacctgggttaatgggtgagaagggaaaactgggggtacccggtcttcctgggtacccagggcgtcaggggcctaaggggtccctgggatttcctggatttcccggagcatccggggaaaaaggggcaagaggtctcagtgggaagtctggaccccgaggagagcgcggaccgaccggccctcgcggacaacgcggaccacggggagctactggcaaatctggggcaaaagggacaagtggcggagatggaccacacggcccaccaggcgagcggggacttcccggaccacagggcccaaacggctttcccggacctaaaggtcccccagggcctcctggaaaggacggcctcccgggacacccaggccagcggggtgaggtcgggttccagggtaagaccgggcctccaggcccaccaggagtggtcggaccccagggcgcagcgggagaaaccggacccatgggggagagaggccatcctggccctcctggccctccaggtgagcaagggctgcccggaaccgccggaaaggagggcaccaaaggtgatccaggaccgccaggcgcacctggcaaagatgggccagcaggactgcgcggtttccctggggaaaggggcctaccaggcacagcaggcggacctgggctgaagggcaatgaaggaccttctggaccccctgggccagcgggatcacccggagagcgcggagcggctggaagtgggggtccaattgggccacctggaagaccaggaccccagggaccgccaggagccgcaggagagaagggtgtaccgggagagaagggtccaatcggcccaactgggagggatggtgtgcagggacccgtaggtcttccgggacccgctggccctcctggggtggctggcgaggacggggacaagggggaagttggagaccctggccagaagggaacaaaaggcaataagggagagcacggtccccctggtccccctgggcctataggtcccgtcggccagccaggcgcagccggtgctgatggagaaccaggagctagaggcccacagggacactttggagctaagggcgatgaagggacccgcggatttaacgggcctccaggcccaatagggctgcaaggtctacctggaccctctggagagaaaggtgagaccggagatgtgggcccaatgggcccaccaggacccccaggccctaggggacccgcaggcccaaatggcgcagatggccctcaaggccctccaggtggggttggtaatctggggcctccgggagagaagggggaacccggagagagtgggtcccccggtattcagggcgagcccggtgttaaagggccacgcggagaaaggggggagaagggcgagtctggacagccgggagagccgggaccaccaggccctaagggaccgaccggggacgatggaccaaaagggaacccgggtccagtggggttcccaggcgacccgggaccacccggagaaggcggtcccagaggtcaagacggagccaaaggagaccggggtgaggatggagagcccggacagcctggctccccgggtccaacgggtgaaaacggcccacctggccctcttggaaaaagaggcccagccggatcccccggtagcgagggtaggcagggcggaaaaggggcaaagggtgaccccggtgctattggcgctcccggaaaaacaggccctgtgggaccggctgggccagcagggaagccagggcctgatggactgcgaggcttgccaggtagcgtgggacagcaggggcgaccaggggcaactggtcaggccggtccccctggacccgtaggccctcccggactgcctggcctacggggagacgctggagcgaaaggtgaaaagggccaccccggactgataggactaatagggcctcctggtgaacagggcgaaaagggggatcgcggactgccaggcccacagggcagtccaggacagaagggcgaaatgggcattcctggtgctagtggccctatcggacctgggggtcctccaggtcttcctggacccgcaggcccaaagggagcaaaaggagcaacaggcccaggcggaccaaaaggtgagaagggcgtgcaaggcccacccggacaccctggcccacccggtgaggtgatacagcctcttccaatccagatgccgaaaaagactcgtaggtcagtggatgggagccgactgatgcaggaagatgaggcaatacccaccgggggagccccaggatcacctgggggacttgaggaaatttttggttcactggatagcctgcgagaggagatcgaacagatgagaagacccactggaacacaggatagccctgccaggacatgccaggacctgaaattatgtcacccagagttgcccgatggcgaatattgggtggaccctaaccaaggatgcgcaagagatgcgttccgagtgttttgtaactttacagcgggtggcgagacgtgcgtgaccccgagagacgatgtcacacagttcagctacgttgatagcgagggttctcctgtgggcgtggttcagctcaccttcctgagacttttgtcagtgtctgctcaccaggacgtgtcatatccctgttcaggtgctgctcgcgacggtcccttgcgtctgaggggcgctaatgaggatgaactttcgccagaaaccagtccatacgttaaagagttcagggacgggtgtcaaacccagcaggggaggactgtgctggaggtaaggactcctgttctggagcagctgcctgtgctggatgcaagcttttccgacctcggcgctccaccccgtaggggaggagtgcttctcggtccagtgtgtttcatgggtta

SEQ ID NO: 4774 - DNA, 5147 bp, Artificial Sequence
  Description of Artificial Sequence: Synthetic coding sequence
atggagcggtgctctcgatgtcataggctcctactgctgcttcccctggtcttaggcctgtctgcagcccctggttgggccggagcccctcctgttgacgtactgagagctctgcgcttccctagtcttcccgacggggtgcggcgagccaagggcatctgtccagctgatgtggcctatagggtcgccagaccggctcagcttagtgccccaactcgacagctctttcctgggggattccctaaggatttctcattgctgacagtggtgcggaccaggcccggtctgcaggcacccctgctcacgctatattcagctcaaggagtgcggcagctcgggctcgagctcggacgcccagtgcgctttttatatgaggaccagacaggaaggccccaaccaccatcacagccggtttttcggggattaagcctggctgatggaaagtggcaccgcgttgcagtcgcagttaaaggccaaagcgtgactctcattgtggactgcaagaagcgagtaactcgccctctccctagaagcgctcggcctgtgcttgatacccacggagtcattattttcggagcaagaattctggatgaggaagttttcgaaggggatgtccaggagctagcaattgtccccggagtacaggccgcatatgaatcttgtgagcagaaagagctcgagtgtgaaggaggccagcgggagcgtccacagaaccagcagccccaccgagcccagcgcagcccacaacagcagccaagcaggctccatcgtccccaaaatcaggaaccacaatctcagcccacggaatccctgtactacgattacgagcccccttactatgacgtgatgacaactggcacgacccccgactaccaggaacagactgatctacaggtcccgccaactgccgaccggtttcaggccgaggaatacggcgagggtgggaccgacccacccgagggtccttacgactacacctatggctacggagatgattaccgagaggaaaccgagctggggccagccctgtcagccgagactgcccattccggagcggctgcccatggtccgagggggcttaaaggagagaagggggaacccgcagttttggagcctggaatgctggtcgagggtcctcctgggccagaaggcccagccggactaatcggccctcccggaatccagggcaaccccggtcccgtcggcgatccgggagagagagggccacctggtcgggctggtctcccaggaagtgacggggcaccaggtccacccggaacttctctgatgctgccctttcgcttcggttccgggggaggtgataaaggtcccgttgtcgctgcacaagaagctcaagcccaggcgatattacagcaagcgagactagccctgcgcggtccacccggtccaatgggttatactggcagacctgggcctctggggcagcctggatcaccgggactgaagggagagagtggggacctcggtcctcaggggccacgtggcccacaggggctcactggtccacctggcaaagctggtcggaggggcagagccggagccgatggggctcgtggtatgcctggtgatcctggagtgaaaggagataggggtttcgatggattgccaggattacccggtgaaaaaggccaccggggtgacaccggcgcacaagggctccccggacctccaggagaagacggcgaacgtggggatgacggtgaaataggccctcgcggactgcctggcgagtcagggcctagggggctgctggggcctaagggcccaccaggaatacctggacctcccggtgttcgaggcatggatgggcctcaaggaccaaaggggtccctgggaccacaaggagaacctggcccaccaggccagcagggcactcctggcacccaaggcctgccgggaccccagggcgcaatcggccctcacggtgaaaaaggaccccaagggaaacccggactgccaggaatgcccggatccgatggcccacccggacaccccggtaaggaggggccacctggcaccaaaggcaaccagggtccctctggccctcagggcccattaggctacccgggacctaggggtgtgaagggagttgatgggattcgaggcctcaagggacacaaaggcgagaaaggcgaagatggttttcccggattcaaaggcgacatcggcgttaaaggcgatcgaggcgaagtgggtgttcccggaagtcgtggggaggatggtcccgagggacctaaaggcaggactggtccaaccggtgaccctggtcctcctgggttgatgggtgaaaaggggaaactaggcgtgccgggtttgcctgggtatcccggaagacagggaccaaaaggctctttaggcttcccaggcttcccaggcgcaagcggtgaaaaaggcgctcggggattgtcgggtaagtccgggcctcggggtgagaggggaccgactggacctcgtggccagcgaggccctagaggggcaaccggcaaatcgggagcaaagggaacaagcgggggagatggcccacacggccctcccggagagcggggacttccagggcctcagggccctaacggctttcccggtcctaaagggccaccgggaccacctggaaaggatgggttgcccggacaccccggacagaggggtgaagtcggatttcagggaaagaccggccctcctggcccacccggagtggtcggaccccaaggcgctgctggcgagaccggacccatgggcgaacgcggacacccagggccacccggaccccctggagagcaagggctgcccggaacagctggcaaggagggtaccaagggcgaccctggccctccgggagccccaggaaaagatggcccagctggtctcaggggcttcccaggagagagaggcctgcccggtactgcaggcggtcccggactcaagggcaacgagggcccttctgggccaccaggacccgctggtagtcctggcgaaaggggcgcagcgggaagcggtgggccaattggtccgccagggaggcctggtcctcaaggccctccaggggcagctggagaaaaaggggtgcctggcgagaagggcccaatcggccctactggacgggacggcgtgcaggggcctgtagggctgcccggtccagccggaccgccaggtgtggctggcgaagatggagataaaggcgaggtgggtgaccccggacaaaaaggaaccaaagggaacaagggggagcacggtcccccagggccacctggccctattggtccagtcggacaacccggagccgctggcgcagacggcgagcctggtgccagggggcctcaagggcacttcggggctaagggggacgaaggaacaaggggatttaacggaccccctggcccaattggccttcaggggctgcctggccctagtggggagaagggcgagacgggagatgtgggcccaatgggcccacccggtcccccaggtccacggggaccagctggcccaaatggagctgatggaccacagggaccaccagggggtgttggaaacctgggccctcccggagaaaagggagaacctggagaaagtggctcccctgggatccaaggagagcctggcgttaagggcccacgcggagagcgtggagagaaaggcgagtctggccagcctggcgagccaggacccccaggacctaaaggaccaacgggggacgacggccctaaaggaaatccaggccctgttggatttccaggggaccctggccctcctggagaggggggacctcgtggtcaggatggcgctaagggcgatcggggtgaggatggtgagcctgggcagcccggaagtccaggtccgactggtgaaaatggccctcccggaccccttggaaaacgagggcctgccggtagcccaggctccgagggcaggcaaggcggaaagggtgccaagggagatccaggcgctattggggctcctggcaaaaccgggcctgtgggtcccgcagggccagcaggaaagcctgggcctgatggcctcagggggctacccggttcagtgggacagcagggacgcccaggcgctacagggcaggctggaccccctggtcccgtcgggccacccggtctgcctggcttacgcggagacgctggggctaaaggagagaaaggacatcccggtctgatcggactcatcggacccccaggcgagcagggcgagaaaggcgatagaggattacctgggcctcagggaagccccggtcaaaaaggcgagatggggatccctggcgcttctggccctatcgggcctgggggtccacccggactgcccggacctgccggtccaaaaggggctaagggggctaccggacctggcggaccgaaaggagaaaaaggggtacagggtcctcctggccatcctggcccaccaggagaagtgatccagcctctgccaatccagatgcctaaaaagacccgccgtagtgttgacggaagtcggttaatgcaagaggatgaagccatcccaaccggcggagcaccgggaagtcctggcggattagaagagatattcggaagcctggattcgctccgtgaggagattgagcagatgcgtcgccctacaggcactcaggacagcccagccagaacttgccaggaccttaaactatgccacccagagcttcccgatggtgaatattgggtggatcccaaccagggctgcgctcgcgacgcttttcgggtgttctgcaatttcacagcagggggtgaaacatgtgtgacccctcgggacgacgtgacacagttttcttatgttgattccgaaggcagcccggtgggtgtggtgcagttgacattccttcgccttcttagtgtgtccgcacaccaggacgtcagctacccatgttccggggctgccagagatggacccctgaggttgagaggggctaatgaagacgaattaagtcccgagacgtctccgtacgtcaaagaatttcgagatggttgccagacccagcagggcagaaccgtgctggaagtgagaaccccggtgcttgaacaattacccgtgcttgacgcatcttttagcgatctgggagctccgccacggagggggggagtgctcttggggcctgtatgttttatgggata

SEQ ID NO: 4775 - DNA, 4890 bp, Artificial Sequence
  Description of Artificial Sequence: Synthetic coding sequence
atggagaggtgttcccggtgtcaccgattgcttttactgctgccgctggtgcttggcctctcggccgcacctggatgggccggagcaccacctgtggatgttctgagggctcttcgcttccccagcctgcccgacggggtgcggagggccaagggcatttgccctgcagatgttgcctatcgcgtggctaggcctgcacagctctccgcacctacgcggcaactctttcccggaggcttccccaaggacttctcacttctgaccgttgtgagaacgagaccgggactacaggctccacttcttacactgtattccgctcagggggtccggcagttgggcctcgaactcggcagaccagttcggttcttgtacgaagaccagaccggacggcctcagccaccttcacagcccgtgtttagaggactttctttggcggatggaaagtggcaccgggtcgctgttgcagttaaggggcagtccgtgacattgattgtggattgcaagaaaagagtgacccgcccattgccgagatctgcccgtcctgtgctcgatactcatggtgtgatcatctttggtgcccgtattctggacgaggaagtgttcgaaggcgacgtgcaagagttggctattgtgcctggggttcaagcagcctacgagtcttgtgaacagaaggaattagagtgtgaggggggacaaagagagcgccctcagaaccagcagccccaccgtgcccaacgttctccccaacagcagccgtctcgccttcataggcctcagaatcaagaaccgcaaagccaggcggcacatggaccacgcggtctgaaaggggaaaagggagaacctgccgtgctggagccgggtatgcttgttgaggggcctccaggtcctgagggaccggcagggcttatcgggccacccggaatacaaggaaacccgggtccagtcggggatcccggtgaaagaggtcctcccggacgcgcaggcctccccggaagcgacggggctcccggaccccctgggacatcgctcatgctcccctttaggtttggctccggcggaggagataaaggacctgtagtagctgcccaggaagcccaggcacaagcgatcctgcagcaggcaagactggccctgcgtgggcctcctgggcctatggggtacactggcaggcctggtcccctaggccagcccggaagccctgggctgaagggggagagcggggatctgggcccacaagggcctagggggcctcagggtcttactggccctcccggaaaagccggtcgtcggggacgggctggagccgacggtgccagaggcatgcctggagaccctggagttaagggagaccggggattcgatgggcttcctgggctgcccggtgagaagggccatagaggagataccggcgcacaggggctcccaggacccccaggagaggacggagaacgcggagacgacggagagattggccctagagggctgcctggggagtcgggcccacgcggtttactgggaccgaaagggccacccggaatccccggaccccctggcgtgagaggcatggacggtccccaggggcctaagggatctctcggaccccagggagagccgggaccacccggacagcaggggacacccggtactcaagggctgccagggccacagggcgctattggccctcatggggaaaaaggacctcaggggaagcctgggctaccaggcatgccgggaagcgacggccctcccggtcatccgggaaaagaaggcccaccaggcacgaaagggaaccaggggccttccgggcctcagggcccattgggctacccaggaccccgtggggtcaaaggcgtggacgggattagaggcttaaaaggccataagggtgaaaagggcgaagatgggtttcccggattcaagggagacataggggttaagggagaccggggtgaggtcggggtccccggaagtcgcggagaggatgggccagaaggccctaagggaagaaccggcccaaccggcgatccaggccctcctggcttgatgggagagaagggcaagttaggcgttccgggactgccaggctacccgggtcgccaggggccaaaaggttccctggggttccctggtttccccggagctagcggcgaaaagggcgctagggggttatcaggaaaaagcggacctcgcggtgagaggggaccaacgggcccacggggtcagagaggccctcgcggagcgaccggcaagtctggcgctaaaggaacctccggaggcgatgggcctcacggacctcctggggagcggggactgcctggaccacaggggccaaatggcttccccggaccaaaggggccattgggccctcccggaaaggacggactgcctggtcaccctgggcaacgaggtgaagtcggattccagggaaagacgggccctccaggccctccaggcgtagtggggccacagggagcagccggagagactgggccaatgggcgaacggggacaccccggtccacctggtccgccaggggagcagggcttgcccggaactgcgggaaaagaggggacaaaaggtgaccctggccctcctggagctcccggtaaagacggacctgccggtctgcgcggtttccctggggagagggggttgccaggaactgccggaggcccaggcttaaaggggaatgaaggcccatccgggcctccaggccctgccggatcccctggagagaggggagccgcagggtcaggaggacccattggcccacccggacggccagggccacaggggcctccaggggcagcgggtgagaagggagtccccggagaaaaagggcctatcggaccaaccggtcgcgacggtgtccaaggaccagtgggccttcctggcccagctggaccacccggagtggccggagaggacggcgataaaggagaggttggcgacccagggcagaaaggcacgaaagggaacaagggcgagcatggccctccaggacccccaggacctatcggacccgttggacaacccggagctgctggagctgatggtgagcccggagccagagggccacaaggccatttcggagcgaagggcgacgaggggactcgcggattcaacggccctcctggcccaattggcctccaggggctccccggaccgtccggtgagaagggcgaaaccggggacgtggggcctatgggcccaccgggtcccccaggaccacggggtccagctggcccaaatggggctgatggacctcaggggcctcctggcggagttggaaatttaggtccaccaggcgaaaaaggggagcccggagaaagtgggtctcctggcattcagggcgaaccaggcgtaaagggcccaagaggcgagcgaggggaaaaaggagaatccgggcaacctggtgaaccaggtcctcctggccctaaaggacctactggtgatgacgggcctaagggtaatcccggtcctgtcgggttccccggtgacccaggacccccaggcgagggagggcctagggggcaggatggcgcaaagggggatcgaggagaagatggcgagcccggtcagcccggaagccctggtcccacaggagaaaatggcccaccaggaccgctcggcaagcgtgggccagccggatcaccagggagcgaaggtagacaaggaggaaagggagcgaaaggtgacccaggcgcaataggagcaccaggaaaaacgggaccggtaggccctgcgggacccgcaggtaaacctggccctgatggtctgagggggctccccggatcagtcggacagcaggggcgacctggcgctaccggccaggctggaccccctggcccagttgggcctcctggcctcccaggactaagaggagacgctggggctaagggcgagaagggccacccaggacttattggactcatcggacctccgggtgaacagggggagaagggcgataggggcttgccaggccctcagggaagcccgggacaaaaaggagagatggggattccaggcgcttcaggcccaattggtcccggagggcctccagggcttcctggcccagccggtccaaagggggctaaaggagccaccggacccggaggccctaagggcgagaaaggagtccagggccctccgggacatcccggtcccccaggtgaggtcattcagcccctccccatccagatgcccaagaaaactcgccgttccgtcgacggatctcgactaatgcaggaggatgaggcgattccaacaggtggcgctccaggatcaccagggggattagaggaaatctttggctctctggacagcctgagagaagaaatcgaacagatgaggaggcccaccggcacgcaggatagccctgctaggacatgtcaggatctcaaactgtgtcatccggagctgccggacggcgagtactgggtcgaccctaatcaggggtgtgctcgcgatgctttccgagtgttctgcaacttcaccgctgggggagagacctgtgttacccccagagatgacgtgactcaatttagctacgttgatagtgaggggtctccagttggagtggtgcagttaacctttctgcgcctcctgtctgtcagtgcccatcaggatgtgtcctacccttgttccggtgcagctagggatggacctctgagactgcggggtgcaaacgaagacgagctcagccctgaaactagcccctatgtgaaggagtttcgagatggttgccagactcagcagggcaggactgtgcttgaagtgaggacccccgtgttggaacaactgccagttctagatgcaagtttttcggatcttggagctccaccccgtagaggaggggtgctgctgggccctgtatgttttatggggtag

SEQ ID NO: 4776 - DNA, 921 bp, Artificial Sequence
  Description of Artificial Sequence: Synthetic coding sequence
atggattggcgggcatccgaagcctggatggttcccagagcgccaaaaggagcatgggacccacgtgagtctcaagacctgttggataacagggctccgttggggccacgagtgttcccaggccctagagtgccttctgcactgatggaaaggcgagtactgaaaggatcacaggggtctcccgcttgtccgggacctcctggggaagttatccagccgcttccgattcagatgcctaagaagacacggcgatctgtcgacggatctaggctgatgcaggaagacgaagctatccccactggcggagctcctggatcgccagggggtcttgaggagatttttggatccctggactccttgcgtgaagagatcgagcagatgcggaggcccacaggcacccaggatagtccagccagaacgtgtcaggacctgaagctctgccacccggagctaccggacggggagtattgggttgaccccaatcaggggtgtgcgagggatgctttccgcgtgttttgtaattttaccgcaggaggtgagacctgcgtaacacctagggacgacgttacacagttctcttatgtagactccgaagggtcacctgtaggggtggtccaactgacattcttgagactcttgagcgttagcgctcatcaggatgtaagctatccgtgctccggagctgccagagacggtcccctgagactgcggggagccaacgaagatgaactgtctcccgagacctctccttatgtgaaggagtttcgcgatggatgccagacgcagcagggcagaactgttcttgaagtgcgcactcccgttttagagcaactacctgtgttagacgccagctttagcgatctcggggcacctcccagacgtggcggagtccttctgggacccgtatgtttcatgggatag

SEQ ID NO: 4777 - DNA, 4968 bp, Artificial Sequence
  Description of Artificial Sequence: Synthetic coding sequence
atggagcgctgttcccgctgccatcgactgcttcttctcttacctttagtcctggggctgtctgccgcacctggatgggccggagctccaccagtagacgtgctgcgcgcactgcgcttccccagcctgcctgacggggtgcgcagggccaagggaatatgcccagctgatgttgcctatcgcgttgctcgccctgcccaactctccgctccgactcggcaattgttcccaggaggtttcccaaaggattttagtcttttgacagtggtgagaaccagacccggtttgcaggctcccctactgacactttactctgcccagggggtaaggcagttgggcctcgaactggggcgaccagtcaggttcctgtatgaagaccagacaggtcggcctcagcctcccagccagcctgtgtttcggggattatctctggcagatggaaagtggcatcgggtcgccgtcgctgtgaagggtcaatcagtgacactcatcgtggattgcaagaagagggtgacaagacctcttcctagatctgccaggcccgtcctggacactcatggtgtaatcatctttggcgctcgcatactcgatgaagaagtgttcgaaggcgacgtccaggagctggccatcgtgccgggtgtgcaggcagcgtatgagtcgtgcgaacagaaggagttggagtgcgagggagggcagagagagcggcctcaaaaccagcagccccacagagcacagcgttctccacagcagcagccatcgagactgcatcgccctcagaaccaggaaccccagagccagcccactgagtcactgtactatgactacgaacctccatattacgacgtgatgacaaccggaactactcccgattatcaagcagcccacggccctagaggattgaagggcgaaaagggggagcccgctgtgcttgaacccggaatgctcgtcgagggcccacctgggcctgaaggccctgcgggacttatcggcccacctggtatccaggggaatcccggacccgtgggcgacccaggcgaaagagggcctccaggtagagccggtcttccgggttccgacggagcacccggaccaccgggtaccagcctcatgcttcctttccggtttggatccggcggtggtgataaagggcctgtggtcgcagcccaagaggcacaggcgcaagctatcctccagcaagctaggcttgctctaagaggccctcccggacctatgggctacactggtagaccagggcctctgggccagcctggctccccgggtcttaagggagaaagcggagacctgggtccacaggggccacggggaccccagggcctgacaggacccccaggcaaggcgggtagacgcggacgagctggcgcagacggcgctaggggaatgccaggagaccctggtgtgaagggcgacaggggtttcgatggtctgccgggactgccaggagagaaaggtcacagaggtgatacaggggcacaggggctgcccggtcctcccggagaggacggcgagcggggtgatgacggcgagatagggccacgaggacttccaggcgaaagcggacctagaggactgttgggacccaagggaccgcctggcatacctggccctccaggggtgagggggatggatgggccacaaggcccaaagggatccctggggccacaaggcgagcccggaccccctggccagcaggggacgcccggtacccaaggactccccggtccccagggtgccatcggaccccacggggagaagggaccccaagggaaaccaggactgcccggaatgccaggctctgacgggcctccaggccatccagggaaggagggaccgccaggaactaagggaaatcaggggcctagcggcccacagggtcctcttggatatcctgggccacggggtgtgaaaggggtcgacgggattcgtgggctgaaagggcataaaggagagaaaggcgaggacggatttcctggatttaagggcgacattggtgtgaaaggggatagaggggaggtcggagtgcctggctcgcggggagaagacggaccggagggccctaaaggtcgaacaggacctactggggatccgggaccacctggcctgatgggggagaagggaaagctgggcgttcctggccttcccggttaccccggtaggcagggaccaaagggtagcctgggttttccaggtttccctggggctagcggtgaaaagggtgctaggggcctgtctggcaagagcggtccgaggggagagagaggcccaactgggcctcgcggacagcgcggaccgagaggcgctacaggtaagtctggcgctaagggaacttccggtggcgacggtccacatggccctccaggtgagagaggcctgcccggaccacagggccctaacgggttcccgggtcctaaaggacccccaggacctcccggaaaggatggccttcccggacatcccggacagagaggagaagtaggctttcaggggaaaacaggaccaccaggccctccaggagtagttgggcctcagggtgccgcaggcgaaaccggaccgatgggagagaggggccaccccggtccgcctggacccccaggagagcagggcctgcctggcacggcgggaaaagagggtaccaaaggcgatccaggccctcccggtgcacctggaaaagacgggccagcagggctccggggattccctggggagcgtgggctcccaggcaccgcagggggaccgggacttaagggcaacgagggcccttccggaccccctggccctgcagggagccccggagaacgtggagctgcaggctccggcggtcctattgggccacccggtagacctggccctcagggccctccaggggctgctggtgagaaaggcgtcccaggtgagaagggtcctatcggaccgacaggacgggacggcgtccaggggccagtgggcctacccggacccgcaggtcctccgggagtggccggtgaagacggcgataaaggcgaagtgggtgacccgggtcagaagggtaccaagggcaacaaaggagaacacggcccacctggccctccaggccctattggccctgttggacagccaggggctgcaggggctgacggtgagcccggagccagaggccctcagggacactttggtgcaaagggcgacgaaggtacacgcggtttcaatggaccaccaggcccaatcggcttgcaaggattaccgggaccatccggtgaaaaaggggaaacaggagatgtggggccaatgggaccaccgggacctccgggacctcgaggtcccgctggtcccaacggagccgacgggccacaggggcctcccggtggggtcggcaatttggggcctcccggagagaaaggcgagcctggcgagtccggatcaccgggtattcagggagagcctggcgtaaagggccctaggggagagcggggagagaaaggcgagtcaggccagcccggtgaacccggacctcctggccctaaaggacccacaggagacgacgggccaaaaggcaaccctggccctgtgggattccccggagatccaggccctcccggtgagggcggtccacggggtcaggatggtgcaaaaggtgacagaggcgaggatggtgagcccggacagcccggtagtccaggccctacgggagaaaatgggccacctggacctctggggaaacgcggacctgccggttcccctggctctgagggcagacagggcggaaaaggtgccaaaggtgaccccggagcgataggggcaccaggtaaaaccggtcccgtaggccctgccggacccgcaggcaaacctgggccagacggactgcgcggtcttccaggttccgtcggacagcagggtcgacctggcgcaactggacaggccggtcccccaggcccagtgggaccccctgggctacccggtctcaggggcgatgcgggtgccaaaggggagaaaggtcatccagggctgatagggttgatcggacctcctggtgaacagggtgagaaaggggacaggggcctaccgggtccacagggtagtcccggtcagaaaggggagatggggatcccgggagcgtccgggcctattgggccaggaggaccaccgggtctgcccggtccagccggacccaagggagcaaaaggagctaccgggcctgggggtccaaaaggggagaaaggcgtgcagggacccccaggtcatcctggtccacccggtgaagttattcaacctctgcccattcagatgccgaagaaaacccgccgaagcgtcgatggttcacgactgatgcaagaggatgaagccattccaacagggggtgcccctgggagccctgggggtcttgaagagatctttggcagccttgactcactccgcgaagaaatcgagcaaatgcgaagacctactgggacacaagactccccagcgaggacatgccaggacctcaaattatgccatccggagctcccagatggagagtactgggtggatcctaatcaaggatgcgcaagggatgctttcagagttttttgcaacttcactgctgggggagagacctgcgtgactcctagagatgatgtcacccagttctcctatgtggatagtgagggttcacccgtcggagtggtacagttgacattcctgcgactattgagtgtgtcagcacaccaggatgtcagttacccatgttctggagccgctagagatgggcctctaaggctgagaggcgctaatgaagatgaattgagtccggaaacctccccatacgtgaaagaattcagagatgggtgtcagacgcaacagggacgcacagtactggaagtgaggacgcccgtattagagcagctgcccgtgttggacgcgtccttctccgatctcggagccccaccaaggaggggcggtgtgctactcggtcctgtgtgctttatgggatag

SEQ ID NO: 4778 - DNA, 921 bp, Artificial Sequence
  Description of Artificial Sequence: Synthetic coding sequence
atggattggcgagcaagcgaggcctggatggtgcctcgagccccaaagggtgcgtgggatcccagagagtcccaggacctgctggataatagggcgccattaggcccacgggtgtttccagggcctagagtacccagcgccctgatggagcgcagggtgcttaagggatcgcaggggtccccagcttgccccggaccacccggagaagtgattcagccactacctatccagatgccgaagaagactcgtcggagcgtcgacggttccaggcttatgcaggaggatgaggcgatccccacgggcggagctccaggcagtcctggagggctagaagagatcttcggatctcttgactctttgcgggaggaaattgaacaaatgcgccgacccactgggacacaagacagtcctgcacgaacctgccaggatctcaagctgtgtcacccagagctgccagatggagagtattgggtcgaccctaaccagggatgtgcaagagacgcctttagagtgttttgcaacttcacggccggaggtgagacctgcgttactccaagagacgacgttactcagtttagttacgtggattctgagggctctccagtgggagtggtgcagttgacctttctaaggctgctgtccgtgtctgctcatcaagacgtaagctacccatgttccggagcagcaagggacggtccgctgcgattacgaggggcaaacgaggacgagttaagtcccgagacttcaccctacgtgaaggaattccgggatggctgccaaacacagcaaggccgaacggtgttagaggtgcggacaccggtcctggagcagctacctgttctagacgcgagcttctctgacctgggtgctcccccaagacggggaggagtgctgctcggccctgtctgcttcatgggatag

SEQ ID NO: 4779 - DNA, 5210 bp, Artificial Sequence
  Description of Artificial Sequence: Synthetic coding sequence
atggagcggtgctcaaggtgtcatcgcctgctcctgctgctacctctggtcttaggactgagcgctgctcccggttgggctggcgctcccccagtcgacgttctcagagctctcaggttcccttccctgcctgacggcgtgagacgggctaaggggatctgtcccgctgacgtcgcgtaccgcgtcgcaaggcccgctcaactgtcagcccctaccaggcagctgtttccgggagggtttccaaaggacttcagtctcctaaccgtggtacggactcgccctgggctccaggccccactgctgacactatactctgctcaaggtgtccgccagctcggcctggagctagggcgacctgtacggttcctttatgaggatcagaccggcaggcctcagccgccatcccagcccgtgttccgtgggctctccctggcggatgggaagtggcaccgcgtggccgtggctgtaaaagggcagtctgtgactttaatagtggactgcaaaaagagagtgacaaggccattacccaggtctgcacgccctgtgcttgatacccacggagtcataattttcggcgcacgcatcctggatgaagaagtttttgagggtgacgtgcaggaactggctatcgtgccaggagtgcaggccgcttatgaatcctgtgaacagaaggagctcgagtgcgaaggaggacagagagagcgccctcagaaccagcagcctcaccgcgctcagcgctcaccacagcagcagccgagccgcctacaccgcccacagaaccaggagccacagtcacagcccaccgaatctttatactatgattacgaacccccttactatgatgtcatgacaacagggaccacgcccgactatcaggatccaacccccggtgaggaggaggagattctggaatcatctttattgccacctctcgaggaagaacagacagacctccaggtgccccctacggcggacagatttcaggccgaggaatacggggaaggcggaaccgatcctcccgagggcccttatgactatacctatggctacggagatgattacagggaggagactgagctgggacccgctctctccgctgaaaccgctcattcgggagccgctgctcacggaccacgaggattaaaaggtgaaaagggagagccagccgtgttagagcctgggatgctggtggaaggccctccaggcccagaggggccagccggactgatcggaccacctggcattcaaggaaaccccggacccgtgggggaccctggcgagagagggccacccggtcgcgctggtctgcctggctccgacggtgcccctggaccacctggcacctccctgatgctcccttttcgctttgggagcggtgggggtgacaaaggccctgttgtggctgcccaggaggcgcaggcacaagcgatcctgcagcaagctagactcgctcttagagggcctcctgggccaatggggtacaccgggagacccggaccgctcggacagcctggttcacctggactgaaaggcgaatctggagatcttggtccacaaggcccaagaggccctcagggcttgacgggcccaccaggcaaagccggaaggaggggccgtgcgggagccgatggcgcaaggggcatgcccggtgaccctggggtcaagggtgatagaggcttcgacgggctgcctgggctgcctggtgaaaagggccatagaggtgacaccggggctcagggcctgccgggacctccaggcgaagatggcgagcgcggagatgatggggagattggccctcgaggcctgcctggcgagtccgggccacggggactgctgggccctaaggggcctcccggaattccaggcccacctggtgtaagaggaatggacggcccacagggcccaaaaggatcactcggaccccagggcgagcctggcccaccagggcagcaggggactcctggaactcaggggcttcccggtcctcagggtgctatcggtccccatggcgagaagggaccacagggtaagcccggtctgccaggtatgccaggcagcgacggaccgcctgggcatccagggaaggaaggccctcccggtaccaaaggtaatcaggggccaagcggtccacagggtcctctcgggtatcccggacccagaggggtgaagggggtagatgggatccgaggtctcaaaggccacaagggggagaaaggcgaggatggctttccagggtttaagggcgatattggtgtgaagggtgaccgaggggaagtgggcgtgccaggtagcaggggtgaagatgggccagagggacctaagggtcgtacgggaccaaccggggaccccggaccgcctggcctcatgggggagaaagggaaactgggtgtgcccggtctgccgggttacccgggacgccagggccctaaagggagcctgggcttcccaggcttccccggagccagtggagagaagggcgctcggggtttgagcggaaagagcggaccacgcggtgaacgcggacccactgggcctagaggtcagcgcggtccacggggagctactgggaagagtggtgctaaaggtacctcaggaggcgatggtcctcacgggccacctggggagcggggactgccaggaccccagggtccaaatgggttccccggacccaagggcccacccggaccccctggcaaagatggcttaccagggcatccgggtcagcgtggagaggtagggtttcaagggaagacgggccctcccggacctcctggcgtcgttgggcctcagggtgctgccggagaaacaggacccatgggagaaaggggccacccagggccaccgggtcccccaggcgagcagggcctccctggaacggctggtaaggaggggactaaaggtgacccgggtccccctggggctccgggaaaagacggaccagctggtttgcgtgggtttcctggggaacggggactgcctggcactgcaggaggtcccggtctcaaaggaaatgaggggccttctggtccgccaggacctgcaggttcccctggagagcggggtgctgcagggagtggcggaccaatcggtccccctggcaggcctggccctcaggggcctcctggtgccgctggcgagaaaggggtaccaggagagaagggacccataggtcccaccgggcgagatggtgtgcagggccctgtgggtttgccaggccctgctggaccaccaggcgtcgccggagaggacggcgataagggggaagtgggggatccagggcagaaagggactaaaggtaataagggtgagcatggcccacctgggccaccaggccctatcgggccagttggacaacccggagctgccggagcagatggggagccaggtgcaagaggccctcagggccacttcggcgcaaaaggggacgagggaacgcgtggatttaatggtcccccaggcccaatcggacttcagggactgcctggcccttccggagagaagggcgaaaccggagacgtcggtcccatgggccctcctgggcctcccggacctaggggccctgccggaccaaatggcgcagacggccctcagggcccacccggaggggtgggcaacctgggaccacctggggaaaagggtgaacccggagaatcaggctcccctggcatacaaggagagcctggagtgaaaggaccccgaggcgaaaggggcgagaagggtgaaagcggacaacccggtgagccaggtcctccaggacccaaaggccctactggtgacgatggaccaaagggtaacccgggaccagtcggctttcccggtgatccaggccctccaggcgaaggaggccctcgaggacaggatggagccaaaggcgatcggggagaggacggcgagccgggacagcccggatccccaggcccaacaggggagaacgggcctcctgggccactgggaaaacggggtcctgcgggaagcccgggtagcgaaggacggcagggcggaaagggcgctaagggagaccctggcgcaattggagcccctggcaagaccggaccagtgggtcctgcgggtccagcgggaaagcctggacccgatggactcaggggcctgcctggcagcgtcgggcaacaagggaggccaggagccacgggccaggccggacccccaggtcctgttgggccaccaggcttacctggcttgcggggagatgccggtgcaaagggcgaaaaaggccaccctgggctaatagggctgattgggcctccaggtgagcagggcgaaaagggggaccggggtctgccaggcccacagggaagtcccggtcagaagggggaaatgggcattcctggcgcatccggtccaatcggtccgggagggcctccgggactgcccggtcccgctggaccgaaaggtgcaaagggagccactgggcctgggggtcccaaaggcgagaaaggcgtgcaggggccacctggccatcccggaccaccgggtgaggttattcagcctctgcctatccagatgcctaaaaaaacacgaagatccgtcgacggctcacgcctgatgcaagaggacgaagctattcctacgggcggagcacctggctcccccggagggttggaggagatcttcgggtcgctggattcattgagagaagagattgagcagatgcgtaggccgaccggtacacaggattctcctgccagaacttgtcaggacctgaagttgtgccatccagaactgccagacggcgagtactgggttgacccgaaccagggttgcgctcgcgacgcctttcgcgtattttgtaattttacagcaggtggagagacctgcgtcactcctcgagacgacgtaacccagtttagctacgtcgacagtgagggatcaccggttggggtggtgcaactgacctttctcagactcctcagcgtgagcgctcaccaggacgtctcatacccatgttcaggcgctgcccgtgacgggccactgcgattacgtggagctaacgaggacgagctttcccctgaaacgagcccatatgtcaaggaattcagggatgggtgtcagactcagcagggccgaactgtgctggaggtgcgcacccccgtgttggaacaactccctgtgctcgacgctagttttagcgacttaggcgctcccccacgcagaggaggcgtgctcctggggcctgtttgcttcatgggata

SEQ ID NO: 4780 - DNA, 921 bp, Artificial Sequence
  Description of Artificial Sequence: Synthetic coding sequence
atggattggcgcgcatccgaggcgtggatggtgcctagggccccaaaaggtgcctgggaccccagagaatcacaggatctcctagacaatcgcgctcctctggggccacgcgtctttcctgggccacgggtgccttcagccctgatggaacgcagggtgctgaagggatctcaggggtctcctgcgtgcccaggtccaccaggcgaggttatccagccacttcctattcagatgcctaagaaaacgaggaggtccgtggatgggtctcgcctgatgcaagaggacgaagctattccgacaggtggggctcctggttctccaggcggactggaagaaatcttcggttcactcgattctttacgcgaggagatcgagcagatgcgacgcccaaccgggacacaggattccccagccagaacctgccaggatctcaagctgtgtcatcccgagctccccgatggcgaatattgggtcgacccgaaccaggggtgcgctcgcgacgctttccgagtcttctgcaatttcactgccggtggcgaaacctgcgtgactcccagagacgatgtgactcaattcagttatgttgactccgagggatctccagtaggggtggtgcaactgacatttctccgcttgcttagtgttagcgctcaccaagatgtttcctacccatgctctggagcagcgagggacggacctttgcgactgaggggcgctaatgaggatgaacttagcccggaaacaagtccatacgtcaaggagttccgggacgggtgccagacccaacagggcagaactgttttagaggttaggacacccgttttggagcagctccccgttttggatgcgtctttctctgatctaggagctcctccccgtcggggaggagtactgcttggtcccgtttgcttcatgggctag

SEQ ID NO: 4781 - DNA, 5069 bp, Artificial Sequence
  Description of Artificial Sequence: Synthetic coding sequence
atggagcgatgtagccgctgccatcggctcctgcttctactcccgctcgtgctggggctttctgctgccccaggctgggcaggggctccgcctgtggacgtgctcagggcactgcggtttccttccctgcccgatggtgtgcgcagggcaaagggcatatgtcctgccgacgttgcataccgagtggcaaggcctgctcagctgagcgctcctacacggcagctcttccctggtggtttccccaaagacttctccttgttgaccgtggtgcggactcgtcctggcttgcaggccccactactgacactgtactcggctcaaggagtgagacagctgggcctagagcttgggaggcccgttaggtttctgtatgaggatcaaacaggcaggcctcagccaccaagccagccagtgtttcgcggactgtcactggcagatggaaagtggcacagggtagcagtggccgtcaaagggcagtctgtcaccctcattgttgactgtaagaagcgagtcacgagaccactgccccgttctgccaggcctgtcttagatacccacggtgtgatcattttcggggcaaggattcttgatgaagaagtctttgaaggtgatgtgcaggagttagctatcgtgccaggagtgcaagccgcttacgaaagctgcgagcaaaaggagctagaatgcgaaggaggtcaacgagagcggcctcagaatcaacaacctcatcgcgcacagcgctcacctcagcagcagcctagcagacttcatcgcccacagaaccaggagccacagagccaggagcagacagatcttcaggttcctcccaccgctgacaggttccaggcggaagagtacggagagggcggaactgaccctcctgaggggccttacgattatacctacggatatggcgatgattatcgggaagaaaccgagctagggcctgccctgtctgctgaaactgcccactctggggcagctgcccacgggcctcgagggctgaagggggagaagggagaaccagctgtcttggaacctggtatgctggtcgagggtccccctgggccagaaggaccagccggtctgatcggccctcctggaatccagggcaacccaggcccagttggcgaccccggtgaacgtggtccaccgggaagggccggactgcccggaagtgatggggctccaggaccgccaggcaccagcctaatgctccccttccggttcggatctggcggtggagacaaaggacctgtcgtggctgcacaagaggcccaagcccaggctattctgcagcaggctcgccttgccctgcggggaccaccaggccctatgggctacacgggcagacctggccctcttggccagccagggagtccaggcctgaaaggtgaaagtggcgaccttggtcctcagggaccaagggggcctcaaggcctgactggacctcctgggaaagctggccgacgcggtcgtgccggagcagatggggctcgcggtatgcctggcgacccaggcgttaaaggggaccggggatttgacggcctgcccggactcccgggtgaaaagggtcaccgcggagacaccggcgctcagggtttgccgggacctccgggagaagatggggagaggggggacgacggcgaaatagggccaagaggtctgcccggtgagtcaggacccaggggcttacttgggcctaaggggcctcctggcattcctggtccacctggggttcgcggtatggacggccctcaggggccaaaagggagcctggggcctcagggagagcctggaccccctggtcagcagggcactcccggtacccaaggcttacctggtccccagggggctatcgggcctcacggcgagaaaggaccgcagggaaaacccggattacctggcatgccaggttcagacggccctcctggccaccctggcaaagagggtcctccaggaacgaagggcaaccaaggacctagcggccctcaaggaccattgggttacccaggaccgagaggcgtgaagggagtggatggcatccggggtctcaaaggacacaaaggcgaaaagggggaggacggctttcctggctttaagggtgatatcggcgtcaagggcgacaggggtgaagtcggagtgcccggatctcgaggggaggatgggcctgaagggcctaagggcagaaccggtccaaccggagacccgggacctcctggtttaatgggagagaaaggcaaattgggcgtgcctggactgcctggctatcccggacgtcagggtccgaaagggagcttggggtttccagggttcccgggagcttctggagaaaaaggtgccaggggtctgtctgggaaatctggacctagaggcgagcggggtcccaccggtcctcgcggacagcggggtcctcggggtgcaacagggaagtctggagccaaggggactagcggcggtgacggccctcatggacctccaggagagaggggacttcccggtcctcagggtcccaacggttttcctggacctaagggcccaccaggtcccccaggaaaggacgggctacccggtcaccctggccagagaggggaggtcggattccagggaaagacaggacccccaggaccaccaggtgtggttggccctcagggtgccgctggagagactggcccaatgggagagcgcggtcaccccggtccacctggaccacccggagagcagggacttcctggaacagccggaaaagagggtaccaagggagatcctggtcctccaggtgccccaggaaaagacgggccagctggactgagaggcttccctggcgagcgaggattgccaggtactgccggtggccctggactcaagggcaacgaagggccaagcggtccgcctggacctgccggatctcctggggagcgaggtgctgcgggttccggaggacccatagggccaccgggtcgaccgggtccccaaggtccccctggggcagcaggtgagaagggggtgcctggcgaaaagggccctataggccctaccggaagggatggtgtacagggtcccgtgggcctgccaggcccagccggaccgcctggtgtagccggagaggatggagataagggagaagtgggcgatccagggcaaaagggcacaaagggcaataagggcgagcatggccctccgggtcctccagggccaattgggcctgtgggacaaccaggtgcagccggtgccgatggagagccgggagccagagggccacagggccatttcggggcaaaaggtgatgagggaaccagggggttcaacgggccacccggtccgataggcctgcagggcttgcccggacctagcggggagaaaggtgagacaggagatgtgggtcccatgggtccccctggaccacctgggcctcggggacctgcgggacctaacggggctgatgggcctcaggggcctccaggcggtgttggaaacctgggcccacccggagaaaagggggaacccggtgaatcagggtccccgggaattcagggcgaaccaggggttaagggccctaggggtgagagaggcgaaaaaggagaatccggccagccaggagagcctgggcctcccggaccgaaagggccaactggagacgatggcccaaaaggcaacccaggaccagtcggattcccgggagatcccggaccgcctggcgaaggtggaccccgtggccaagacggcgcaaagggagaccgaggggaggatggagaacctggacagccagggagccccggaccgaccggcgagaacggccctccgggaccactgggtaagcgcggaccggcagggtcgcccggtagtgaaggcagacagggcggtaagggggctaagggcgatccaggggcaatcggagcaccaggtaagactgggccagtgggtcccgcaggccctgcaggcaagcccggacctgacgggcttaggggtttgccaggatcagtaggacagcagggcagacccggagctaccggtcaggctggcccacccggacctgtgggaccgccaggcctgccaggcttgcggggagatgccggtgcaaagggtgaaaaaggccatcctgggctcattgggctgattggcccacccggagagcagggcgagaagggtgatagaggacttcccggaccacagggcagccccggacagaaaggggagatgggtatccccggagcttctggtcctatcggtccaggagggcctccagggctgcctggacccgcagggccaaaaggcgcaaagggggcaactgggccagggggacccaagggcgaaaagggcgttcaggggccacccggacaccctggaccaccaggtgaggtgatccaaccactacctatacaaatgcccaaaaaaacaaggcggagcgtcgacggatctaggctgatgcaggaggacgaggcaatccccactggcggtgctccaggcagtccagggggacttgaggagatatttggcagcctggactccctacgagaagaaatcgagcagatgaggcggcctaccgggacgcaagactcccctgcaagaacatgccaggatcttaagctctgtcaccccgaattacctgatggtgaatactgggtggatcccaatcagggctgtgcccgagacgcatttagagtattttgtaatttcactgcgggtggagaaacgtgcgtaaccccaagggatgatgtgacccagttctcctacgtagatagcgaggggagtcccgtgggggtcgtgcaattgaccttcttgaggcttctgtccgtgtctgctcaccaagacgtttcctacccgtgttctggagcagcgcgtgacggtcccctgaggctaagaggtgccaacgaggacgaactgtccccagaaacgagcccgtacgtcaaagagtttagggatggatgtcaaacacagcagggaagaaccgtgctggaagtgagaactcccgtgctggagcagttgcctgtgctcgacgcatccttctcagacctaggagctccccctaggaggggaggcgtcctacttggtcccgtgtgctttatgggata

SEQ ID NO: 4782 - DNA, 4890 bp, Artificial Sequence
  Description of Artificial Sequence: Synthetic coding sequence
atggagagatgctcccgctgtcaccgtctgctcttgctgttgcccttagtgctgggactgtccgcggcacccggatgggcgggagcccctcctgtggatgtactaagggccctcagatttccctctctcccagatggcgtgaggcgggctaaaggaatctgtcccgctgacgtggcctaccgggtcgccagacctgcacaactctccgccccaacccggcagctgtttcctggaggattccccaaggattttagcctgttgaccgtcgtcaggacccgccctggcctgcaagcaccactactcaccctctatagtgcacagggggtgagacagcttgggctggagcttgggcctcccgtccggtttctctacgaggatcagacgggcagaccccagcctccgtcacagccagtttttagagggttgtcactggccgacggcaagtggcaccgcgtggcagtcgctgtgaaaggtcagtctgtgaccctgatcgtcgattgcaagaagagagtaacacggcctcttcctcggtcggccagacctgtcctggacacccatggcgtcattatcttcggtgccagaatcctcgacgaagaggtatttgaaggtgatgtccaggagctggctattgtgccaggcgtgcaggccgcatatgaaagttgtgaacaaaaagaactagaatgcgaggggggacagcgggaacgaccccagaaccagcagcctcaccgggctcagagatctcctcagcagcagccaagcaggctccatcgcccacagaaccaggagcctcaaagccaggctgctcatggtccaagaggactgaaaggcgaaaagggggaaccggcagtgctagagcctggtatgctagtggaggggccaccgggacccgagggccctgcgggactcatcggaccccctgggattcagggcaacccagggccagtgggtgatcccggagaacggggtccaccgggacgcgctggtttgcccggatcggatggggcaccgggacctcccggaacgagtcttatgttaccattccgcttcggttccgggggaggcgataaaggaccggtggtggccgcacaggaagcccaggcccaagctatcctgcaacaggctcgcctcgctctgaggggcccacctggacccatggggtatactggacggccaggccctcttggccagccgggtagtcctgggctgaaaggtgaaagtggagatctggggccacagggtcctcgtggacctcaaggtctgactggcccacccggtaaagctggtcgccgaggtagggcaggggctgatggtgcacgaggaatgccaggtgacccaggagtaaaaggtgaccgcggattcgacggcctgccaggactacctggggaaaagggacaccggggtgatacaggggcacaggggctgcccggtccccctggggaggatggggaacgcggagatgatggcgagattgggccacgcggactgcctggagagagcggaccgaggggacttctgggccctaagggtccacctggcatacctggaccccctggagtccgaggcatggatgggccacaaggaccgaagggctcactaggccctcagggggaacctgggccacctggccagcagggcaccccgggaacacagggactccccggtccccagggcgctattgggccacacggcgagaagggaccccaagggaaacccggtcttcccggtatgcctggctcagatggaccccctgggcacccgggaaaagagggccctccaggcacgaaaggcaaccagggtcccagcggccctcagggtccactgggctatcccggtcctaggggagtcaaaggcgtcgacggaattaggggtcttaaaggccacaagggtgagaagggtgaggacggcttccctggatttaagggcgacattggtgtgaaaggggataggggcgaagtaggagttccgggaagcagaggagaggatgggcctgaaggacccaagggcagaacagggcctacgggggatcctggcccaccaggtttgatgggcgaaaagggcaagctcggagtgcccggtctaccaggttacccgggtcggcagggcccaaaaggcagcctgggctttccaggatttccaggagcttccggcgagaaaggtgcccgtgggctgagtggcaagagtggtcccaggggcgaacgcggtccaacaggacccaggggtcagcggggtcctcgcggtgctactggaaagtctggagccaaagggacctcagggggagatgggcctcatggacctccaggagaacgcggtttgcccggaccccagggccctaacgggttccctggacctaaaggacccccaggacctccaggcaaagatggcctacccggacatcccggacaacgcggtgaagtaggcttccagggtaagaccggacccccaggaccaccaggggtggtgggtccacagggtgccgcaggagagaccgggcctatgggcgagagagggcaccccggacccccaggaccacctggagagcagggcctccctggaaccgcaggaaaagagggtacaaaaggagacccgggaccccctggagcgcctgggaaagatggtccggctggactgcggggatttcccggagagagaggactcccaggcacggctggcggtcccggactaaaggggaacgaaggaccatcaggccctccaggacccgctggctctccaggcgaaagaggagcggctggctccggtggaccaatagggcctcctggcagacctggccctcagggcccacccggagccgctggagaaaaaggtgttcctggggaaaaggggccaatcggccctacaggcagggacggagtgcagggccctgttggcctgccaggaccagccggtcccccaggagtcgctggtgaggacggggacaagggagaggtgggtgatcccggtcaaaaaggaaccaagggaaataaaggagaacacggccctccaggccctcctggtccaattgggccagttggacagcctggcgcagccggagcagacggggaacccggagctaggggtccgcaaggtcatttcggagccaagggggatgagggcactaggggcttcaacgggccacccggacctatcggactacagggtctgcccggaccctccggggagaaaggtgagactggggacgttgggcctatggggcctccagggcctccagggcctcggggtcctgctgggccaaacggtgccgacggaccacaaggtcctcccggaggcgtcggcaatctcggccctcccggagaaaagggtgaaccaggcgaatcaggctcccctggtattcagggggagcccggagtgaaggggccacgaggggaacgcggtgaaaaaggggaaagcggccagccaggcgagccaggccctcctggaccgaaaggccctaccggagacgatgggcctaagggcaatcccggaccagtgggttttccaggtgaccctggacctcccggagaagggggacccaggggccaggatggagccaagggagaccgtggggaagatggcgagcccggacagcctgggagtccaggtccgaccggagaaaatggacctccgggtcccttgggtaaaagggggccagccggatcccctggatcagagggtagacaagggggaaaaggggcaaagggtgacccaggtgcaataggtgctcctgggaaaaccggacccgtggggccagcaggtcccgctggcaaacccggtcctgacgggctgcgcggactgcccggaagcgtgggccagcagggccgtccgggagctactggccaggcagggcctccaggccctgtgggaccgcctggcctgccagggctgaggggtgatgccggtgccaaaggagagaaggggcaccccggacttataggacttattggtcccccaggcgagcaaggagagaaaggcgacaggggactccctgggccacaaggaagcccgggtcaaaaaggagagatggggattcctggagcgagcgggccaatcggtccgggtgggccacccggactgccgggacctgctggaccaaagggcgctaagggcgctactggcccaggcggtccgaagggggaaaagggagtccagggaccacccggtcatccgggacctcctggcgaagttattcagcccttacccattcaaatgcctaaaaaaactcgaagatccgtggatggatctaggctcatgcaggaagatgaggcaatccctacgggtggagcccctggcagccccggtggtctggaggaaattttcggttcactggattccttaagagaggaaattgagcaaatgcggaggcccacagggacccaggacagtcccgcacggacttgtcaggacctcaaactctgtcacccagagctgcctgatggggagtactgggtggacccaaaccaggggtgcgctagagatgcttttcgagttttttgcaacttcacagcgggaggagagacatgcgtgaccccgagagacgacgttactcagttctcgtacgttgattctgaagggagcccggtgggcgttgtgcagctgacatttctgagactcctctcggtctccgcccaccaagatgtttcttatccgtgttctggcgcagcgagagatggtccacttcggctgcgaggtgccaatgaggacgaattgagccccgagacatctccatatgtgaaggagtttagggacgggtgccagactcagcaggggcgaaccgtcctggaagtgagaaccccggtccttgaacagttacccgtgctggatgcttccttcagcgacctgggtgcccctccacgacggggtggagtgttactcggtcccgtatgttttatggggtag

SEQ ID NO: 4783 - DNA, 4890 bp, Artificial Sequence
  Description of Artificial Sequence: Synthetic coding sequence
atggagcgttgttcccgttgtcaccggctcttgttgcttttacccctcgtccttggtttaagcgctgcgccagggtgggctggcgctcccccagttgacgtcctcagggcgctgagatttccttctctgcccgatggcgtgcgacgcgctaagggcatttgccctgcagacgttgcctatagggttgcgaggcccgcacaactttctgccccaacccgccagctctttcctggagggttccccaaggacttttcgctcctgactgtggtgcgaacaagaccagggcttcaagcgcctctgctcaccctatattccgctcagggggtccgacagctggggcttgagctgggcagacccgtaaggtttctgtacgaggaccagactggaaggccccaacctccgagccagcccgtgtttcggggtcttagtcttgccgatggaaagtggcaccgtgtcgctgtggctgtgaaggggcagagcgtgactttgatcgttgattgcaaaaagcgagtaactcggccattaccaagaagcgcgaggccggtgctggacactcatggcgtgatcatcttcggcgctaggatcctcgacgaggaagtatttgaaggagacgttcaggagctggctatcgtccccggagtccaggctgcgtacgagtcatgtgagcagaaagagctggaatgtgaaggcggtcaacgcgaacgaccgcagaaccagcagccgcaccgagcccagaggtccccacagcagcagccctcacgtctgcaccgtccacaaaatcaagagccccagtctcaggccgcacacggtccacgcggtctaaagggagaaaaaggggaacctgctgtgctggagcccggaatgctagtggagggccctcccggacctgaaggccctgccggactgattggtcccccaggcatccagggcaacccaggcccagtcggagatcccggagagcgcggtccaccagggagggctggtctgccagggagcgatggtgcaccaggcccacctggaacatctctgatgctgcccttcaggttcggctccggcggaggggataaagggccagtggtggctgctcaagaagcccaagcccaggcaatcctccagcaggcacggctcgcacttcgcggtccccctggacccatgggttatactggcagacctggacccctgggccagccaggcagtcctggactaaaaggagagagtggagatctgggcccacaagggccaagggggccacagggtctcacagggcctcctggaaaagccggtcgacgtggaagagctggagctgatggggctcggggaatgcccggagatcccggagtgaagggcgaccgcggtttcgatgggttgcctggcctccctggagagaagggccaccgtggggataccggggctcaggggctcccaggacctcctggtgaggacggtgaaagaggagacgacggtgagatcgggcctcgcggactgccaggggagtccggcccaagagggttgctgggcccaaaagggcctcctgggattcctgggccacccggagtccgcggaatggatggtcctcaaggcccaaagggctccttaggccctcagggtgagccaggaccgccaggccaacagggcacacccggaacacaaggcctcccgggtccgcaaggagctattggtcctcacggagagaaagggccacagggtaagccaggcttacccggtatgcccggatcggacgggcctcccggacacccaggcaaagagggaccccctggcacgaaaggaaaccagggaccttccggaccccagggtccactggggtaccccggaccccgaggcgtaaaaggcgtcgacgggattcgtggcctgaaaggtcataaaggcgagaagggtgaagacggctttccaggttttaagggagatatcggtgtcaagggtgatagaggggaagttggcgtgcctggctcccgaggggaggatgggccagaagggccaaagggtcgaaccggaccaacaggtgaccctggcccaccaggactcatgggagagaaaggcaagttgggcgttcctgggctgcccggttatcccggacggcaaggccctaagggctcgctgggcttcccaggtttccctggggcttcaggggaaaaaggggctcgcggactgagcggtaaaagcggcccacggggagaaagaggtccaactggtcccagaggacagcggggaccgcgtggcgcaactgggaaaagcggggcaaaggggacctctgggggagatgggcctcacgggccaccaggggagcggggtttacccggtcctcagggtccaaacgggtttccaggccctaaaggaccccctgggccaccaggaaaggatggcttgcctggacatcccggtcagagaggagaggtcgggttccaggggaagaccggcccaccgggtcctcccggagtggtggggccacagggcgcagctggcgagaccggcccaatgggagagaggggccatcccggaccccctggacccccaggcgagcaggggttgcccggaacagcgggtaaagagggaaccaagggcgaccccggaccaccgggagctccaggcaaggatggccctgcaggccttcgaggttttcccggtgagcgagggctgcccggaacggctggcggtcctggactgaagggcaacgaaggcccttcaggccctcccggacctgccggttccccaggcgagcgcggtgccgcagggtctgggggaccaatcggacctcctggaaggcccggaccccaagggccacccggtgccgctggagaaaagggggtgcctggcgagaaaggccctatcgggccaacaggacgcgacggtgtgcaggggccagtgggactgcccggtcctgcaggccctccaggggtcgcgggagaagatggtgataaaggggaagttggggatccgggacagaaaggtactaaaggtaacaaaggagaacacgggccacctggcccacccggtccaattggcccagtgggacagcccggagcggcaggggcagacggcgagcccggtgcaaggggccctcaagggcacttcggagccaagggagacgaaggcaccaggggttttaatggccctcccggtccaatcggcttgcagggcctgcccggaccttctggcgagaagggcgagactggcgatgttggccctatggggcctccagggcctcccggaccacgtggacccgctgggccaaacggagctgatggtccgcagggaccaccgggaggcgttgggaatttaggcccaccaggggaaaaaggggagccaggcgaaagtggctcccctggcatacagggcgagcccggagtaaagggtcctaggggagagcggggtgagaagggggagtccggacagcccggagaacctggacccccagggcctaaaggacctacaggggacgacggcccaaagggtaaccctggccctgtcggttttcctggggaccctgggccacctggagaggggggaccccgaggtcaggacggcgcaaagggcgatcgaggagaagacggggaacccggacaaccgggaagtcctggtccgacaggggagaacggacctcccggaccactgggtaagcggggtcccgcaggcagcccgggatcagagggtagacagggaggaaaaggagccaagggcgaccctggggcaatcggtgcccctgggaaaacagggcctgtcggaccggctgggcctgccggaaaaccgggaccagacggcctgagaggcctgcctggctcagtgggccagcagggacgaccaggcgcaacggggcaagctggcccaccaggacctgtggggcctcccggtttgccgggactgcgcggtgacgctggcgcaaagggtgaaaagggacacccaggactgattggtctcataggtcctcccggtgaacagggcgaaaagggggacagggggctcccagggccacagggctctcccggacaaaaaggcgaaatgggcattccaggagccagcggcccaatcggccctggcggacctcccggacttcctggccctgcaggacctaaaggagctaaaggcgctactggtcccggaggcccaaaaggagaaaaaggcgttcagggaccaccaggacatcctggaccacccggtgaagtgatccagccattgccgatccaaatgcccaagaagaccaggaggtccgtggatggatcgaggctcatgcaggaggacgaggccatacctacagggggagcccctggttcccctgggggattggaggaaattttcgggtcactggatagcctacgtgaggagattgagcagatgaggagacccaccggaacacaggatagccccgctaggacctgccaagatctaaagctgtgccacccggaactccctgatggggagtactgggtagatcccaaccagggctgcgctcgggacgctttccgtgtattttgtaatttcaccgcagggggagaaacctgcgtgaccccacgcgatgacgttacccaattttcctatgtggatagtgagggatcacccgtaggtgttgtgcaacttacctttttacggttgctttctgttagcgcccaccaggacgtgagctacccttgctccggcgcagccagagacgggccacttaggctgcgaggggctaacgaagacgaactgtcccccgaaactagtccatatgttaaggaatttcgggacggatgccaaacccagcaaggccgaacggtattagaggtacggactcctgtgcttgaacagctgcccgtgctggatgccagtttcagcgacctgggagcgcctcctagaaggggtggcgtgctcctgggaccagtgtgttttatgggatag

SEQ ID NO: 4784 - DNA, 5132 bp, Artificial Sequence
  Description of Artificial Sequence: Synthetic coding sequence
atggaaagatgcagtaggtgccataggctattgttgctactgcctctcgttctagggttgtcagccgcaccaggctgggccggagcccctcccgtcgatgtcctgagagctcttcgtttcccctcactgccagatggtgtaagaagggccaagggcatatgtcctgccgatgtcgcttatcgagttgcccgtccagctcagctgagtgctcctacacgacagctattccccggaggattccctaaagatttttctttgctgactgtcgtgcgcaccaggcctggattacaggcaccacttttaaccctatattcggctcagggggtgaggcagttgggtcttgaactgggacgccctgtgcgttttttatacgaggaccagactggtaggcctcagcctccctcacagcctgtgtttcgtggcctttctctcgccgatgggaagtggcacagagtcgcagtagctgtgaaagggcagagtgtgaccttaatcgtcgattgtaagaaaagagtgacacgtccactgccacggagtgccagacccgtactagatactcacggcgttattatcttcggcgctcggattcttgacgaggaggttttcgagggggatgtccaggagctggccatcgtccccggagtccaggctgcctacgagagctgtgaacagaaagaactggagtgcgaggggggacagagggagagaccgcagaaccaacagccccatagagcccagcgcagtccgcagcaacagccctcacggttgcataggcctcagaaccaggaaccacagtcccaggaccccaccccgggagaggaggaagaaattctggaatcctcactgttgccccctctggaagaagaacagacagatctacaggttccccctacggcggataggttccaggctgaagagtacggcgagggagggaccgatccaccggagggcccatacgattatacttatggatacggagatgattatcgcgaggaaacggagttggggccagctctgagcgccgagaccgcccactctggagccgctgctcatggcccaagagggctgaagggggagaagggagaacctgctgtgctcgaacccggtatgctcgtggaaggccctcctggcccagagggccctgccggactgatcggaccacctggaatacagggaaatccaggtccagtaggtgacccaggagaacgaggcccacccggaagagcagggctgcctggctctgacggtgccccagggccaccagggacatcactcatgctgccctttcgcttcggttccggtggtggtgataaggggcctgtcgttgccgctcaggaagcccaggcccaggccatcctacagcaggccaggctggctcttagggggcctccaggccctatgggatataccggcagacctggcccactgggacagccagggagcccgggactcaaaggcgagtctggagaccttggaccccagggcccacggggaccacagggattaactggcccacctggaaaggccggacggagaggccgagccggtgccgacggagcacgaggcatgcccggtgatcctggtgtcaagggtgaccgaggattcgacggcttgccaggtttaccaggcgagaaagggcatcggggtgatacgggggcacaggggctacctgggcctcccggtgaggacggggaaaggggtgacgatggcgagatcggtccccgtggtctccccggtgagagtgggcctcggggacttcttgggcctaaagggcctcccggtatccctggaccaccaggcgtcagggggatggacggtccgcaaggacccaaaggctccctcggccctcagggtgagccaggaccaccaggccaacaggggacacccggtactcaggggctaccgggtccgcagggagccatcggccctcacggggaaaaaggcccacagggaaaacccggactgcctggcatgcccggttcagacggcccacccggacacccaggcaaagagggcccaccgggaaccaagggcaaccaggggccatcaggccctcaaggccctctcggctacccagggcctagaggagtcaaaggagtcgacggtatcaggggtttaaagggacataaaggtgaaaaaggcgaggatggtttccccggattcaaaggggacatcggagtgaaaggagaccgaggggaagtgggggttcctggctcacggggtgaggacggtccagagggccctaaaggacgaacgggcccaactggagaccctgggccacccggtctgatgggggaaaagggcaaactgggggtgccagggctcccaggataccccggacgtcagggaccaaaaggttccctaggtttccccggattcccaggcgctagtggcgagaaaggtgccagggggttgagtgggaagtccggcccacgcggagagcggggaccgactggtcccagggggcagagaggaccccgaggggctactggaaagtcaggcgcaaagggaacatccggcggagatggccctcacggaccaccgggagaaagggggctacccggtcctcagggccctaatgggtttcccggacccaaggggccaccaggtccaccgggaaaagatgggctgccaggacacccaggccagcgaggagaggtcggctttcaagggaagaccgggccaccgggaccaccaggtgtggtggggccacagggggcagccggagaaaccggaccaatgggtgagcgcggacatcctggtcctccagggccacccggtgagcagggcttgccaggaaccgcgggaaaagagggtaccaagggtgacccaggccctccaggagctccaggcaaggatggacctgcagggcttaggggatttcccggtgagcgtggcctaccaggcaccgcgggaggaccgggactgaagggtaatgaaggcccaagtggccctccaggacccgcaggctcgcccggagaacggggagctgcaggaagtggaggcccaataggccctcctggacgccctggcccacagggcccacccggagcggcaggagaaaagggagtccccggagaaaagggcccaattggtcctaccggcagagacggagtgcagggacctgtgggcctgcccggtcctgcaggcccacctggtgtcgccggagaggacggggataagggggaggtgggagatcccggacagaaaggaaccaaggggaataaaggcgaacacggcccaccaggacccccagggcctatcggccctgtgggtcagccaggcgcagcaggtgccgatggcgagccgggagcccgaggacctcagggacatttcggcgctaagggagacgaggggaccaggggattcaacggccctccaggccctattggcctgcagggactaccaggaccttccggggaaaaaggagagacaggcgacgtagggcctatgggccctccaggaccccctgggccaagaggtccagccggaccaaacggagctgacgggcctcagggacctcccggtggggtggggaatctcgggccaccaggagagaagggggagcctggagaatcaggttcccccggtattcagggcgaacctggggtcaaagggccaagaggagagagaggcgaaaaaggagaatccggtcagcctggggaacccggacctcctgggcctaagggtcccacaggcgacgacggcccaaagggcaacccgggtcctgtaggcttcccaggagatccaggaccacctggtgagggtggccctagaggccaggacggagcaaagggcgatcgcggtgaggatggcgagcctggacagcccggatcccccggtccaactggtgagaacggccctcctgggccactcgggaagagaggccctgctggcagtccagggtccgaagggagacaggggggaaagggagcgaagggagatcctggagcaatcggggctcctgggaagacagggcctgtgggacccgctgggccagccggaaaacccggaccagacgggcttagggggctgcccggtagcgtcggtcagcaaggcaggcctggcgcaacgggtcaggctggaccgcctggaccagtcgggccacccggtctaccagggctgaggggcgatgctggcgctaagggggaaaaaggacatccgggtctgattgggctcatcggtcctccaggcgagcaaggagagaaaggcgacagagggctgccaggcccacagggcagcccagggcagaaaggtgagatgggaattcctggagcgtctggaccgattggcccaggaggtccacctggccttccgggaccagccggacctaaaggagcaaaaggagccacaggtcccggagggcctaaaggcgagaagggtgtgcaaggaccccctgggcaccccggaccccctggggaggtgatccagcccctcccgattcagatgcccaagaagaccagacgctcggtcgacggcagcagactcatgcaggaagacgaggcaatccctacagggggagcgccaggaagtcctggaggtttagaagaaatctttggaagtttggatagcttgcgcgaagagatcgaacagatgagacgccctacaggcacacaagacagcccagcaaggacctgtcaggatctgaagctatgccatcctgaactaccggatggcgagtactgggtggaccctaatcagggctgcgcccgtgacgccttccgagtcttttgtaattttacggccggaggggaaacttgcgtcacccccagggatgatgttacgcagtttagctacgttgacagcgaggggtctcctgttggggtggttcagctgaccttcctgcggctgctgtctgtgagcgcacatcaggacgtctcgtacccctgcagcggggcagctcgagatggacctctgcgcctccggggagctaatgaggacgagctctcgcctgaaaccagcccctacgtaaaagagttccgcgacggctgccagacccaacagggtcggacagtactggaagtccggacgcctgtgctggagcagttgcctgtgctagacgctagtttctcagacctgggagcccctcccagaagggggggagtcttactgggccctgtttgctttatgggcta

SEQ ID NO: 4785 - DNA, 5148 bp, Artificial Sequence
  Description of Artificial Sequence: Synthetic coding sequence
atggagcgctgcagtcgttgccatagactgcttctccttttacccctggtactgggtttatctgcagccccaggttgggcaggagccccacctgtagatgtgctgagagccctcaggtttccttccctgcctgatggggtgcggcgagctaagggtatctgtcctgccgatgtggcgtacagagtggctcgccctgcccagctttcagctcctaccaggcagctgtttcctggagggttccctaaggatttttcactgttgaccgtcgttcgcactcgacccggattgcaagctcctttactgaccctgtattctgcccaaggggtaagacagctgggcctggaacttggacgcccagtcaggttcctgtacgaagaccagacaggtcggccacagccaccctcacagcctgtgttccgcggactaagtttggcggatgggaagtggcatagggtggctgtggcagtgaaaggacagtcagtgactttgatagtggactgcaaaaaacgcgtcactcgaccactgcccagaagcgcaaggcctgtccttgacacacacggagtgattatctttggcgcaaggatcttggatgaagaggtgtttgagggcgacgtgcaggaactggcaatcgtgcccggtgtgcaagctgcatacgagtcatgtgagcagaaagaactagaatgtgaaggtggacagcgggagaggcctcagaatcagcagcctcaccgcgctcagagatcaccacagcaacagcccagccgacttcatagaccacaaaatcaggagcctcagagccagcccactgaaagcttgtattatgattataaacctccatactacgatgtaatgacaacaggcacgactcctgactatcaggaacagaccgacctgcaggttcccccaaccgccgataggttccaggccgaggaatacggggaagggggaacagaccccccagaaggtccctacgattacacgtacggatatggcgacgactatcgcgaagaaaccgaattggggcctgccctgtccgctgaaacagcacatagtggagcagctgcacatggccctcggggtctcaagggcgaaaaaggcgaaccggcagtcctggaacccggaatgctggtggagggacctccaggcccagagggccctgcaggactgattgggccacccggtattcagggcaacccaggaccagtgggcgatccaggcgaacggggacctccaggacgtgcgggacttcctggttccgacggcgctccgggaccaccagggacctctctaatgcttccctttcggttcgggagtggaggcggtgataaaggacctgtcgtagctgcccaggaggcacaagcccaggcaatactacagcaggccagactggccctgagagggcctccagggcctatgggatacaccgggaggcctggtcccctaggtcagcctgggagtcccggtctgaagggcgagtcaggagatctggggcctcagggccctagagggcctcagggacttaccgggcctccgggaaaggctggccgtaggggcagagcaggcgcagatggcgctagaggaatgcccggagaccctggcgtaaagggcgaccgcggatttgacggactgccagggttgccaggcgaaaaagggcatcggggagacactggggctcaggggctccctgggcctcctggtgaagatggagagcgaggggatgatggcgaaatcggtccacggggactcccgggagaatctggtccgcgaggactgcttggacccaagggacctcccggaatcccgggaccacccggagtcagaggaatggatggtccccaggggcctaaaggctccctggggccacagggcgagcctgggccacctgggcaacagggcacgcctggtacgcagggactccccggaccacagggcgcaatcgggccacacggggagaagggtccgcagggaaaacctggcctccctggtatgcccggtagcgacggcccacccggacaccccggtaaggaagggccaccaggcaccaagggcaatcaaggcccaagcggaccccagggtccccttgggtatcccggaccaagaggcgtcaaaggggtcgatggtattcggggattgaaaggccataagggcgagaagggggaagacggattcccaggctttaagggcgatattggcgtaaagggtgatcgaggcgaagtgggggtccccggttctaggggcgaagatggcccagagggtccaaaaggaagaacagggcctaccggagacccgggaccccctgggctgatgggagaaaagggaaaactcggggtcccaggccttccgggttaccccggacggcagggtcctaagggtagtcttggtttcccaggttttccaggtgccagtggtgagaaaggggctagaggcctgtctggtaagagcgggccaagaggggagagagggcctaccgggcctagggggcagcgcggacctcgcggagctaccggcaagtctggcgctaagggcacctccggcggagatggcccacatggaccacctggagagcgcggtctgcctggccctcagggacctaatggtttccctggcccaaagggaccacccggtcccccaggtaaagacggtctgccagggcaccctggccaacggggagaagtgggcttccagggcaaaaccggccctcctggtccacctggcgtcgtggggcctcagggtgccgcaggagagacaggacctatgggggagcggggacacccgggaccgcctggcccacccggagaacagggcctccccggaactgctggcaaagaggggaccaagggggatccaggccctccaggcgctcccggaaaggacggaccggctgggctccgtggattccccggagagagagggctgcctggaacagctgggggtcctggcctgaaagggaacgaggggccaagtggccctcctggacccgctggaagccctggtgagcgcggagctgccggatctggcggacccatcgggcctcccggaaggcctggccctcagggcccacccggtgcagccggagaaaagggggtcccgggtgagaaaggacctatcggccctaccggcagggacggagtgcagggccctgtcggcttgcccggacctgccggtccccctggtgttgcgggtgaggacggcgataaaggagaagtgggcgaccctggacagaagggcacaaagggcaacaaaggagaacacggccctccgggtccacctggacctataggacctgtggggcaaccaggggctgccggtgccgacggtgaaccaggggcacggggacctcaagggcacttcggtgccaaaggcgatgagggcacacgcggatttaatgggccaccgggtcctatcggcctccaaggtctgcctggaccttccggggagaaaggagagactggggacgtcggtcctatgggcccaccgggaccacccggtcccaggggccctgctggacctaacggcgctgatgggccacagggcccaccagggggagtgggcaatctgggcccacccggagaaaagggcgagcctggcgaatcaggcagcccaggaattcagggagaacctggtgtcaaaggccctcgtggagagcgcggtgaaaagggggagagcggccagcctggcgagcccggacctccaggtcccaaaggccctacaggggacgatggtcctaagggaaaccccggtccggtgggtttccctggggaccccggacctcccggagaggggggacctcggggtcaggacggtgccaagggcgacaggggggaggacggcgagcctggacagcctggatcaccagggcctaccggcgagaatggcccacctgggccactcggcaagcgaggtccagcgggtagccctggatctgaaggcagacagggaggtaaaggtgccaagggggatcccggagccatcggcgctcccggaaagacgggcccagtcgggccagccggtccagccggaaagcccggacccgatgggctgcgcggactcccagggagcgtgggccaacaggggcgtccaggggctactggccaggccggaccaccaggccctgtcggccctccgggactcccaggactccgcggagacgccggagctaaaggcgaaaagggccaccccggactaattggcctgatagggcctccgggtgagcagggtgaaaagggagatagagggctcccaggaccccagggttccccaggccagaagggggagatgggtatccccggagccagtggccctattgggccagggggaccgccaggcctcccgggacccgctggccctaaaggggctaagggggcaaccggcccaggcggtcccaaaggcgagaaaggcgtgcaggggccacccggtcaccccggtcccccaggagaggtaatccagcccttacccatacagatgccaaagaagacccggcgatcagttgacgggtctagactgatgcaggaggatgaggccatccctacaggcggagctcctggatcccctggtgggcttgaagaaatctttggtagtctcgattccctccgggaggaaatcgaacagatgcgacggccaaccggaacacaggacagcccggcacggacctgtcaggacctgaaactttgtcatcccgagctgccagacggtgagtattgggtggatccaaatcaaggatgtgcacgagatgctttccgcgtcttttgtaattttacagctggtggggaaacttgtgtaacaccgagagacgacgttacgcagtttagttatgtggatagtgaggggtcaccagttggggtagtgcagctcacctttcttaggcttttgtctgtgagcgctcaccaggatgtaagttacccgtgcagcggcgcagctcgcgatggaccgttgcgactgcggggtgcaaatgaggacgaattgagtcctgagacgagtccttatgttaaggaatttcgtgatggttgccagacgcagcagggcaggacggtcctggaggtcagaactcccgttctcgagcagcttcccgtcctcgacgcttctttttccgacttgggcgctcccccacgccgagggggagtgctgcttggccctgtctgtttcatgggctar

SEQ ID NO: 4786 - DNA, 5147 bp, Artificial Sequence
  Description of Artificial Sequence: Synthetic coding sequence
atggaaaggtgttcccgatgccaccgactcttgctgctgctacccttagttctgggtctgtcagccgcaccaggctgggccggagcccctccagttgatgtgctacgggctttgcgattccctagtttgcccgacggcgtgagaagagctaaaggtatttgtcctgccgatgtggcataccgagtcgctagacccgcacagctgtcagctcccacaaggcaattattccctggcggattccccaaagatttttccctattgactgtagtgagaactcggcctggcctgcaggctccactgcttactctgtattctgcacagggggtgagacaactcgggttggaacttggaccccctgttaggttcctgtatgaggatcagactgggaggcctcagccaccaagtcaaccagtcttcaggggactgagcttagcagacgggaagtggcatcgtgtggctgtcgcagtgaaggggcagtctgtgacactaatcgtagattgtaagaagagagtgactcgccctctcccaagatcagccagacccgtcctagatacacatggcgtgataatcttcggagcgaggatactggatgaggaggtctttgagggtgacgtccaggagctcgccatagtgccgggtgttcaggccgcatacgagagctgcgagcagaaggagttggaatgcgaggggggacagagagaacggcctcagaaccagcagcctcacagagcccagcggagccctcagcagcagccatcacgcctgcaccgccctcagaaccaggaacctcagagccaacccaccgagtctctgtattacgactataagccaccctactatgacgtgatgacaacaggaactacccctgactatcaggagcagacggatctccaggtacctcccaccgctgatagattccaagccgaggagtacggggagggtggcaccgaccctcctgagggcccttacgattatacgtacggctacggggacgattatagagaggagacagagctgggtcccgctcttagtgccgaaacagcgcactctggggctgccgctcacggcccaagggggttgaagggcgaaaaaggagagccagcagtactggagcctgggatgctcgtggaaggacctccagggcctgaaggtcccgcaggactaatcggacccccaggcatccagggcaatcctggcccagttggggacccaggtgaacggggacctcccggaagagctggactgccagggtccgatggggctcccggtccacccggaacctcattgatgctgccttttcgatttgggtctggtgggggtgataaagggcctgtggtggccgcacaggaggctcaggcacaggcaatcctgcagcaggcgcgtctcgcattgcgaggcccacctgggcctatgggctacaccggaaggcccggacctcttggtcaacccggatctccgggtctgaaaggcgagagcggggatctggggcctcagggaccgagggggccacagggtctgacaggtcccccaggcaaagcaggccgaagagggagggcaggggctgacggagctcgagggatgcccggagatccaggcgttaaaggcgacaggggattcgacgggctcccagggctgcccggagagaagggccaccggggagatacgggggctcaggggctgccaggaccccctggagaggatggggaaagaggggatgatggggagattggccctagggggttaccgggagagagtgggccaagagggttgctgggaccaaagggccctccaggaattccaggacccccaggagtacggggaatggacggccctcaaggccctaagggtagcctgggacctcagggtgaaccagggcctccaggacagcaaggtactccagggacacagggtcttccaggaccacaaggtgcaatagggcctcatggcgagaaggggcctcagggcaaacctggcctgcctgggatgccgggaagcgatggaccccctggccaccccggtaaagagggacctcccggaactaaagggaatcagggtccttccggacctcagggacctctcggataccccggacccagaggagtgaagggcgtggacggaataagaggtcttaagggccacaaaggcgaaaagggcgaagacggctttcctggattcaagggggatataggcgtcaagggtgacaggggggaggtaggcgtgcctggcagtcgcggagaggacggcccagagggcccaaagggcagaaccggtccaaccggggacccgggtccacccggattaatgggagagaagggaaagctgggcgtgccaggacttcccggatacccaggtcgccagggccctaaaggatcactgggatttcctggatttcccggagcgtccggagaaaagggtgctcggggactgagtggtaaatccgggccaagaggcgaaagggggccaaccgggcctaggggacagcgtggtcctcggggtgcaaccggcaagtccggggcaaaggggacgtcagggggtgacggacctcacggaccgccaggcgaacgtggtttgcctgggccacagggccctaatggtttcccagggccaaagggtccaccaggcccaccagggaaagacggactgcctggccatcctggtcagaggggggaggtcggtttccaggggaagaccggcccaccaggtccacccggagtcgtggggccacagggcgctgcaggagagaccgggccaatgggcgagagaggacatcccggtcctccaggccctcccggtgagcaagggctgccaggcaccgccggaaaggaggggactaagggcgatcctggtcctcccggagctcccggaaaggatggccctgcagggctccgaggtttccctggggagcggggactgcccggtactgctggaggcccaggtctgaagggtaacgaggggccatcaggcccacccggacctgccggatctcccggagaacgcggagccgcaggctccgggggacccattggccctcccggtagacccggtccgcagggccctcccggtgctgctggcgagaagggtgtccccggagagaaaggccctatcggcccaactggaagagacggggttcaaggccctgtaggattgcccggacctgcagggccacctggcgtagctggcgaggacggcgacaagggcgaagtaggggaccctgggcaaaaggggactaaaggaaacaaaggtgaacatggcccaccaggaccacctggacctattgggccagttggccaaccaggggctgccggagctgacggagagcctggcgctagggggccacagggtcacttcggcgcaaagggtgatgaagggacccggggattcaatggccctcccggtcccatcggacttcaaggtcttccaggtccttccggggaaaagggagagactggggacgtgggaccaatgggccctccagggcctcccggacccaggggcccagctggacccaacggtgcagacggaccccaggggccacccggaggcgtgggcaatctgggacctccaggggagaaaggagaaccaggtgaatccggtagccccggaatccagggagagccaggcgtgaaaggaccaaggggcgaaagaggggaaaagggagagtctggccagcctggcgaaccagggcctcctgggcctaagggcccaaccggggacgacgggccaaaagggaatcctgggccagtgggatttcccggagatccaggacctccaggcgaaggcggaccaagaggacaagatggcgcaaagggggatcgcggtgaggatggtgagcctggacagccaggcagccctgggcctaccggagaaaacggcccacccggaccgctgggaaaaaggggtcccgcaggcagtccaggttctgagggaagacaggggggaaagggtgcgaagggcgaccccggagccatcggagctccaggaaagaccggccctgttggtcccgctggccctgcaggaaagcccggtcccgacggccttcggggtctgccgggttctgtgggacaacaaggtagaccaggagctacaggccaggccggaccacccggacccgttggcccacctggacttcccggtctgcgtggtgacgccggtgccaaaggcgagaagggccatcccggactgatcggccttataggccctccgggtgagcagggggaaaagggcgacagaggattgcctgggcctcagggctccccaggccaaaaaggggaaatggggattccaggcgcaagcggtcctattggtccgggagggccacctgggttacctgggcctgccggtcccaagggtgcaaaaggcgcaacaggccctggcggaccaaagggcgagaagggggtccagggtccccctggccatcccggaccacctggtgaagtcatacagccgctacctattcagatgccaaagaagacgcgacggagcgtggacgggagtaggttaatgcaagaggacgaggctataccgaccggcggagcaccgggatctcctggaggtttggaggaaatatttggcagtctcgactccctccgcgaggaaatagaacagatgcgacggccaacagggactcaagactctccagctcgaacatgtcaagacttgaagctctgccatccggagctcccggacggcgagtactgggtggaccccaatcagggctgcgctagagatgcctttcgcgtgttctgcaattttacagcgggaggagagacctgcgtgacaccacgcgacgacgtgactcagtttagttacgtcgattctgagggtagcccggtgggcgtcgtgcaattgacatttctgaggctgctgagtgtgtcagcccatcaggacgtttcctacccttgttccggggctgcaagagatggtccgcttagattgagaggtgcgaacgaagatgaactgagccctgagacttctccttacgtcaaggaatttcgcgacggttgccagacacagcaaggtcgcaccgtcctggaggtccggacaccagtactggaacagctacccgtcctagacgcttctttcagcgatttgggcgcaccacctcgcaggggaggcgtcctcctgggccctgtctgtttcatgggcta

SEQ ID NO: 4787 - DNA, 5030 bp, Artificial Sequence
  Description of Artificial Sequence: Synthetic coding sequence
atggaaagatgcagcaggtgccatcggttgttgctgcttctgcccctggtgctgggcctcagcgctgcgccaggctgggccggtgcgcctccagttgacgtgctgcgcgctttgagatttccctctttaccagacggtgtgcgaagggcaaaggggatctgtcccgctgatgtggcctatagggtcgctaggcctgcgcagctgtctgctcctacccggcagttattcccgggtggctttcccaaagacttttcgctgctgacagttgtcaggacaagacccggactgcaggcccctttactgacattgtattcggcccagggagtgaggcagctggggctagaactagggcgtccagtccggttcctctacgaagaccagacagggcgacctcagccccctagtcaaccggtgttccgcggactctccctcgccgacggcaaatggcatcgggtggcagtggctgtcaaaggacaatcagtgacattgatcgtggactgcaaaaaaagagtcacacgtcccctccctcgaagtgccagaccagtcctggatactcacggggtgattatatttggcgcacgtatacttgacgaagaggtctttgagggggacgtgcaagaactggcaatcgttcctggggtgcaggccgcatacgagtcatgtgaacaaaaggaactggaatgcgaagggggacaacgcgagagaccccagaaccagcagcctcaccgggcacagagaagcccgcagcagcagccatccagactccaccgacctcagaaccaggagccgcagtcccagcctaccgaaagcctgtactatgattacaaacctccttactatgacgtcatgactaccgggactacccccgactatcaggaccctacacccggagaagaagaggagatcctggagtcatctctgttgcctccactagaggaagccgctcatggcccaaggggtctgaaaggggaaaaaggcgaaccagccgtgctcgaaccaggcatgctggttgaagggccacccggacccgagggacctgccggtcttattggccctcccggaatccagggcaaccctggacctgtaggagatcctggagaacgcggacccccaggaagagctggattaccagggagcgatggcgctccagggcctccagggaccagtttaatgctgccattccgcttcggcagtggagggggagacaaagggcctgtcgtggccgctcaagaggcccaggcccaggcaatcctccagcaagccaggctagccttgcgcggaccacctggcccaatggggtacaccgggagacctgggcctctgggccaaccaggctcacccggacttaagggcgaaagcggggacctgggcccacagggtccgcgaggcccacaaggtctgacagggcctcctggcaaggcgggtcgtcgcggtcgggcaggagccgacggcgctcgtggaatgcccggtgatcctggagtcaaaggcgatcggggattcgacgggctgccagggctgcccggtgaaaaggggcaccgaggggacaccggcgctcaaggtttgcccggacctcccggagaggacggcgaaagaggggacgacggcgaaatcggaccccgtgggctgcccggagagtccggacctcggggtctcctcggacctaaaggcccaccaggaatccctgggcctccgggagttcggggaatggacggtccacaagggcctaaggggagtctgggcccacaaggtgagcccggaccaccaggacagcagggcacacctggaactcagggactgcccggaccccagggggctataggaccacacggagaaaaggggcctcaaggcaagcccggacttcctggcatgccaggtagtgatgggcctcctggtcatccagggaaagagggaccacccggtactaagggaaaccaggggccaagcggccctcagggcccattaggctatcctgggcctcggggtgttaagggggttgatggcatcaggggcctgaaaggccacaagggggagaaaggagaagacggctttcccggttttaaaggtgatatcggcgtgaagggagaccggggagaagtgggagtccccggttcaaggggggaggatggcccagaaggaccaaagggccgaacgggcccaaccggcgatccaggccctcctggattaatgggggaaaaaggaaaactgggtgtcccaggactaccgggttatccgggaaggcagggaccgaagggcagtctcgggttccccggattcccaggagcctcaggagaaaagggagccaggggacttagtggcaagtccggtccaagaggggaaagaggcccaacagggccaagggggcagagaggtcctcggggagctaccggcaagtctggcgcaaaggggacgtccggaggtgatggccctcacggcccacccggagagaggggcctccctggcccacagggacctaacgggttccctggacctaaggggcctcccggacctccagggaaagatggcctgccagggcatccaggccagcgaggcgaggtaggcttccagggaaagaccggtccacccggtccccctggagtcgttggaccccagggcgcagcgggagagaccgggccaatgggcgagagaggacatcctgggccacccggtcctccaggtgagcaggggctgccaggtacagcgggtaaggaaggcactaagggggacccaggtcctcctggggcacccggtaaggatggccctgctgggctgaggggtttccccggtgaacggggactacccggtacagccggagggccagggttaaaaggtaacgaagggcctagtggtcccccaggacctgcagggtcccccggagagcggggtgccgcaggctccggcggtccaattggtcctccgggaagaccaggccctcaggggccacctggcgctgccggtgaaaaaggcgtaccaggagagaaaggtcctataggcccaactggcagggacggggtacaggggccagttggccttcccggacccgctggccctcctggcgtcgccggagaggatggagataagggagaggtcggcgacccagggcagaaagggacaaagggcaataaaggagagcacggtcccccaggaccgcctggcccaatcggtccagtgggacagcccggagcggcaggcgctgatggagagcctggtgccagaggaccccagggacacttcggcgctaagggcgacgaggggactagaggcttcaacggaccaccagggcctatcggactgcagggactgcctgggccttccggcgaaaaaggggagactggtgacgtggggccaatggggccacccggaccacctgggcctaggggaccagccggacctaacggggctgacgggccacagggaccaccaggtggagtaggcaacttgggtccgccaggggaaaaaggcgaaccaggcgaatcaggcagccccggtatccagggcgaacctggagtgaaaggtcccagaggagagaggggcgagaaaggtgagtctggccagccaggagaacctggtcccccaggccctaagggcccaaccggggatgatggacctaagggaaatcccggaccagtgggcttcccaggggatcccggtcccccaggggaaggtgggcctcgcggacaggacggcgctaagggggaccggggtgaagatggggagccagggcaacctggctcccctggaccaacgggcgagaatgggcctcctggccctctgggaaaacggggacctgcgggaagtccaggctctgaaggacgccaggggggtaagggcgcaaaaggagatcctggcgctatcggtgctcctgggaagactggcccagtcgggccagccggacccgctggaaaacctggtcccgatggtctgcgtggactgcccggttctgtaggccagcagggtcgccctggagctacagggcaggccggacccccaggacctgttggcccacccggtttgccaggtcttcggggagacgccggagcaaagggggagaagggccatcctggtctaattgggctgatcgggccaccaggagaacagggggaaaagggggaccgtggcctgcccggaccacaaggcagccccggacagaaaggggaaatggggatccctggggcaagtggaccaattggtcctggcggtccgcctggcctcccaggccctgcagggcctaaaggtgccaaaggcgctaccggaccaggaggtcccaaaggggagaagggcgtccagggcccacctggccaccccggaccgcctggcgaggtgatccagccactgcccatccagatgcccaaaaaaacccggcgaagcgtggatgggtctcggctgatgcaggaggatgaggccattcccaccggcggtgcacctggatcacctgggggactagaggagatatttggctccctcgactcacttagagaagagatagagcagatgagacggcctacggggacacaggattctccagcacgcacatgtcaagaccttaagttgtgccacccggagctgccagatggcgaatattgggtcgatcctaaccaggggtgtgcaagagacgcgttcagagtcttttgcaactttactgccggaggcgagacctgtgtgactccacgtgacgacgtaacacagttctcttacgttgacagcgaaggtagcccagttggagtggtgcagttgactttcctccgactgctgtccgtgtctgcccaccaagacgtctcttacccttgctctggtgccgcaagagatggacccctgagactcagaggggcaaacgaggatgagttgagtcctgagaccagcccctatgtgaaggagtttcgcgatgggtgtcaaacacagcagggtagaacggtccttgaggtgagaaccccggtactggaacagctgcctgttttggatgcctccttttctgaccttggggcaccacccaggcggggtggagtacttctgggacccgtgtgcttcatggggta

SEQ ID NO: 4788 - DNA, 4968 bp, Artificial Sequence
  Description of Artificial Sequence: Synthetic coding sequence
atggaaagatgttcccgctgccaccggctgcttctgctgttacctttggtattagggcttagcgcagcgccaggatgggccggagctcctccagtggatgtacttcgcgctctgcgattccctagtctgcctgacggagtccggagagctaaaggaatctgcccggctgacgtggcgtatagagtggccagacctgcacagctaagtgccccaactaggcaactgttccctggagggtttcccaaagacttttcactgttgactgtcgtgagaacccgccctgggttgcaggcaccacttctcactctgtactcagcgcagggcgtcaggcagctgggcctggagctaggtaggcccgtaaggttcctgtacgaagatcaaactggcagaccccaacccccaagccagccagtgttcaggggcctgtcgcttgcggacggaaagtggcacagagtcgcagtggccgtgaaggggcagtccgttacactgatcgtggattgcaaaaagcgtgtgaccaggcctctgcccaggtccgccaggccggtgctcgatacacacggtgtgatcatctttggagcacgaatactggacgaggaggtgtttgaaggtgatgtgcaggaactcgcgatcgttcccggtgtgcaggccgcatatgagtcttgtgagcagaaggaattggagtgcgaaggtgggcagagagagagaccccagaatcagcaaccccaccgggctcagcggagtccacagcagcagccttccagacttcataggccacagaatcaggaacctcagtcccaaccaacagaaagtttatattacgactacaaacctccttattacgacgtcatgactacaggcacaacgcctgattatcaagcagcccatggccctaggggactaaaaggtgaaaagggcgagccagcggttctagagcctggaatgcttgtcgaaggcccaccaggtccggaaggcccagcaggacttatcggcccacctggcatccagggcaatccaggcccagtgggggatcccggtgagcgcggtccccctggtagggccggactaccaggctctgatggtgcaccaggcccaccaggcactagcctgatgctgcccttcaggtttggatctgggggaggcgacaaggggcctgtcgtggccgctcaggaggcccaggcgcaggccattctccagcaggccaggctggccctccgcggaccccctggccctatgggctacacgggcaggcccggaccattggggcaaccaggtagcccaggcctgaaaggcgaatccggcgatttaggccctcaaggtcctcgtggccctcagggtctgaccggccctccgggtaaagccggtcgccgaggcagggcaggagccgatggtgctcgcggaatgccgggagatcccggagtgaaaggcgacagggggttcgatgggctccctggcctgcctggcgaaaagggccaccggggagacaccggggctcaggggctgcccggaccacctggagaggatggagagaggggtgacgatggcgaaatcggcccacgcggactgcctggcgagagcggtccccgaggacttctagggccaaaaggaccaccaggtatccccggaccacccggagtgagaggaatggatggaccgcaggggccaaagggtagtctaggtccacaaggcgagccagggcctcctggccaacagggtacccccggaacccaaggattacctggaccccagggagctattggaccccatggcgaaaagggaccccaggggaagccaggtttgcccggaatgccagggtccgacggcccaccagggcatcctggcaaggaaggaccacccggaacaaagggtaatcagggtccttccggcccacaggggccactgggctaccccggtcctaggggtgtgaagggcgtggacggcatccgtggcctgaagggacacaagggtgagaagggcgaggacgggtttcctggcttcaaaggagatattggggtaaagggtgatagaggggaggtgggggtacctggctcccgaggcgaggatggcccagaggggccaaaagggagaacaggcccaacaggcgacccagggcctcccggtctcatgggtgagaaaggaaaactgggcgtgcccggtttaccaggttaccctggccgacaggggcctaagggcagcctaggcttccccggattccccggtgcctctggcgaaaagggggctagaggccttagcgggaagtcgggtcctcggggtgagcgcggtcccaccgggccaagaggccagaggggcccacgtggcgctactgggaaatcaggggcaaaagggacgtcaggcggagacggaccccacggaccgccaggagaaaggggcctacctggaccccaagggccaaatggttttcctggtcctaagggaccaccagggcctcctgggaaggatggacttccaggccatccgggtcagagaggagaggtgggttttcaggggaaaacagggccaccagggcctcccggtgtggtgggccctcagggggctgccggtgagactgggccaatgggcgaaagaggccacccaggcccacccggtccacccggtgaacagggccttcctggaactgccggaaaggagggcacaaagggcgaccctggtccccctggcgcacccggaaaagacggacctgcgggactgcgcggatttcccggtgagcgtggtctgccgggaactgctgggggacccggtctgaagggcaacgaagggccaagtggcccacccggaccggctggtagtcccggagagagaggggcagccggatcgggaggccctatcggaccccctggacgcccaggcccacagggcccacccggagcggctggggagaaaggcgtcccaggggagaaggggcctattgggccaacgggacgagatggcgtacagggacctgttggcctgcccggtccggctggaccaccaggcgtggcgggtgaagacggggataaaggcgaggtaggagacccagggcaaaaaggtacaaaaggaaacaagggtgaacacggtccccctgggccacccggaccaatcggcccagtaggccagccaggggctgctggggcagatggcgagcccggagcgcgaggccctcagggccatttcggggcaaaaggtgatgagggtacaaggggattcaacggccctccgggaccgatcggcctgcagggactcccaggaccttctggcgaaaaaggtgagacaggggatgtggggcctatgggccctcctgggcctcctggcccaagaggccctgcgggtccaaatggtgcagatggcccacaaggacctcccggaggcgttggcaacttgggtccgccaggcgaaaaaggagaaccaggagagtcgggatcacccggtatccaaggcgagccaggcgtgaaggggcctcgaggggagagaggggagaaaggcgagtctggtcagcctggagagccagggccaccaggtccaaaagggccaacgggagacgatgggcctaaggggaatcccggacccgttggtttccccggagacccaggacctccaggagaagggggacccagaggtcaggacggagctaagggcgaccgaggcgaagatggggaacccggtcagcccggttcccccggacccacaggcgagaacggccctccaggacctttaggcaagcgcggacctgccggttctcctgggagtgagggccgtcagggcggaaagggggctaagggcgaccctggagctatcggagctccgggtaaaacaggccctgtcggaccagccggacccgctggaaagcccggaccagatggattgagaggtttgccaggatcggtcgggcagcagggtcggccaggtgccaccgggcaggccggaccgcctggccctgtgggcccaccaggcttaccgggactgcggggagatgccggagccaaaggtgaaaaaggtcatccaggattaattgggcttatcggaccgccaggagagcaaggcgaaaagggagatcgcggattgcctgggcctcaaggcagtccgggacagaaaggagagatggggatccctggagcgtctgggcctatcggaccaggcggtcctcccggtctgccaggccctgctgggcctaaaggggcaaagggcgctacaggccctgggggtcctaaaggcgaaaaaggtgtgcagggaccacctggacacccaggcccaccaggtgaggtgattcagccccttccaattcagatgcctaaaaaaacacggaggtctgtcgacggctccaggctcatgcaggaggacgaagctatccctactgggggagctcctggatcccctggtgggcttgaggagatcttcggatccctggattcgttacgggaagaaattgaacaaatgagaaggcctactggcacgcaagacagcccagctaggacatgtcaggatctaaagttatgtcatcccgaactccctgatggagagtactgggtggacccgaaccagggttgtgcccgagacgcctttagagtattttgcaatttcaccgctgggggagagacctgtgttaccccgcgtgatgatgtaacacaattttcatatgtggattctgagggtagccccgtaggcgtggtgcaactgacattcctgcggttgctctcggtgagcgctcatcaggacgtttcatatccctgttcaggagctgctagagatgggccactacgactcagaggagccaatgaggacgaactctcccctgagactagcccttacgttaaggaatttagagatggctgccaaacccagcagggcaggacagtgctggaagtcagaacgcctgttctggagcagcttcctgtcctggacgctagtttctccgatttgggtgcacccccaaggcgaggaggcgtgctgctagggccagtatgtttcatgggctaa

SEQ ID NO: 4789 - DNA, 5147 bp, Artificial Sequence
  Description of Artificial Sequence: Synthetic coding sequence
atggagcggtgttcccggtgtcatagactgctcctcttgctcccattggttcttggcctttccgccgcaccaggttgggctggggcacctcctgtcgatgttctccgcgcactgcgatttccctccctgccggacggcgtgcgaagggctaagggaatatgtcctgccgacgtggcttatcgggttgctcgcccagcacaactgtccgcacccacacgtcagcttttcccaggcggatttcccaaggacttcagcctgcttactgtggtccgtacacggccaggtttacaggcgcctctactcaccttatactccgcccaaggagtgcggcaactgggtctggagcttggccgacccgtgcggtttctgtatgaggaccagacaggtcgaccccaacctccaagccagccagtcttccggggtctctctctggctgacgggaagtggcatcgtgtagcggtggcagttaaaggacaaagtgtgacccttattgtggactgcaaaaaacgggtgacccgaccccttcccaggagtgctagacctgtcctggatacccatggcgtaattatctttggagctaggatcctcgatgaagaagtgttcgaaggcgatgttcaagagctggcaattgtccctggtgtgcaggcagcgtacgagtcgtgcgaacaaaaggaactggagtgcgagggagggcagagagagcggcctcagaaccagcagcctcacagagcacagagatccccccaacagcaaccctccagattacatcgtccccagaaccaggaaccgcagtctcaacccaccgaatcactatactacgattacaagcctccctattacgatgttatgaccaccggcaccaccccagactaccaagaacagacagatctgcaggtgcccccaacagcagatcgcttccaggccgaggaatatggggagggcggaaccgaccccccagagggcccatatgattacacatatggctatggcgatgactatcgggaggagaccgagcttgggccagcgttgagtgcggagaccgcccactctggtgccgctgcccacggcccacggggactgaaaggtgagaaaggcgaaccagccgtgttggagccaggaatgctggttgagggaccacctggcccagagggaccggcaggtctcatcggtcccccagggatacagggaaatcccggaccggtgggagacccgggtgagcgaggacctccgggtagggcgggattaccgggatctgacggtgctccgggtcctccaggaacctcactgatgttgcctttcagattcggatccggaggcggagataagggccctgtggtggctgcacaggaggcacaggcccaggcaatcctgcagcaggccagactggctcttcgcggacccccaggccctatgggttacactggcagacctggtcctctggggcaacccggatcacccggattaaagggcgagtccggtgatttagggccacaaggtcctcgtggacctcagggattaaccggcccacctgggaaagcaggacggcgtggtcgggcaggcgcagatggagcgagagggatgccgggagatcccggagtgaaaggtgatagagggtttgacgggctgcctgggctccctggcgagaaaggacaccgaggagataccggggctcagggactccctggacctcccggagaggatggagaaaggggagatgacggggagattgggcctcgaggactgccgggagagtcaggtccgagaggtttactgggccctaagggccctcccggtattcctggtcccccaggtgtgaggggaatggatgggccacagggcccaaaggggagtctgggaccccaaggggaacctggtccacctggacagcaagggactcctggtacccagggcttgcccggacctcagggagccattggcccacacggggaaaaagggccacagggtaagcccggactacccggaatgccgggtagtgatggacccccaggccacccaggaaaggaagggccacctggtacaaagggtaatcagggtccgtcgggcccacagggaccactgggctaccccggtccacggggagttaaaggcgtcgatggaattaggggcctgaagggccacaaaggagaaaagggcgaggacggattccccggatttaaaggagatatcggtgttaagggagacagaggggaagtgggtgttcccggtagccgcggagaagatggccctgaaggtcctaaggggaggaccgggcctactggagatcccggtcccccaggcctgatgggtgagaaggggaaactgggcgtcccaggtctgccaggatatcccggacgccaggggcctaaaggttcattgggctttcctgggtttccaggcgcttctggcgagaagggagccaggggactttcaggtaaatctggccctaggggagaacggggacccacaggaccaagagggcagaggggaccgcgtggggcaaccggcaagtccggggctaaaggaacctcaggcggtgacggaccgcacggccctccaggagaaaggggccttcctggtccccagggacccaacggcttccccggtcctaagggcccaccgggacctcctggcaaagacgggctgcctggacacccagggcagagaggagaagtcgggtttcaaggcaaaaccggccctccagggcctccaggtgtcgtgggtccacagggggcagcaggggaaaccgggccaatgggcgagcggggacatcctggtccaccagggccacccggtgagcaagggctcccaggcacggcgggaaaagagggtacaaagggggaccccggaccccctggagccccagggaaagacggacccgcaggacttagggggttccctggagagcgtggcttacccggtaccgccggtggacctggcctgaaaggcaacgaaggtccatcaggacctcccggtcctgccggtagccccggagaaagaggtgccgctgggtctgggggaccgatcggccctcccggaaggcccggacctcagggccctccgggtgcagcaggcgagaaaggagtacccggtgagaagggaccgatcggacctaccgggagggacggcgtgcagggcccagtggggttgccaggccctgctggtccccctggggtcgccggtgaagatggagacaaaggggaggtcggggaccccggacagaaaggcacgaagggaaacaagggtgaacacggacctcctggccctccgggaccaatcgggccagtcggtcagccaggcgctgccggtgctgatggtgagcccggagcacggggtccccagggccatttcggggctaagggggatgagggcacccggggttttaacggaccaccagggccaatcggcctgcagggcctgccaggcccatctggtgagaagggggagaccggcgacgtcggacccatgggccctccagggccacccggacctcgcggaccagctggaccaaacggtgcagatggacctcaggggcctcccggtggtgttggcaacttgggcccacccggtgagaagggggaacctggggagtctgggtctcctggtatccaaggggaacctggggtgaaagggcctagaggcgaacgcggtgagaaaggagagtcaggacagcccggtgagcctgggccaccaggccctaaaggaccaaccggcgatgatgggcctaagggtaaccccggacccgtagggtttccaggagaccctgggccaccaggagaaggcggacccagaggtcaggatggcgctaaaggagatagaggagaagacggagagcccggacagcctggcagccctgggccaacgggagagaatggcccacctgggcctctgggaaagagagggcctgcgggaagccctggaagtgagggaaggcagggtggtaagggggcaaagggtgaccctggcgcaatcggagcgcctgggaagacgggacctgtagggccagccggtccagccggaaagcctggcccagatgggctgcgagggctgcccggatccgttggccagcaggggaggccgggagccaccggacaagctgggccacctggtcccgtaggaccgccaggccttcccggtcttaggggcgacgccggagccaagggcgaaaagggacacccaggtcttattgggctcataggacctcccggagagcagggtgagaaaggggacagaggactccccggaccgcaggggtctcctgggcagaaaggtgaaatgggcattcctggcgcttctggccctatcgggcctgggggacctccgggactgccaggtcctgccggaccaaaaggcgctaagggagctacaggcccaggtggccctaagggcgaaaaaggggtccagggtcctccaggccacccaggccctcccggagaagtcatccagcccctaccaatccagatgcctaaaaagactcgcaggtccgtggatggcagtcgtcttatgcaggaggatgaagctataccaacgggcggagccccaggatcccctgggggactggaagagatttttggctcactggacagcttacgcgaagaaatcgagcagatgcgtagacccactgggacccaggactctccagcccgaacatgccaggatctgaagctttgccaccccgagctcccagacggcgagtactgggtcgatccaaaccaaggttgtgcacgcgacgccttccgggtgttctgcaactttactgcgggaggcgaaacatgtgtcacaccgagagacgacgtgactcagttttcctatgtggattcagaaggctcccctgtgggagtcgtacaactcaccttcctgcgcctgctgagcgtcagtgcacaccaggatgtaagttacccctgctccggagctgctcgggatggacccctgcggctgcggggagccaacgaggacgagctgtctcctgaaacttctccttatgtgaaggagtttagagacggctgccagacccagcagggtcggaccgttctggaagtgcggacccccgtattggaacagctccctgtcctggatgcctcattttccgacctcggtgcacctcccagaagaggcggagttttgctaggaccagtgtgctttatggggta

SEQ ID NO: 4790 - DNA, 9192 bp, Artificial Sequence
  Description of Artificial Sequence: Synthetic coding sequence
atgaggtccagactgcctcccgctctggccgctctcggtgcagcactgttactttcttccattgaggctgaggtcgatcccccttccgatctaaacttcaaaatcattgatgaaaacactgtccacatgagttgggcaaaacccgtggatccaatcgttgggtacaggatcacggttgatcccacaacagatgggcctactaaggagttcacccttagtgcgagtacaactgagactctgctttccgagttagtgcccgagactgagtacgtcgtcaccattacctcttacgacgaagtggaagagagtgtgcccgtgattgggcaacttactattcagacaggatccagcacaaagcccgtagagaagaagccaggcaagactgagatccagaaatgctcggtgtcagcttggaccgatctggtatttctcgtggatgggagctggtcagtgggcaggaataactttaagtacattctcgacttcattgctgccctcgtgtctgctttcgacattggcgaggaaaaaacccgggtgggtgttgtacagtactcctcggataccaggactgagttcaacctcaaccagtattatcaacgagatgagctgctggctgctatcaagaagattccgtacaaaggaggaaatacaatgacaggggacgccattgattatttggtgaagaatacgtttaccgaaagcgccggagccagggtgggatttcccaaggtcgccatcataatcacggatggtaagtctcaggacgaggtggagatcccagcacgggagctgcgcaacgtgggtgtggaagtgttttccctcggcattaaagctgccgacgccaaggaactcaaacagatcgccagcacacccagtctgaaccacgtgttcaacgttgccaacttcgacgcaatcgttgacattcagaacgagatcatcagtcaggtgtgcagcggtgtggacgagcagcttggcgagctggtgtcaggcgaagaggtggtagaaccgccatcaaaccttattgcgatggaagtcagttccaagtacgtgaagctgaattggaacccctcccccagtcccgttactgggtataaagtgatcctaaccccgatgaccgcgggatcgagacaacacgctctgagtgtgggccctcagaccactactcttagcgtgagagacctgtctgccgacacggaataccaaatcagtgtgtctgccatgaaagggatgactagctcggagcctatttctataatggaaaagactcaacccatgaaagtccaggtcgagtgtagcaggggagttgacattaaagcagatatcgtattcttagttgatggaagctactctatcggtatcgccaattttgtcaaggtgagagcctttctcgaggtgctggtaaaaagcttcgagatctctccaaatagagtgcagatcagtctcgtgcagtatagccgcgacccacacactgaattcacacttaaaaagtttaccaaagtcgaggacattatcgaagccattaacacgttcccctaccggggaggcagcacaaacaccgggaaagcaatgacgtatgttcgcgagaaaatctttgtgccaagcaaagggagcagaagtaacgtacctaaggtgatgatcttaatcaccgatggcaaaagtagtgacgctttcagggaccctgctataaagctgcgtaactccgatgtcgagatcttcgccgtcggtgtcaaggatgcagtaaggtccgaactggaggcgattgcaagcccccctgctgaaacacacgtgttcaccgttgaagacttcgatgccttccagcgaataagttttgaactgacacaatccatatgtctgcggattgagcaggaactggcagccataaaaaagaaagcatatgttcctcctaaggacctctctttctctgaagtgaccagctacggattcaaaacaaactggtcaccagcaggagagaatgtattcagttaccacatcacgtacaaagaagcagcgggagacgacgaggtgacagttgttgaacctgcctcctccacgtcagtggtcctctcttcgcttaagccagagacattatacctggtcaatgtgactgccgaatacgaggacggctttagtattcctctcgcaggggaggaaaccacggaagaggtgaagggcgcacccaggaacctgaaggttactgatgagaccacagatagcttcaagatcacatggactcaggccccagggagagttctgcgctatcgcattatatacagacctgtcgctgggggagaatcacgggaagtgacgaccccgccaaaccagagaagaagaaccctggaaaatttaatccctgacacaaaatatgaggtctccgtcattcctgaatacttttctggccctggaacaccactcactgggaacgcagcgaccgaagaggtgcgtggcaatcccagggacctcagagtgagtgaccctaccacaagcacaatgaaattgagttggtccggcgcacctggtaaagttaaacagtatcttgtgacatacactcccgtcgcaggcggagagacccaggaagtcaccgtgaggggagataccaccaacacagtgctgcaaggattaaaggaaggaacccagtacgccctctccgtgaccgcgctgtacgcttctggggcaggtgacgcgctgtttggtgaggggactactctcgaagaaaggggctcaccgcaagacctggtcactaaggatatcacagatacaagcattggagcttattggaccagtgcgcctggtatggttaggggctatcgggtgtcatggaaatcactctatgatgacgtcgacaccggtgaaaagaatctgcccgaggacgctattcacacaatgatcgagaaccttcagcccgagactaagtaccgcatctctgtgttcgccacttactcctcaggggagggcgagcctctcaccggagatgcaacaacagagctgtcacaggactctaagaccctaaaggttgacgaagagaccgaaaacaccatgagggtcacgtggaaaccagcgccaggtaaagtcgtgaactatagggtcgtttatagaccacatgggagaggaaagcagatggtggccaaggtaccaccaacagtgacttccaccgtcttaaaacggctgcagccacagacaacttatgacattaccgtgctccccatctacaaaatgggtgaggggaagctgcgacaagggagcggcacaacagcgagccgctttaagtctcctcggaacctgaagacaagcgatcccaccatgtcctccttcagagtgacttgggagcctgccccaggcgaagtaaaggggtacaaagtgacatttcaccccaccggcgatgaccggagattgggtgagctggtggtgggaccctacgacaatactgttgtgcttgaggaactgcgcgctggtacaacatacaaggtaaacgtgttcggcatgtttgacggcggagaaagttcccctctcgtcggccaggagatgacaactctgtccgataccacagttatgcctatactgagctccggcatggaatgcctcacccgggcagaggccgacatcgttttgctagtggatgggagttggtccataggccgagctaattttaggactgtgcgttcatttatttccaggatcgttgaggtatttgacatcggccctaagcgggtccagattgcgctggcccagtactccggggacccccgaaccgagtggcaacttaatgcccaccgtgataagaagtcccttctgcaggccgttgcaaacctgccatataaagggggaaacacacttaccggcatggcactgaatttcattaggcagcagaattttagaactcaggccggaatgagacctcgggctcggaaaatcggagtgctcatcactgatggcaaatctcaagatgacgtggaggccccatccaagaaattgaaggatgagggagtcgaactcttcgcgataggtatcaagaacgctgacgaagtggaattgaagatgattgcaaccgatcccgacgatactcatgcttataacgtggccgatttcgaatcattatccaggatcgtcgatgacctgactatcaacctttgtaacagcgtgaagggcccaggggatctggaggccccatccaaccttgtcatttctgagaggacccaccggtcctttcgcgtatcctggacacccccaagcgactccgtggatcgttacaaagttgagtattatcccgtgagtggaggtaagagacaggaattctacgttagtaggatggaaacgagcacagttctcaaagacctgaagccggagaccgagtacgttgtgaacgtgtacagtgtcgtagaagacgagtacagtgagcccttgaagggaacagagaagacccttccggttcccgtggtctctcttaatatctatgacgttggtccgactacgatgcacgtacaatggcagcccgtcgggggagctaccggttacatcctgagctacaagcctgtgaaagataccgaacctactagacccaaggaagtccgtctgggacctactgttaacgacatgcagctcaccgacctcgtgccaaatactgagtacgctgtaactgtacaggccgtgttgcacgacctcaccagcgagccagtgaccgtacgggaggtgaccctccctctgcctaggccacaggacctgaagctgcgcgacgtcacacactcgactatgaacgtgttttgggagcccgtgccgggaaaagtacgaaaatacatagtcaggtataagactcccgaagaggatgtcaaggaggtcgaggttgacaggagcgagactagcacatctctgaaggatctgttcagccaaacactttatactgttagcgtatcggctgtgcacgacgagggggagtccccgccagtcaccgcgcaagagaccaccagacctgtgcctgctcctactaatctgaagatcaccgaagtcacctctgaaggctttcgagggacatgggaccacggcgcatccgatgtaagtctgtaccgaatcacatgggctcccttcggatcgtcagacaaaatggagaccatactgaacggcgatgaaaatacgctggttttcgaaaacctgaaccccaataccatctacgaagtttccataacagccatatatccggatgagtccgagtcggacgacctgattggtagcgaaaggacactacccattctgaccacgcaggcccctaaaagcgggccacgaaatctccaagtgtataatgccacatcaaactctctgacagtaaagtgggatccagcatctggaagggtgcaaaaatatcggattacctaccaaccgtcaacaggagagggtaatgagcagacaactacgatcggaggcagacagaattccgttgtactgcagaaattaaaacccgataccccctatacgataaccgtgtcaagtctgtaccccgatggcgaagggggacgcatgactggtcgaggaaagacaaagccactgaacaccgttcgaaaccttagggtctatgatccaagcaccagtaccctcaacgtgcggtgggatcatgctgagggcaaccccaggcaatacaagcttttctatgctcctgctgccggaggccctgaagagttagtgccaattccaggcaatactaattacgccatcctccgaaacctccagcctgatacatcctatactgtcactgtggtgcccgtctacacagagggggacggcggaaggacttccgacactggacgcaccctgatgcgaggcctggcacgtaatgtgcaggtgtataatcccacacccaatagcctagacgtaaggtgggaccctgccccagggccagtactgcaatatcgggttgtttatagccccgttgatggtaccagaccaagtgaaagcatagtagtacccggaaatacaaggatggttcatcttgagcggctcattccagacaccctctactcggtgaatctcgtggctctgtatagcgacggagaggggaatccgtcccccgcacagggccgaactttaccaagatctggccctaggaatttgcgtgtcttcggcgagacaaccaattctttgagcgtcgcctgggaccacgccgatgggccagtacagcagtatcgtatcatctactcccccaccgtcggggaccccatcgatgagtacaccactgtacccggacgccgtaataatgtgatactgcaacctttgcagcccgatacaccctacaagattaccgtcatcgcagtgtacgaagacggcgacgggggacacctcactggcaatgggagaacagtaggcctgttgcctccacaaaatattcatattagtgacgagtggtacacccgttttcgggtgagctgggacccctcgccttcacctgttttgggttataaaattgtgtataagccagttgggtccaacgagccgatggaggcttttgtaggcgagatgacatcttacactctccataatctcaacccatccaccacatacgatgtgaacgtctatgcacaatacgattctggcttgtccgttcctctcacagatcagggtaccaccctttatcttaacgtaaccgacttaaaaacctaccaaatcggctgggatacgttctgcgtcaaatggagtccccacagagccgctacctcttaccggctaaagctcagccctgcagatggtacccgcggacaggagatcactgtgagaggatccgaaacatcccattgctttactggactgagccccgatacggattatggggtgacagtatttgtccagactcctaatctggaggggccaggcgtgagtgtgaaagagcacactacagtgaaacccacagaggccccaactgaaccccctacccccccaccaccacctaccattccacctgcaagggacgtttgcaaaggagccaaagccgacattgtgttcttaaccgatgcatcctggtcaatcggagacgataatttcaataaggtggtgaaattcatttttaacaccgtcgggggatttgacgaaatctcccctgctggcatccaagtgtcttttgtgcaatactctgatgaggtcaaatccgagttcaaacttaatacttacaacgataaagctcttgccttaggcgcactgcaaaatattagatatcggggaggcaacaccaggactggcaaggcactgaccttcattaaggaaaaagtgttaacatgggagagcggtatgaggaaaaatgtgccgaaggttctggtagtggtgactgacggaaggagtcaggacgaagtaaaaaaggccgctctggttattcagcagagcgggtttagtgtcttcgtggtgggagtggccgatgttgactataatgagttggcaaatatcgcgagcaaaccttctgaacgtcatgtgtttatcgtggatgattttgagagtttcgagaagattgaagacaacctcatcactttcgtttgcgagacagccacatctagttgcccactcatttatctggatggctacactagtcccggttttaaaatgttggaagcgtataacctgactgaaaaaaattttgctagcgtacagggggtttccctagagtccggttccttcccttcatacagtgcctatcgaatccagaagaacgcctttgtcaatcagccgacagccgacctgcatcctaatggtctgcccccttcatacaccattatcctgctgtttcggctgctgcccgagactccgtcagacccatttgccatttggcaaataaccgacagggactataagcctcaggtgggagtcattgcagatcccagcagcaagacactaagtttttttaataaggacacacgcggagaagttcagaccgtcacttttgacacagaggaggttaagacgctattctacgggtcattccataaggtgcatatcgtggtgacaagcaaatcagtgaaaatttatattgactgctacgaaatcatcgaaaaagatatcaaagaggctgggaatatcaccaccgacgggtacgagatcctgggcaaactcctgaagggggaacgtaaaagcgccgcatttcagatacagtccttcgacattgtatgcagccccgtttggacttccagggaccgatgctgcgatatcccgtctagacgcgacgaaggaaaatgccccgctttccctaacagttgcacctgcactcaggattctgtggggcctcctgggcctccgggacctgccggaggccctggggctaaaggtccgcgaggggagcggggaatttcgggcgcaatcggcccacctgggcctaggggtgacattggtcctccgggacctcagggccctccagggcctcagggccctaatggtctctcgattccaggcgagcagggtcgacagggcatgaagggagacgccggagagcccggattgccaggacggaccgggacacctggccttccgggtcctcccggaccaatggggccacctggagaccgagggtttacgggcaaagacggggcaatgggcccacggggtcctcccggtccgccaggtagtcctggatccccaggtgttactggtcccagtggtaaaccgggtaaacccggagatcatggcagacctgggcctagcggtctgaaaggtgagaaaggcgacaggggggacatcgcctcccagaacatgatgcgggcagtggccagacaggtgtgtgagcagctgatttccggccagatgaacagattcaatcaaatgctcaatcagatcccaaatgattatcagtcctccaggaatcagccgggaccccctggcccacctggcccacctggttctgccggtgccaggggcgaacctggccctggaggtcgccctggatttcctggaaccccaggcatgcaaggcccacctggagagcgcggactccctggagaaaagggcgagcgcggtaccggttctagtggtccccgtggtctgcccggaccgcctggaccccagggggagtctcggacgggtcccccaggttcgacagggagcagaggtccccctggaccacctggacgcccagggaatagtgggatcagggggccaccgggacccccagggtattgtgattccagccaatgcgcaagcattccttacaatggacagggatatccaggctctggataa

SEQ ID NO: 4791 - DNA, 5699 bp, Artificial Sequence
  Description of Artificial Sequence: Synthetic coding sequence
atgcgttcgcgcctgccacctgctctcgcagcgttaggggctgccctgctgctatcatccattgaggctgaaggaatggaatgtctaaccagagcagaggcagatattgtactgctcgtggacggctcctggagcattgggcgagcgaactttaggaccgtgcgcagtttcattagtcgtattgtggaggtgttcgacattggtccgaaacgggtgcagatcgccctcgctcagtactctggggaccccaggaccgagtggcagcttaacgctcaccgggacaaaaaatccctgttacaggccgtagctaatctgccatataagggaggtaacactctgaccggcatggcactcaactttatccgccagcagaatttcagaactcaggccggaatgaggccaagggcgcgtaagatcggcgtgcttattacagacggcaagagccaggacgacgtggaagcccctagcaagaaattaaaggatgaaggcgttgaactctttgctatcggcatcaaaaacgccgacgaggtggaattgaagatgatcgctaccgacccagatgatactcacgcctacaacgttgcagacttcgaatccttgagtagaattgtagatgacctcaccataaacctctgcaattcagtcaagggaccaggcgacttggaagcgccatccaacctggtcatttcagagcggacacacaggagtttccgagtgtcctggacccctccttctgattccgtggacaggtataaggtcgagtattacccagtgtctggcggaaaaaggcaggagttctacgtgtctagaatggaaacctccaccgtcctgaaagacttaaagcccgaaacagagtacgtggttaacgtttactccgtggtggaagacgagtactctgaacccctgaaaggcactgagaaaactctgcccgtgcctgttgtctctctgaacatctacgacgtggggcctacaaccatgcatgtgcagtggcaaccagtcgggggagccaccggctatattctcagctacaagccagttaaggacactgagcccaccaggcccaaagaggtgcggttggggccaaccgtgaacgatatgcagctcactgacctggtgcctaacaccgagtatgcagtgacggtccaggcggttcttcatgacttgacaagcgaacctgtgactgtgcgcgaggtgactctgccactccctcggccacaggatctgaagttacgagacgtcacacacagcaccatgaatgttttctgggagcccgttcctgggaaggttagaaagtatatcgtaaggtacaagacacctgaagaggatgtgaaagaggtggaggtcgatcgatctgagaccagcacttctcttaaggacctgttctctcagacactgtatactgtcagtgtcagcgcagttcacgacgagggcgaatcacctcccgtaaccgcccaggagaccactcggcctgtcccagctcccacaaatctgaaaatcaccgaggtgacttctgagggctttcgcggaacctgggatcatggcgctagcgatgtctctctctaccggatcacatgggcgccttttgggtcatctgacaaaatggagacgattttaaatggggatgagaacaccctggtattcgaaaacctgaatcccaacactatttacgaagtcagcattacggcaatataccctgatgagagcgagtcagatgacctgattgggagcgaacggacattacctatcctcacgacccaagctccaaaatccggcccacgcaatctgcaagtgtataatgccaccagcaactccctgacagtgaagtgggatcccgcatctggacgagtgcaaaagtatcggattacctaccagcccagcaccggtgagggcaacgagcagactactactatcggcggacgacaaaacagtgtagtgctccagaagctgaaacctgacacaccctacacaataaccgtgtcatccctttatccagatggagaaggcggacgcatgactggccgtggaaagacgaaacccctgaacactgttcgcaaccttagagtgtacgatccgagcaccagtaccctgaacgtgagatgggatcacgcggagggcaatcctaggcaatataaactgttctacgcacccgcagcagggggacccgaggagctggtgccaataccaggcaatacaaattatgctattttaaggaatttacagcctgacacctcctataccgtcaccgttgtgcctgtatacaccgagggggacggaggccgtacaagcgataccggaagaactctgatgagaggcttagctcgcaacgtccaggtttacaatcctacaccaaacagtctggatgtgcggtgggatcccgcaccaggcccagttttgcagtaccgggtagtctactcacccgtcgatggaaccaggccatccgagtccattgtcgtccctgggaatacacggatggtacatctggagcgcctgatcccagatacgctgtattctgtaaacctggtggccctctactccgatggcgagggtaatccctctccggctcagggacggactctgcccagatcaggacctagaaaccttcgtgtattcggcgagaccaccaacagcctgagcgttgcctgggaccacgccgatggacccgtccaacagtaccgaattatatattctcccactgtgggtgacccaatcgatgagtacaccacggttcctgggaggcgcaataacgtaatcctacagccgctccagcctgatactccctataaaattaccgtgattgctgtgtacgaggatggggatggcggtcatttaactggaaacggtcgtactgtcggcctgctccctccacagaatatccatataagtgacgaatggtacacccgcttcagagtgtcttgggatcccagtccaagccccgtcctggggtacaaaatcgtctacaaaccagtgggtagcaatgaaccgatggaggccttcgttggggagatgacctcttataccctacataaccttaacccttctacgacctatgacgtgaatgtgtatgctcagtacgactctggactaagcgtcccgctaactgaccagggtaccaccctatacctcaatgtcaccgatcttaaaacctatcaaattggttgggataccttctgtgtgaaatggagcccacatagggcagccaccagctacagattaaagttgagccccgcagacggtacccgcggacaggagatcaccgtccgtggaagtgagaccagccattgttttactggcctgtcacccgataccgactacggtgtgacagtcttcgtacaaacacctaaccttgagggccctggcgtgagtgtgaaggagcacacaacagtgaagccaacagaagctcctaccgagccccctaccccacctcctccaccgaccatcccacctgctagggatgtgtgtaagggagcaaaggcggatatagttttcctgaccgatgcttcttggtccataggggatgacaatttcaataaggtggttaagtttatatttaacaccgtgggaggctttgacgagattagtcccgctggaatccaggtctccttcgtacagtatagtgacgaagtgaaatccgagtttaaactgaatacttacaacgacaaagcacttgctcttggagccctccaaaacatccggtaccgaggcggaaatacaagaacaggcaaagcattgactttcatcaaagagaaggtcttgacttgggaatcgggcatgcgaaagaacgtccctaaggtgttagtagttgtgaccgacgggagatcccaggatgaagtcaaaaaggccgcacttgttatacagcagagtgggttctctgtctttgtcgttggtgtcgccgatgtggattataacgagctcgccaacattgcatcgaagccaagcgaaagacacgttttcatcgttgatgacttcgagagttttgaaaagattgaggataatctcatcacattcgtttgtgaaactgcgacctcatcatgcccgcttatatatttggacggctataccagtcctggattcaaaatgctggaagcctataacttaacagagaaaaatttcgctagtgtgcagggcgtgtctttggagagtgggtccttcccatcctactctgcgtacaggattcaaaaaaacgctttcgtgaaccaaccaacagcagacttgcaccccaacggactgcccccttcttatacaattatactgctgtttaggctactccccgaaactccctccgacccatttgcaatttggcagatcaccgacagagactataagccacaggtcggcgtgatcgcagatccttcttcgaagactctttcattcttcaacaaggatacaagaggagaggttcagaccgtgactttcgataccgaggaggttaaaacactgttctatggctcgtttcacaaagtgcacattgtcgttactagtaaatcagttaaaatctatatcgactgctatgagattatcgaaaaggacatcaaggaggctggaaacataacaactgatggctatgagatcctcgggaagctcctgaagggggaaagaaaaagtgccgcttttcagatccagtctttcgacatcgtgtgctctccggtgtggaccagtcgggatagatgctgtgacataccttcccgcagagacgagggtaagtgcccagcctttcccaacagctgcacatgcacccaagacagtgtcggccctccgggacctccagggcctgccggtggtcctggcgcaaaaggtcctaggggcgagcggggtatctctggtgccattggcccaccgggacccaggggcgatatcggtccacccggaccacaggggccacctggccctcaagggccaaatggcctgtcaatcccgggagagcagggcagacagggtatgaagggggacgctggtgaaccgggacttcccggaaggaccggcacaccaggcctaccaggtcccccaggcccaatgggtcccccaggcgacagaggcttcaccgggaaggatggtgccatgggcccaaggggaccacccggaccccctggtagccctgggtcacctggagtgacagggccatccggaaaaccagggaagcccggtgaccacgggagacccggtccttccggcttgaaaggagagaaaggcgaccggggagacattgccagccagaatatgatgcgggcagttgctagacaagtctgcgaacaactcatctcaggccaaatgaatcgttttaatcagatgctgaaccaaatccctaacgattaccaatcttcaagaaaccagcccggacctcccggtcccccaggtcctcctggatccgcaggcgcaagaggtgaacccggaccagggggtcggccaggctttcctgggactcctggcatgcaggggccacctggcgaaagaggcctacctggtgagaaaggggaacggggtacaggatcctcaggcccacggggactcccaggcccaccgggtcctcagggcgagtccagaaccggaccccctgggtctactggatccagggggccacctggtcctccaggacgccctggaaacagcggaatacggggaccccctgggccacctggttattgcgattcgtctcagtgtgcatcaatcccttacaacggtcagggttaccccggttccggcta

SEQ ID NO: 4792 - DNA, 8964 bp, Artificial Sequence
  Description of Artificial Sequence: Synthetic coding sequence
atgaggagccggcttcctcctgcactagctgctctaggagccgctctgctgctgagctccatcgaagcggaagtggatcctcctagcgacctgaacttcaaaatcattgatgagaatacagtgcacatgagctgggccaagcccgtcgatccaattgtggggtacagaatcacggtggacccaaccacagacgggccaactaaagaatttactctcagtgcttccactaccgaaacgttgctgtccgaactcgtgcccgagaccgagtatgtggtcacaataacgtcttatgacgaagtggaggaatctgttcctgtaatcggccaacttaccatccagaccggctcttctaccaagcctgtcgagaaaaagccaggcaaaaccgagatacaaaagtgctcagtatcagcatggacagacttggtttttctggtggacggctcctggtctgtgggacggaacaattttaaatacattctggacttcatagccgcacttgtttctgctttcgatatcggagaagaaaaaactcgggtaggagtcgtccagtatagtagcgacacccggactgaattcaatctaaatcaatactatcagcgagacgagctactcgccgctatcaaaaagatcccctacaagggcggaaacaccatgaccggagacgctatcgattacttagtgaagaacaccttcactgaatccgctggagctagagtggggtttcctaaggtagctattattatcactgatggcaaatcccaggacgaggtggagatccctgctcgagaactcaggaacgttggtgtcgaagtattttcccttggcatcaaggccgctgacgccaaggaattgaaacagatcgctagcacccctagtttgaatcatgtgttcaacgttgctaacttcgatgccatcgtggacatccaaaacgagattatctcacaggtttgttctggtgtggatgaacagttgggcgagctcgtctctggggaagaagtcgtagagcccccttctaacctgattgctatggaagtctcctctaagtatgtcaagctcaactggaatccatctccgtcacctgtaacgggatataaggtcatcctgacaccaatgaccgcagggtcccgccagcatgctctatctgttggcccacagacaactacactgtctgtacgggatctgagcgccgacacagagtatcagatttcggtatctgcaatgaagggcatgacctcatctgagccaatctccatcatggagaagacacagcctatgaaagtccaagtggagtgtagtagaggcgtcgacatcaaggctgatattgtgttcctagtggatggctcctactcaatcgggattgccaatttcgttaaagttcgggcattccttgaggtcctggtgaaatcttttgagattagcccaaaccgagtccagatctctctggtccagtatagtcgcgacccccacactgagtttacactcaagaagttcaccaaggtagaggatatcatcgaggccatcaataccttcccatatagaggagggtctaccaacaccggtaaagcaatgacgtatgtgcgagagaaaattttcgtcccgagcaagggttctaggtcaaacgttcccaaagtgatgattctcattactgatggcaaaagctcagacgccttccgggaccctgctattaaactacggaactcggacgtggagatcttcgccgtgggcgtgaaagatgccgtccgctccgagttggaggctatagcctcccctcctgctgaaactcatgtctttaccgtcgaggattttgatgcgttccaaaggatttctttcgaactcacccagtctatctgcttacgcatcgaacaagagctggccgctattaagaagaaggcgtacgtacctcctaaggatttgtcttttagtgaggttacatcctatggttttaagaccaactggtctcccgctggcgagaacgtgttcagctatcacatcacttacaaagaagccgctggcgatgacgaggtgacagtcgttgagccagctagctctacaagtgtcgtactgtcttctctgaagcctgaaacattataccttgttaatgtgacagcagaatacgaagatggattttctattccactggccggagaggagacgaccgaggaagtaaagggggcaccccgtaatctcaaggttacagatgagacaactgattccttcaaaattacttggacccaggcgccaggaagagtcctgcgttaccgaattatctaccggcctgtcgccggaggcgaatcccgagaagttactactccaccaaaccagcggagaagaactttagagaaccttattccagacactaagtatgaggtgtccgtcataccagagtacttttcaggaccaggaaccccccttaccggcaacgccgcaactgaagaagtgcgcggtaatcctcgggatttgcgagtgtccgaccccaccacgtccacgatgaaactcagttggtctggggctccaggaaaggttaaacagtatttggtgacttatacacccgtggccggtggtgagacccaggaggtaacagtgcgaggggacactactaataccgttctgcagggactaaaagaaggcacacagtacgcattgtcggtcactgcgctgtatgcctctggtgcaggagatgctctgttcggagaaggaacaactttggaagagcgcggttctccacaagatctcgtgacgaaagatatcactgacaccagtatcggcgcatattggacttcggctccagggatggtccgcggatatcgagtgtcgtggaagtcgttatatgatgacgttgacaccggcgaaaagaacctccctgaggacgctattcatactatgatagagaacctgcagccagagactaagtatcgtattagcgtctttgcgacgtattcttctggcgaaggggagcccctcactggcgatgccaccacagaactcagtcaagacagcaaaactctaaaggtggacgaagagaccgaaaataccatgcgggtgacttggaagcccgcaccgggaaaggtcgtaaactatcgcgttgtctacaggccccacggtcgcggaaaacaaatggtagccaaagttccaccaacagtcacttctactgtacttaaaagattgcagcctcagaccacttacgacatcaccgtattgcccatatataaaatgggtgagggcaaactgagacagggcagcggaacgaccgcctccaggttcaaatccccccgaaacttgaagacttctgaccctaccatgtcctcctttagggtgacgtgggagccagcaccaggggaggtgaagggctacaaggtgaccttccatcctaccggagatgacagaaggctgggagaactggtggttggaccttacgataatacagtggtcctggaggagttgagggccggtacaacatacaaggtgaacgtttttgggatgttcgatggcggagagagcagtccactagttgggcaggaaatgacaaccttaagcgatactacagttatgcctatcctgtcaagtggtatggagtgcctcaccagggcggaagccgacattgtgctcctggtggacggctcatggtcgattggcagagcaaacttccgtaccgttagatcctttataagtcgcatcgttgaagtctttgacattggtccaaagagagtgcaaattgccctggctcagtattccggagaccccaggactgagtggcaactgaacgcccaccgagataaaaagagcctcctgcaggctgtggctaacctgccatacaaaggaggaaatacacttaccgggatggccttgaacttcattcgacaacagaacttcaggacgcaagcaggcatgaggcctagagctcgcaagatcggagtcctgatcacagacggcaagtcccaggatgacgttgaggcccctagtaaaaagttaaaggatgagggtgtggagctgttcgccatcggaattaagaacgcagacgaagtggaactaaagatgatcgcaacagatcctgacgatactcacgcttataacgtggccgacttcgaaagcctgagccggatcgtagatgatctcacgataaacctctgtaacagcgtgaaaggcccaggggacctggaggccccatctaatcttgtgatctcggagagaacccatcggtcatttcgggtctcatggaccccaccaagtgatagtgtagaccgctacaaagtggagtactacccagtgtcaggaggcaagcgccaggagttttacgtgtctaggatggagacatccacagtgctcaaggatctcaagccagaaaccgagtatgttgtcaatgtgtacagtgtcgtggaagacgaatactctgagccccttaaggggaccgagaaaaccctgccagtgcccgtggtgtccctcaatatttacgacgtcgggccaacaacaatgcatgtccagtggcagcccgtcggcggtgcaaccggttacatcttaagttacaagccagtgaaggacaccgaacccacgcggcctaaggaagtcaggctcggtcccactgttaatgatatgcaactcactgacctcgttcccaacactgaatatgcggtgaccgtgcaagctgtcctgcacgatctgacctccgaaccagtgaccgtccgagaagtgaccttacccttgccaaggccacaagacctgaaacttcgggatgttacacatagcactatgaacgtgttctgggagccagtgcccggaaaggtgcgaaagtacatagtgaggtacaagaccccggaggaagatgttaaagaagtagaggtcgacaggtccgagacctccacgtccttgaaggatcttttctctcagaccttatacaccgtgagtgttagcgccgtccatgacgagggcgagtctcccccagtcaccgctcaggagaccacccgcccagtgcccgctcccacaaatcttaaaataactgaggtgacatcagagggatttagggggacctgggaccatggcgcatctgatgtttcactgtaccggatcacctgggcgccttttggcagctcggataagatggagactatcctcaacggagacgagaatactctcgttttcgagaacctgaatcccaataccatttatgaagtctctattaccgcgatttaccctgatgaatctgagagcgatgatcttatcggatccgagcgcactttgcccatactaactacacaagccccaaaaagcggcccacggaatcttcaagtatacaatgccacatcaaactcattgaccgtgaagtgggaccccgcatccggcagggtgcagaaatatcgaatcacttatcaaccatccaccggcgaaggcaacgagcagaccacaactatagggggacgtcagaactcagtggtgctgcagaaactgaagcccgacacaccctatacgataacggtgtctagtctttatcctgatggtgagggcggtcggatgactgggaggggaaagacgaagccacttaacactgtgcgcaacctgagagtttatgatccatctacaagcaccctgaacgtgcgctgggatcacgcagaagggaacccccgacaatacaaattattttatgctcccgcagccggtggacctgaggagttggtcccaatacccggtaacacgaattacgccattttaaggaaccttcaacctgatacgagctatactgtgactgtggttccagtgtacaccgagggagacggcggacgtaccagcgatactggaaggaccctcatgcgcggactcgccagaaatgtgcaggtctacaaccccacgccaaatagcctggatgtcaggtgggacccagccccaggcccagtgctgcaatacagagttgtttatagtcccgtcgacggcactcgaccttccgagtctattgttgtccccggaaatactaggatggtccacctggagcgtttgatccccgataccctgtactctgtgaacctggtggcactctactccgatggggaagggaaccccagcccagcacagggcaggactttgcctaggtcagggccaagaaacctcagagtgttcggggaaactacgaattctttgagcgtggcttgggatcacgctgatggcccagtgcaacagtacaggataatctactcaccaacagttggagaccccatcgatgagtataccaccgtccctgggagaaggaacaatgtaattctgcagccgttgcaaccagacacaccttacaaaatcacggttatcgcagtatatgaggacggggatggcggacacttgactggcaatggacgaacagtcgggctgctgcctccccagaacatccacatatctgacgaatggtatacccgctttcgggtcagttgggatccgtcccctagtcctgttctgggctataagatagtgtacaagcccgtcgggagcaatgagcctatggaagcattcgtcggagaaatgacttcctacaccctgcacaaccttaatccttccacaacatatgacgtgaatgtttacgctcagtacgacagtgggctctctgtgcccctcaccgaccagggcacgaccctgtaccttaacgtgacggatctcaagacctaccagattggatgggatactttctgtgtgaaatggtcgccgcaccgagcagctacaagttatcgcctcaagttgagcccagcagatgggacccgaggacaagagataaccgtgcgcggtagtgagacaagccattgttttaccggtctctctcctgacacagactatggagtcaccgtgtttgtccagactcctaaccttgaggggcctggagtctccgtaaaggaacatacaactgtcaaaccaacagaggctcccactgaaccgccaactcctccaccccctcccacaatccctccagcaagggatgtgtgtaaaggggcaaaggccgatattgtgttcctcaccgatgcctcctggtccataggcgacgataatttcaacaaagtagttaagttcatatttaacacggttggcggtttcgatgagattagcccagctggtatccaggtgagctttgtccagtattccgatgaggtaaaaagcgaatttaagcttaatacgtataatgataaggctttggcactgggagccctacagaatatccgatatcgcggtggaaataccaggacaggaaaggccttaaccttcatcaaggaaaaggtgttgacctgggagtcaggtatgagaaaaaacgtgcctaaagtgcttgttgttgttacagacggtaggtcacaggatgaggtcaagaaagccgctctggtgattcagcagagcggattcagtgtgtttgtagttggagttgcagacgttgactataatgaattggcaaatattgctagtaagcccagcgagcgccacgtctttatagttgatgatttcgaaagttttgaaaagatcgaagataatctcataacttttgtttgtgagaccgccactagcagctgtccactgatatatctggacggatacacaagcccaggctttaaaatgctggaggcttataacttgactgagaagaattttgcgtctgtgcagggggtaagcctcgagtcgggaagcttcccctcctattccgcttacaggatacaaaagaacgcttttgttaatcagccaacagctgacctgcatccgaatggactcccacccagctatacaatcatccttctgttcaggctgttgcccgaaactccctcagatccattcgccatatggcagatcaccgatcgagactataaacctcaagtgggcgtgatagccgacccatccagtaagacactgtcttttttcaacaaagacacccggggtgaggtccaaacagtcaccttcgacacagaagaagtcaagactctattttacggctcgttccacaagagagatgaaggcaaatgtcctgcttttccaaattcgtgcacctgtacccaggatagcgtcggacctccaggccctcctggccctgcagggggacccggagcaaaaggaccacgcggagaacgcggaatctccggagccattgggcctcctggccctagaggggacattggacctccgggacctcagggtccacccggaccgcaggggccaaatgggctgagcattcctggcgagcagggcaggcaaggaatgaaaggtgatgcgggtgagcctggactccctggcagaacaggcacccctgggttgcctggccctcctggaccaatgggtcctcccggagacagaggctttacagggaaggacggggctatggggccaagggggcctcctggtcccccaggcagtccaggatctccaggtgtaaccggccctagcggcaagccaggcaagcctggcgaccacggcagaccaggtccatccggactgaaaggcgagaagggtgatcgcggtgatatcgctagtcaaaatatgatgagggccgtagcccgtcaggtatgtgagcagctgatctccggccagatgaacagatttaaccagatgcttaaccaaattcccaacgattatcagtcatctaggaaccaacccggtcctcctggaccaccgggacctcccggaagtgccggagctagaggagagccgggaccaggaggacggcctgggttcccagggaccccaggcatgcaaggaccgccaggcgagcgagggctgcccggtgaaaagggagaaagaggcacagggtccagcggccctcggggactgcctggacctcctgggcctcagggtgagagtcggacgggacccccaggcagtactgggtcacgtgggcctccaggacccccagggaggccaggtaacagtgggataaggggccctccaggaccgccaggctactgtgacagtagccagtgtgcttccattccttacaatggccagggttaccccggttcgggttac

SEQ ID NO: 4793 - DNA, 2088 bp, Artificial Sequence
  Description of Artificial Sequence: Synthetic coding sequence
atggtggccgaacggactcataaagcagccgctacgggtgcacgcggtccaggggagctcggggcacccggaaccgtggccctggtagctgctagggccgagaggggcgctaggctcccctcacccggaagctgtggcctactcactctcgctttatgctctctggctctgtcacttttggcacatttccggactgccgagctgcaggccagggttctccgacttgaagcagagagaggcgagcagcagatggagaccgcaattcttggtagagttaaccagctgctggacgagaagtggaagttacactctaggcgcaggagggaagcccctaaaacaagcccaggctgcaactgtccacccggtcccccaggaccaactgggaggcctgggttgcctggggataagggcgctatcggaatgcccggtcgggtcggaagcccaggtgacgccggtctcagcattatcggtcccaggggtccccctggacagccaggaaccagaggttttccaggcttccccggtcccatcggcttggatgggaaaccaggccaccccggtcctaaaggcgatatgggtctcaccgggcctcccggacagcctggaccacaaggacaaaagggagagaaaggccagtgcggagaataccctcatcgggaatgtttaagcagtatgcccgcagcccttcgaagctctcagatcatagctctcaagggggagcaatcacaggcgagtattcaagggcctcccggtcctccaggccctccgggacctagcggcccactggggcatcctggcctcccgggaccaatgggcccacccggactcccaggccctcctggaccaaaaggagatcccggaatccagggatatcatgggcgaaaaggagagaggggaatgcccggaatgcctggtaagcacggcgcaaagggagcccctggcatcgccgttgccggtatgaagggcgaaccagggatccccggaaccaagggcgagaaaggagctgaagggtcccccggactgcctggattgttggggcagaaaggggagaaaggagatgcaggcaacagcatcgggggtggcagaggcgaaccagggcctccgggtctgccaggcccacccggaccaaagggtgaagctggggttgatggccaagtgggaccgcctggtcagccaggagacaagggggaaaggggcgctgcgggagaacagggacctgacgggcctaaaggttctaagggcgaacccggtaagggggagatggttgattataacggtaacataaatgaggctctccaggagataagaacgctagcgctgatgggaccacctggcctgcctggccagataggcccaccaggcgcacctgggattcctggtcagaaaggcgagattggcctgccaggtcccccaggccacgacggcgagaaagggccaagaggcaagccgggagatatggggccaccgggaccccagggtccgccaggtaaagacggacctcctggagttaagggcgagaatggccaccccggatcacctggcgagaaaggggagaagggagagaccggacaggccggatcaccgggagagaagggagaggctggcgaaaagggcaacccgggagcagaggtgcccggactgcctggccctgaaggacccccaggaccacccggacttcagggagtacccggacctaaaggcgaagctggattagacggtgcaaagggtgaaaagggctttcagggagagaagggggatcgaggcccactaggtctccctggtgccagcggactggacggtaggcccggtccaccaggaacgcctggacctattggcgtaccgggaccagcgggaccgaagggcgagcggggaagtaagggcgaccccggaatgacgggcccaaccggagcagcagggctccccggtctgcacggcccacccggagataagggtaatagaggtgagcggggaaagaaggggtctcggggacctaagggagataaaggcgatcagggcgcacccggtctggatgctccttgtcccctaggcgaagacggtttgccagtgcaggggtgctggaataagtag

SEQ ID NO: 4794 - DNA, 2154 bp, Artificial Sequence
  Description of Artificial Sequence: Synthetic coding sequence
atggtggctgagaggacgcacaaggctgccgcaaccggggcaaggggaccaggggagcttggtgcgcctgggacagttgccctggtggcagctagggccgagagaggagccagattgccttcccccggaagctgcggcctgctgacactcgccctgtgtagcctggcactgagcctcctggcgcacttccgcactgccgagctccaggccagagtcctgagactggaggccgaacggggagagcagcaaatggagaccgcaatcctgggcagagtaaatcagctcttggacgaaaagtggaaattgcactcccggcgaagaagagaagcacctaaaacctcgcccggatgtaattgtccgccagcatttcaggggcctaccgggaggccaggccttcctggagataagggggctattggaatgcccggacgggtcggctctccaggtgacgccggactaagcatcatcggccctcggggaccccctggacaacctggcacccgtggatttccaggcttcccgggtcccatcgggctggatgggaagcctggtcaccccggaccaaagggagatatgggacttaccggcccacctggtcagcctggcccacagggtcagaagggcgaaaagggacagtgtggggagtaccctcaccgggagtgcctgtcttccatgccggcagccctgcgttcatcgcagattatcgccctgaagttgcttcctctcttaaacagcgttcggcttgctccgccaccagtcattaagcgcagaacctttcaaggggagcagtcacaggcgtccatccagggtcccccaggtccccctgggcctccaggaccttcaggaccactgggccatcctgggctccctggaccaatggggcctcctggtttgcccggacccccaggcccaaaaggggatccgggtatacagggttaccacggaaggaaaggggaacggggtatgcctggcatgcccggaaaacacggcgctaaaggtgcccctggcattgccgtggccggtatgaagggtgagcccggaattcccggaacaaaaggagagaagggtgctgagggaagtcctggactgcctggccttcttgggcaaaagggcgaaaagggagatgcgggtaacagcattggaggcggacggggtgaaccaggcccacccggactgcccggtcctccagggccaaaaggggaggcaggcgtggatggccaggtgggcccaccagggcagccgggagacaagggcgaacgcggagcagccggagagcaggggccagatggtcctaagggctccaaaggcgaaccaggcaagggagagatggtggactacaatggtaatataaatgaagctctgcaggagatcaggaccctagctctgatgggccctcctgggctaccagggcagattggcccacccggagccccaggcatccccggtcagaagggtgagatcggactgcctggaccgccaggtcatgacggagagaagggccctcgaggaaaaccaggcgatatggggccaccaggcccacaaggtcctccagggaaagatggccctcccggagtcaaaggggaaaacgggcatccaggcagtccgggagaaaaaggcgaaaagggagaaacaggacaggctgggtcccccggagagaaaggggaagcaggggaaaagggtaatcctggtgctgaggtgccgggacttcccggtccagagggtcctccaggaccccctgggttgcagggcgtgcctggtcctaagggggaggcaggactggatggtgcaaagggggaaaaaggcttccaaggggagaagggagaccggggacctttgggtctaccgggtgctagcggcctggatggcaggccaggacctcccggaacacctggccctatcggcgtacctgggccagccggacccaagggtgaaagaggatccaaaggagatcctggtatgaccggtcccacgggagctgcaggtttacccggtctgcacgggccacccggagataagggaaacaggggggagagaggcaagaagggatccaggggccctaagggcgataagggtgaccagggagcgcctggattggacgccccttgccccttaggcgaggacggcctgcccgtccagggctgctggaacaaatag

SEQ ID NO: 4795 - DNA, 2052 bp, Artificial Sequence
  Description of Artificial Sequence: Synthetic coding sequence
atggtggcagaaaggacccacaaggcagccgctactggtgcgagaggcccaggcgagttgggcgctccgggtactgtggctctagtggcggcaagggccgaacgcggtgcaaggttaccaagccccggtagctgtgggttgcttacactcgcactgtgcagcctggcactaagccttctggcccatttcaggaccgccgagctgcaagctcgagtgctgaggctggaggcagaacgcggagaacagcagatggagaccgcgattctcggtcgagttaaccagttgctggacgagaaatggaagctccactcaagacgacggcgagaggcccctaagacttcccctggatgcaactgtccccctggccctcccggaccaaccggccgaccagggttacccggagacaagggtgcaatcggcatgcccggacgcgtgggatccccaggagatgctggccttagtatcattgggcctagggggcctccagggcagcccggtaccaggggattccctggcttcccgggtccaatcggtcttgacggaaagccaggtcaccctggacccaaaggagatatgggcctaactgggccaccaggacagccagggccacagggccagaagggagaaaagggccagtgcggcgaatacccccatcgggagtgtctttccagtatgccggctgccctccgatcgtctcaaatcattgctcttaagggagaacagtctcaggctagtattcagggtccaccaggacctccaggcccacctgggccttcaggacccctgggacaccctggtcttccaggccctatgggtccccctgggctgccaggccctcctgggcctaagggtgaccctggaatccagggttaccacggcagaaagggcgaaaggggaatgccaggcatgcctggcaagcacggagccaagggcgctcctggtatagctgtggccggaatgaaaggagaacccggtatcccgggtacgaagggggagaagggcgctgaggggtcccccggtcttcccggtctgttgggacagaagggtgaaaaaggtgacgccggaaattccataggcggtggaagaggggagcctggcccaccaggcctcccgggacctcccggtccaaagggagaggccggagtggacggtcaagtgggacctcccggtcagcctggggacaagggcgagaggggggctgcgggagagcagggccctgatggaccaaagggttcaaagggagagccaggcaagggtgaaatggtggactacaatgggaacataaatgaagcccttcaggagatccggactttagcgttgatggggccacctgggcttcctggacaaataggcccaccgggagctcccggtattcctgggcagaagggagagattggactcccaggtcccccagggcatgatggagagaagggaccccgaggtaaacccggtgatatgggaccacctggccctcagggcccaccaggcaaggacgggccaccgggagtaaagggagagaacggccacccaggctcccccggtgagaagggcgaaaaaggcgagacaggacaggctggttccccaggagagaagggcgaggctggggagaagggcaaccctggcgcagaggttcctggactcccgggacccgagggacccccaggccctcctgggcttcagggcgtgccaggcccaaaaggcgaagcaggtctggacggagcaaaaggcgagaaaggattccagggcgagaagggcgaccggggacctttgggtctgcctggtacaccagggccaattggggtgccaggccctgcaggtccaaaaggtgaaagagggagtaaaggggaccctggtatgactggcccaaccggggctgcgggacttcccggtctgcatgggcctccaggtgacaagggcaaccgcggagaaagagggaagaaaggatcgaggggcccaaagggagataagggcgaccaaggcgctcctgggctggacgcaccatgcccgttgggcgaggacgggctgcccgtgcaaggatgctggaataaatag

SEQ ID NO: 4796 - DNA, 2067 bp, Artificial Sequence
  Description of Artificial Sequence: Synthetic coding sequence
atggtggctgaacgaacgcacaaggcggctgctaccggtgcacgcggtccaggagagctgggcgctccagggacagtcgccctcgtcgccgctcgggcagagcgcggagcgagactgccctcacccggttcctgcgggctgctcacccttgcactctgctctcttgccttgtctctgcttgcccacttccggacggccgagctgcaggctcgggtgctccgccttgaagcagagcggggtgagcaacagatggaaaccgctatcctaggccgagtgaatcagctcctggatgaaaaatggaaattgcactccaggagacggagagaggcacccaaaacgagcccaggttgcaactgccctccagccttccagggacctaccggtaggccgggtctcccaggacagccagggacacgaggctttcctggattcccgggacccatcggcctcgatggaaagcccggacacccagggccaaaaggtgatatgggcctgaccggacctccaggccagcccggaccccaagggcagaaaggggaaaaaggtcagtgcggggaatatccacatcgtgaatgtctgtcatctatgcccgctgccctgcgttcaagccagataatagcactgaaactgctgccgctcctgaattctgtcagactcgcacctccaccagttatcaagcgaagaaccttccaaggcgaacaaagccaagcctctatccaagggcctcctggtccgccaggcccaccaggtccgtctggccctctgggccaccctgggctcccgggtccgatgggtccacccggacttccagggccacctggacctaaaggtgacccgggaattcaggggtatcatggcaggaagggcgagcgcggtatgccagggatgcctgggaagcacggcgctaaaggcgcacctgggatagccgtagctggaatgaagggcgagccaggcattccgggaacaaaaggggaaaagggcgcagaaggctcacctggactccccggactgctcggacagaaaggggaaaaaggcgacgctggcaactcgatcggagggggacgcggagagcccggacctccaggcctgccaggacccccaggccctaagggcgaagcaggcgtggacgggcaggttggccctccaggccagcccggagacaagggagagcgtggagctgccggagaacaggggccagacggtccaaaaggctctaaaggcgagccgggaaaaggagagatggtggactataatggaaacatcaacgaggcactccaagaaatcaggaccctggctttgatgggacccccagggctccccggtcagatcggacccccaggggctccaggaatccccggacagaaaggcgagattggcctgcccggacccccaggtcatgatggggagaaagggccaagaggaaaacccggtgacatgggaccgcctggcccacagggacccccaggcaaggacggcccacctggcgtgaaaggagagaacggccatcccggtagtccaggcgagaagggggaaaaaggggagaccggccaagccggatctcccggagaaaagggggaggccggagagaagggcaatcccggagccgaggtcccaggattgcccggtcctgaaggtccccctggcccaccaggcctccagggtgtgccaggtcctaagggtgaggcgggtctggacggggcaaaaggcgagaaaggatttcagggagagaagggcgaccggggaccccttgggcttcccggagcttctggtctggatggcagacccggaccgcctgggacgcccggtcccataggtgtacccggaccagccggacccaaaggcgagcgcggttccaaaggcgatcccggaatgaccggccctaccggtgccgctggcttgcccggactgcacggcccaccaggggacaaaggaaacaggggggagaggggaaaaaagggtagccggggaccgaaaggagataagggagaccagggggcacccggactcgatgccccatgccccctgggagaagacggtctgcccgtgcaaggctgctggaataagtag

SEQ ID NO: 4797 - DNA, 2088 bp, Artificial Sequence
  Description of Artificial Sequence: Synthetic coding sequence
atggtagccgagaggacccataaagccgcagccacaggtgcacgcggtccaggggagctgggggctccagggaccgtggcactcgtagccgcacgcgcagagcgaggagcgcgactgcctagtccaggctcatgcggacttctgactctcgcactgtgctcactagctttatcactgcttgcacatttcagaacggcagagctgcaggcccgtgttctgcgactggaggccgagcggggtgaacagcagatggaaacagctatactaggacgggttaaccagctgctggacgagaaatggaagctccattctagaagacggcgagaggcgcctaagacgtcccctggatgtaactgtcctccagcctttcagggaccgacgggaaggcctggactgcctggggataagggagcaattgggatgcccggacgggtgggctcccctggggatgctgggttgtccattataggacctcgcggaccccctggacagcctggtactagagggttcccagggttcccagggcctatcggtctggacggcaaaccagggcacccagggcctaaaggagatatgggcctgacaggtccacctgggcagccgggaccccagggccagaagggggagaagggccagtgcggcgagtatccacacagagaatgccttagtagcatgccagccgctctgcggagctcacagatcatcgccctgaagggagaacaatcgcaggcttctatccagggcccaccgggacctcccggaccccctggaccctccggcccactaggccatcctggacttcctgggcctatgggtccaccagggctaccaggacctccgggtcccaaaggagatcccggaatccagggctatcatggccgaaagggtgagcgcggaatgcccggaatgcctgggaaacatggagccaagggcgcacctggaattgccgtcgcaggaatgaagggcgagcctgggattccaggcacaaagggagagaagggtgctgaaggatccccagggttgcctggcctactgggacagaagggggaaaagggggatgctgggaattccattggcggaggcagaggggagcccggtcctcctggactgccgggaccacctggccctaagggcgaagcaggagtggacggacaggtgggtccaccaggtcagccaggtgacaagggtgaaaggggggctgccggagagcagggacctgacggacctaaggggagcaaaggagagcctggaaagggagaaatggtggactacaacggcaacatcaatgaggccctgcaggagatcagaactctggctctgatgggccctcctggcctgcctggacagatcggccctcctggcgctcccggaataccaggtcagaagggggaaatcgggctgcccggacccccagggcatgatggcgagaagggaccacggggtaagcctggggacatgggtcctcccggtcctcagggcccacccggtaaggatggccctccaggcgtgaagggtgaaaacgggcatcccggtagccctggggagaagggcgagaagggagagactggccaagccggatctccaggagagaagggggaagcgggagagaaggggaacccaggggctgaagtacccggactgcccggacccgaggggcctcctggcccaccaggactgcagggagtgccgggaccaaagggagaggccggactcgatggtgcaaagggcgagaagggcttccagggtgaaaagggagacagaggaccccttgggctgcctggtgcatcaggccttgatggtagacccggtcccccaggaacccctgggcctattggagtgcctggaccagcaggcccaaaaggggaaagaggttccaaaggggatcctgggatgacggggccaacaggggctgctggcctgcctggcctgcatggaccaccaggggacaaaggcaatcgcggagagcgcggaaagaaggggtcacgcggacccaaaggcgataaaggagatcagggcgctccaggcttggatgcgccttgtccactgggagaagatggtcttcctgtgcaaggatgttggaacaaatag

SEQ ID NO: 4798 - DNA, 2097 bp, Artificial Sequence
  Description of Artificial Sequence: Synthetic coding sequence
atggtagctgagcgaactcacaaggcagctgcgacgggcgcaaggggtcctggagaactcggggcaccaggaaccgtggcactggtggccgcacgagctgaacgaggcgctcggttgccatcaccaggctcttgtggcctgctcacgttggccctttgttcactcgcactctcactcctcgctcacttccgaactgctgagttgcaggcacgagtactgaggctggaggccgagcgaggcgagcagcagatggaaactgctattctcggtcgagtgaatcagttgctcgatgagaagtggaagttacactctagaagacgtagggaggctccaaaaacttcccccggatgtaattgccccccagccttccaagggcctactgggaggccaggcttgcccggagacaagggtgccattgggatgccgggacgagtgggatccccaggagacgccggactgagtattattgggccacgaggccctccagggcagcccggaacaagaggtttcccaggattccccggacccattggcctcgatggtaagcctggccaccctgggccaaagggcgacatgggcctgacagggccaccaggacaacccggacctcaggggcagaagggggagaagggccaatgtggagaatacccacacagactactgccattattgaattccgtgcgcctagcaccaccccctgttattaagcgtagaactttccaaggtgaacagagtcaggcatccatacaaggccctcctggcccaccaggtccgcctggtccctcaggccctctgggccatcccggacttcccggtccaatgggacctcccggtctgcctggccctcctggccctaagggtgaccccggaatccagggctaccatggtcgaaagggagagcgtggaatgccaggtatgcccggtaagcacggcgctaagggggcacctgggattgctgtcgcaggcatgaagggagagcccggtattccaggtacaaagggagaaaagggagccgagggatctcctgggttgcccggtctcctcggccagaaaggggaaaaaggagacgccggaaattccataggcggtggacgtggtgagcccggacccccagggttacctggacccccaggacccaaaggcgaagcaggtgtggatggccaggttggacccccaggacaacctggggacaagggagagcgcggagccgctggcgaacagggccctgatggaccaaagggctctaagggagagcccggaaaaggcgagatggtcgattataatggcaatattaatgaagctcttcaggaaataagaacgctggcgctcatgggccctccgggtcttccgggacagatcggtccaccaggagcccctggaattccaggtcaaaaaggcgagatcgggttgccaggcccacccggtcatgacggagagaagggaccacgtgggaagccaggagacatgggaccgccaggccctcagggacccccaggcaaggatggtccaccaggtgtaaagggagaaaacgggcatccagggagccccggagagaagggcgagaaaggggagacgggacaagccggatcccccggtgagaaaggcgaggctggggaaaagggcaacccgggagctgaggtgcctggtttgcctggaccagaaggcccacccggaccacccggactgcagggcgtccccggacccaagggggaggcaggcctcgacggtgctaaaggcgaaaaagggttccagggcgagaaaggagacaggggtcccctgggcctgcccggagcctccggtttagatgggcgtccaggtccccctgggactccgggacctatcggtgtgcctggcccagccggtcccaagggagaacgaggcagcaaaggagatcccggtatgactggtcctaccggggctgcgggtctgccagggctacatggtcctccaggcgacaaaggcaatcgcggagagcgcggaaagaaaggttctcgcggacccaaaggcgataaaggagatcagggcgcaccaggcctcgacgctccctgcccactgggcgaggatggcctgcccgtacagggctgttggaataagtag

SEQ ID NO: 4799 - DNA, 1938 bp, Artificial Sequence
  Description of Artificial Sequence: Synthetic coding sequence
atggttgcagaaagaactcataaagcagccgctacaggcgctcgagggcctggagagctgggtgcaccaggaacagtagcactggtggcagctcgagcagaacggggagctagactgccgtctcctggatcctgcggcctcttgactctcgccctgtgttctttggcactttcactcctggcccactttaggacagcagagctccaggccagggtgctgagactggaggccgagcgcggagaacagcagatggagaccgcgatcctcggacgcgttaaccagctgctagacgagaaatggaaactgcattctcgccgaaggagggaggcacctaagactagtcctggctgtaattgcccacccggacctccgggacagcccggaacgcgcggttttcccggattcccgggtcccatcgggctggacggcaagcccggacaccctgggcctaaaggggatatgggcttaaccggtccaccgggtcaacccggaccccagggacagaagggagaaaagggacaatgcggggagtatccccaccgcctgctgcccctgttgaatagtgtcaggctggcacccccaccggtcatcaagcgacgtacattccaaggagagcaatctcaagctagtatccaaggcccacccggtcctccaggtccacccggtcccagcggtccattaggtcaccccggactccctggacctatggggccacccggactgccaggccctcccggaccgaagggggaccccggtatccagggctaccacggcagaaagggtgaacgtggcatgccaggcatgcccggtaaacacggggcaaagggagccccaggcatcgctgtggccggtatgaaaggggagcccggaatcccaggaaccaagggagaaaagggagctgagggttcccccggacttcccggactgttgggccagaagggggaaaagggcgatgctggaaacagtataggcggtggaaggggggagcccggacctcctgggctaccgggtcccccaggcccaaagggagaggcaggcgtggacgggcaggtaggcccacccggacagcccggagacaaaggcgaacgtggcgcagcaggcgaacaggggcctgatggaccgaagggctccaaaggggaacctgggaaaggcgaaatggtggattacaacggaaacatcaacgaggctttgcagccatcccggggacccgcactgcgtggtccccctggtctgcctggccagattggaccgcctggggctccgggaatccctggccaaaaaggtgaaataggacttccaggccctcctggccatgacggtgaaaaaggtccaagaggaaagcccggagacatgggaccgccaggtcctcaaggcccaccaggaaaggacggacctcctggcgtcaaaggcgagaatggccaccctgggagcccgggagaaaaaggggagaagggggagacaggtcaagcgggaagtccagtgcccggattgccagggcctgagggcccacccggacctcccggtttgcagggggtgcctgggccaaagggagaggctggtttggatggtgcaaaaggcgaaaaaggcttccagggggaaaaaggcgacagggggccactaggactaccgggagcctcaggtctcgacgggaggcccggaccaccaggcacaccagggcctatcggtgtgcctgggccagcgggtcctaaaggtgagagagggtctaagggagacccgggaatgaccggccctaccggtgctgccggtcttccaggtcttcacgggccacccggagacaagggcaataggggcgaacggggtaaaaaggggagccgcggtcctaaaggggacaagggcgatcagggagccccagggctggacgccccttgtcctctgggcgaggatgggctccctgtgcagggttgttggaacaagtag

SEQ ID NO: 4800 - DNA, 2109 bp, Artificial Sequence
  Description of Artificial Sequence: Synthetic coding sequence
atggtggccgaacgcactcacaaagcagcagccaccggagccaggggtcccggagagcttggagctcctggcactgtcgccctggtcgcagctcgggcagagcggggagcaaggctgccctcgccaggctcctgcggactgctgaccttggctctctgctctctggctcttagtcttctcgcccacttcagaacggccgaactgcaggcgcgagtgctgaggctcgaggcagaacgtggagagcaacagatggagacagctattctgggacgcgtcaaccaactgcttgatgagaagtggaaactgcacagtaggagacggcgagaagctcctaagaccagccccggatgcaattgtccaccagcattccaagggccaaccgggaggccaggccttccaggcgataaaggcgctattggcatgccagggagagtgggctcaccgggagatgcaggactgtcaataattgggccaagaggaccacccggtcagccagggacaaggggatttcccggatttcctggaccaatcgggctggacggaaaacccggtcaccccggaccaaaaggtgatatgggattgacaggaccccctgggcaacctgggcctcaaggacagaaaggagagaaaggccagtgtggggagtacccccacagagaatgtttgagtagtatgcctgctgccctccgttcctctcagattatcgctttaaaactactgcccctgttaaactcagttcggttggccccacccccagtcatcaagcgaagaaccttccagggcgagcagagccaggcctctatccagggtccaccaggcccacccggtccgccaggtccttccgggccattggggcaccccggattacctggccctatgggcccacccggactgccaggccctcccggacctaagggcgatcctgggatccagggataccacggaaggaaaggggaaagaggaatgccagggatgccaggtaagcatggcgcaaaaggggcaccaggcattgcggtggcagggatgaaaggtgagcctggtattccaggcaccaagggcgagaagggggcagaagggtcgcctggactacccggtctgcttgggcagaagggcgagaagggcgacgcgggtaactccatcggaggtggcagaggagaacctgggcctccagggctgcccggacctcctggcccaaaaggagaagccggagtggatggtcaggttggccctcctggccagccaggtgataagggtgaacggggagccgctggcgagcagggaccagatggacctaaggggtctaaaggggagcccggaaagggggagatggtagactacaatggaaatattaacgaggctctgcaggaaattcgcactctggccctgatgggaccacctggtctgcccggtcaaattggcccacccggtgctcccggaatccctgggcaaaaaggagaaattggtcttccaggccctcctgggcacgatggtgaaaagggaccgaggggtaagccgggagatatggggccacccggacctcaaggtcccccaggcaaagacggtccacccggagtcaaaggggagaatggacatccgggaagcccaggggagaaaggagagaagggggagactggacaagctggctctccagtgcccggattgcctggcccagagggccctcccggtccgcctggactgcagggcgtccctgggccaaagggagaggcaggcctcgatggagcaaagggtgagaagggctttcagggcgagaagggggacagaggcccactcgggttacctggcgcttcaggtttggacggccgtcccggacccccaggaaccccaggtcctattggagtccctggcccagccggtccaaagggagagcgaggctctaagggcgaccctggaatgaccggacctaccggcgctgcagggctgccagggcttcatgggccaccgggagataagggaaatagaggcgagagaggcaagaaaggatctaggggaccgaaaggggacaaaggcgaccagggagcaccaggacttgatgccccttgtcctctaggagaggacggattgcctgttcaaggatgttggaacaagtag

SEQ ID NO: 4801 - DNA, 2112 bp, Artificial Sequence
  Description of Artificial Sequence: Synthetic coding sequence
atggtggccgagaggactcacaaggccgctgcgacaggggcaaggggccctggggagctcggtgctcccggtaccgtagcactggtggcagcacgcgcagaacggggtgctcgcctccctagccctgggtcttgcgggcttcttacgctggctctctgctcgctcgccctctcgctgcttgcccatttccgcactgcagagctccaggctcgggttcttcggttagaggctgaacgcggtgagcagcagatggagacagcaatcctgggccgagtgaatcagcttctagatgaaaaatggaaactgcacagccggaggcggagggaggcccctaaaacgagtccaggatgtaactgtccgcctgggccacctggcccaactggacgccctggtctgccgggagacaagggcgctattgggatgcctggcagagtcggaagcccgggtgacgcaggactgtccataatcggtcctcgcggtccacccggacagccgggaacccgcggttttcccggttttcccggacccatcggactggacggaaagcccggacaccccggacctaagggtgacatgggtctaacaggaccaccaggtcagccaggccctcagggacaaaaaggagaaaaagggcagtgtggagaataccctcatcgggagtgcttgagctctatgccagccgctctgcgctcttcacaaattattgctctgaaactgctaccactcttgaacagtgtccggctggctcctcccccagtcatcaaacggagaacgtttcagggagaacagtcccaagcatctattcagggccctccgggtcccccagggccacccggaccttccggccctctgggtcaccccggactgcccggacctatgggtccacccggtctgcctggcccaccaggtcccaagggcgaccctggaatccagggctatcacggcagaaaaggggaacggggtatgccaggcatgcctggcaaacacggtgccaagggcgctcctggcatcgccgtggcaggtatgaaaggcgagcccggtatccctgggaccaagggggaaaagggagctgagggttcacctggcttaccaggcctgctgggacagaagggggaaaaaggagacgccggaaatagcatcggaggagggaggggcgagccaggaccacccggtctgcccggacccccaggtcccaagggcgaggcgggagttgacggccaggtgggccctccaggtcagccaggagacaagggagagagaggcgcagctggggagcaagggccagacgggccaaagggctcaaagggcgagcccggaaagggcgagatggtcgattacaatggaaatatcaacgaggccttacaaccctcgagaggtcccgcactgagaggccctccaggcttgcccggtcagatcgggcctccgggtgcgccaggaatcccgggacagaagggggagatcggtctacctggcccacctggccatgatggtgaaaagggcccaaggggaaagcctggtgacatgggtcccccagggccacagggacctcctggcaaagacggtccccctggcgtgaaaggagaaaatggtcatccaggatcgccgggtgaaaagggggaaaaaggcgaaacaggccaggccggaagtcctggcgagaaaggggaggcaggagaaaaaggaaaccccggtgctgagggccttcagggtgtgcccggacccaagggggaagccggactggatggcgcaaaaggagaaaaaggctttcagggtgaaaagggagaccgtggccctttgggtctccccggagcttctggactcgatggacggccaggcccaccaggaacacccggaccaatcggagtgcctggacccgcagggccaaagggtgagaggggctccaagggggacccagggatgacgggacccaccggcgctgccggactccctggattgcatgggcctccgggtgacaaaggaaaccggggagagcgaggaaagaagggatcacggggacccaaaggcgataagggcgatcagggagcgcctgggcttgacgccccttgccctctcggcgaagatggactgccagtgcaaggatgttggaacaaatag

SEQ ID NO: 4802 - DNA, 2076 bp, Artificial Sequence
  Description of Artificial Sequence: Synthetic coding sequence
atggtcgcagaaagaactcataaggccgctgcgaccggagccagggggccaggcgaattgggggctcccggtaccgtcgcgctcgtcgcagcacgcgctgagcgcggagcccgactaccgtcccccggaagttgcgggcttctgacactggccctttgctctctggccctgtccctcttggcccatttccgcacggcagaactgcaagctcgagtactgaggctggaggccgagagaggcgaacagcaaatggagaccgctatcctgggtagggttaaccagctcctggatgagaagtggaaactccacagtagaagaagacgggaggcgcctaaaacctcccccggatgcaattgcccccctggacctccaggccctaccgggagacctgggcttccgggagacaagggagccattggaatgccagggagggtggggtcacccggtgatgcaggactcagcatcattggtccaaggggccctccgggtcagccaggtacgaggggatttccaggctttcctgggcctataggactcgacgggaagccaggacaccccggtccgaaaggagacatggggttgaccgggccaccgggacagcccggtccccaagggcaaaaaggagaaaaaggccagtgcggggaatacccccacagggagtgcctatccagtatgccagcggctctgcggtcaagtcaaatcatcgctctgaaactcctgccgcttctgaactccgtcaggctggcgcctccacctgtgattaagcgccgaacctttcaaggtgagcagagtcaggctagcattcaagggccaccagggccacctgggccacccggaccttctggtcctttgggtcaccccggtctgcctggccctatggggccaccaggacttcctggccctccagggcctaaaggagacccagggatccagggctaccacggcagaaaaggcgaaagaggtatgccaggaatgcctggcaagcacggggcaaaaggtgccccaggtattgctgtcgctggcatgaaaggagagcccggaatcccaggcactaaaggcgagaaaggcgctgagggatcccctgggctgcccggtctcttgggccagaagggcgaaaagggagacgctgggaattcaatcgggggagggcgaggcgagccaggcccacctggcctgcccggtccaccgggaccaaagggagaggcaggtgttgatgggcaggtcggccctcccggacagcccggtgataagggagagcgaggggctgcaggcgagcagggccctgacggtcctaagggaagcaaaggggaacccggtaagggcgagatggtcgattataatggcaatatcaatgaggccctccagccctctagagggccagcccttcggggaccgcctggcttgccagggcagatcgggccacctggcgctccgggtattccaggacagaaaggggagattggactccccggaccaccaggccatgatggcgaaaaaggcccaaggggtaaaccaggtgatatgggaccacctggtccacaggggccaccaggtaaggatggtcccccaggagtcaaaggagaaaatggtcatccaggcagcccaggcgagaagggcgagaaaggcgaaacagggcaggccggaagtccgggtgagaaaggcgaagccggtgagaaaggaaaccccggagcggaggggctccaaggagtgcctggccctaaaggcgaggcaggcctcgatggagccaagggtgagaagggatttcagggagagaaaggtgaccggggtcccctggggctgcccggtacgcccggacccatcggggttccaggacccgcagggcctaagggtgaacgaggtagcaaaggagacccaggcatgaccggtcctacaggggctgcaggcctccctgggctgcacggccctcccggagataagggaaatagaggggagcgcggaaagaagggctcaaggggccctaagggagataaaggcgatcagggcgcacctgggttggacgcgccttgcccattaggtgaggatggcctccctgtgcagggttgctggaacaagtag

SEQ ID NO: 4803 - DNA, 2118 bp, Artificial Sequence
  Description of Artificial Sequence: Synthetic coding sequence
atggtggcggaaagaactcataaggccgctgctaccggcgcaaggggtcctggcgagctgggtgcacctggcactgttgcgttggtggccgctcgcgcagaacgcggagctaggctgcccagcccgggtagctgtgggctccttacgttggccctgtgttcactggccctgagtctgttggcacattttcggacagctgaactgcaagctcgggtacttcgccttgaggccgagagaggggaacagcagatggaaacagcaatactcggacgagtgaaccagctgcttgatgagaaatggaaactgcactcccgaaggaggcgcgaggcacctaagacgtctcccggttgtaattgcccccctgccttccagggacccactggcaggcctggactccctggctcccccggagatgccggtcttagcatcatcggcccaagaggaccacccggacaacccggaacaaggggattccccggattcccaggccctatcggcctcgatggaaaacctgggcatccaggtccaaaaggcgacatgggccttaccggacctcctgggcagccaggaccccagggccagaaaggcgagaaaggccaatgcggcgagtacccccaccgagagtgtctttcaagtatgcccgctgccctgcggtcgagccagatcatcgccctgaaacttctgcccctgctcaactccgtgaggttggctccacccccagtgatcaaaaggcgcacattccaaggggagcagtcccaggcttccattcagggcccacccggtccgccaggaccgcctggtccctcagggcctttggggcatcctggacttcctgggccaatgggtccaccaggactccccggacccccaggccctaagggggaccccggaattcaggggtatcacggacgtaagggtgaacggggaatgccaggtatgcctggtaaacatggggcaaagggggctccagggatagctgtggctgggatgaaaggtgagccgggaattccaggaaccaaaggcgagaagggagccgagggaagtccaggactgcccggactgctgggacagaaaggcgaaaaaggggacgccggaaactctatcgggggaggcagaggcgagccagggcctcctgggctccctggcccaccaggccctaaaggtgaggccggtgttgacgggcaggtaggcccaccaggtcagccaggcgacaagggagaacgcggagccgcaggcgagcagggtccagatggtccaaagggctctaaaggggagccaggcaaaggagagatggtagactataacgggaatattaacgaggctcttcaagagattaggacactggcactgatgggtccaccaggactgcctggacaaattgggccacctggggcacctggtattcctgggcagaaaggagaaatcggcctgcctggccctcctggccatgacggagagaaaggaccccgaggcaagcccggagacatgggacccccaggccctcagggaccccctggaaaggatggtcccccaggcgtcaagggagagaatggacaccccggttcaccaggggagaagggagaaaagggggaaactggacaggccggaagccctggtgaaaaaggcgaggcaggcgagaaagggaatcccggtgctgaggtccccggactccccggacctgagggacctccgggtccaccagggcttcagggtgtgcccggaccaaaaggggaagccggtctcgacggggcaaagggcgagaagggcttccagggcgaaaagggtgaccggggaccgttggggctgcctggagctagcggccttgatggacgacccggtcctccaggaacacccggacccatcggcgtccccggacctgccggtcccaagggtgaaagagggtcgaagggtgatccaggcatgacaggtcccactggcgcagctggcttgcctggcctgcacggccctcccggtgacaagggaaacaggggagagcgaggcaagaagggatccagggggcctaaaggggataaaggagaccagggagcgccagggctcgacgcgccatgccctcttggggaagatggattacctgttcagggatgctggaacaaatag

SEQ ID NO: 4804 - DNA, 2154 bp, Artificial Sequence
  Description of Artificial Sequence: Synthetic coding sequence
atggtggcggagcgtacacacaaagcagccgctactggagctcggggacccggagagttaggcgcacctggcactgtggccctggttgctgcgagagccgagcgaggagccagactgccgtctccaggcagttgtggcctactgacactggctctctgttctctggccctgtcccttctagcccacttccggacagcggagctgcaggccagagtgttgagattagaggccgagcgaggtgagcagcaaatggagaccgccatccttggacgagttaaccagctgctggatgaaaaatggaaactgcactctaggcggaggcgggaagcccctaagactagccccggttgtaattgtcccccagggccacctggcccaaccggcaggcctgggttgcccggtgataagggcgctattggaatgcctggcagagtgggcagcccaggggacgcaggcctctccatcattggccctagggggcctccaggacagcccggaacgcgagggttccctggattccccggaccaatcggcctggatggaaagccaggtcaccccggacctaagggagacatgggcctgaccggaccccctgggcagccaggcccacaagggcagaagggagaaaaaggccagtgtggggaatacccacacagggaatgtctgtctagtatgccggctgcgctgcgaagctcgcagatcattgccctgaagctgctgcccctgcttaatagcgtccggttggctccaccaccagttattaaaagacgcacttttcagggagaacagtcccaagcttccattcaaggaccaccagggccacccggtcccccagggccatccggccctctgggccatccgggattacccggacccatggggccaccaggactccctggcccacctgggcctaagggagacccgggaatacagggttatcatgggcgaaagggagagagaggaatgccgggtatgcctggaaaacacggggcaaagggtgcccctggtattgcagtcgccggtatgaagggcgagcccggaatccctggcaccaagggcgagaaaggcgctgaaggaagtcccggactcccaggcctgctggggcagaaaggggaaaagggggatgccggaaacagtattgggggaggacggggtgagcccggtccccctggactgccgggtccgcctggccctaaaggggaggcaggcgtggacgggcaggtggggccacccggacagcccggagataaaggtgagcgcggtgccgctggcgaacagggacctgatggacccaaggggagcaagggggaacccggaaaaggtgagatggtcgattacaatggcaacatcaatgaagccttacaggagatccgtacccttgctctgatgggccctcccggtctcccaggccagatcggcccacccggtgcacctggcattccgggtcagaagggcgaaattggattgcccggacctccagggcacgacggtgaaaaagggcctagaggtaaacctggagatatggggccaccaggcccacagggccctccgggaaaggatggtccccctggagtgaagggtgagaatggccaccccggttctcctggggagaagggggaaaaaggcgagaccggacaggctggaagtcccggagaaaagggggaagcgggtgaaaagggtaatcctggagccgaggtgcctggtttgcccggacccgaaggtccaccaggccctcccggtttgcaaggtgtgccgggtcctaagggggaagctgggttagatggagctaaaggggagaaagggttccagggggagaagggcgatagggggccactgggactccccggtgcgagcggactggacggaaggcctggtccaccgggaacccctggaccgattggagtgcccggtcccgctggacccaaaggcgagaggggctctaaaggagatccaggcatgacaggacctactggcgctgcaggtctgccaggactccacgggcctccaggcgataaaggaaatagaggcgaaagagggaaaaaagggagccgaggccctaagggggataagggcgaccagggcgctccgggactggatgctccgtgccctctgggggaagacggcctccccgtgcagggctgctggaacaaatag

SEQ ID NO: 4805 - DNA, 2007 bp, Artificial Sequence
  Description of Artificial Sequence: Synthetic coding sequence
atggtggcagagcgaactcacaaggcggcagctaccggtgctcgtgggcctggcgaactcggggcacccggaacggttgccctggtagccgcacgggctgaaaggggcgcacgcctgcccagccctgggagctgtggactgctgacactggccctgtgttcactcgcactgtcccttctggctcacttcagaaccgctgaacttcaggcacgcgtccttaggctcgaggcagagcggggagagcagcagatggagaccgctattctgggacgcgtaaatcaactcctcgatgagaagtggaaattacacagtcggagacgcagagaggcgcctaagaccagcccagggtgcaactgcccacctggaccaccaggcccaactggaaggccaggcctgcccggagataaaggagcaattggcatgccaggccgtgtcggatcccccggagacgcgggactctccattatcggaccacgaggacccccagggcaaccaggcacacgcggattccccggtttccctggtccgattggcttggacggcaagccgggacacccgggtccaaaaggagacatgggactcaccggtccccctggccaacctggaccacaggggcagaagggagagaaaggccaatgcggagaataccctcacagggagtgtctgtcctctatgcctgcggctctgaggtcgagccagataattgccctgaagggtgaacagagccaggccagtatccaagggcctcctggtcctccaggccctccgggaccttccggacctttaggccacccagggttgccaggacccatggggcctccaggattgcccggtccccctggccctaaaggagatccagggatccaaggctatcatggtagaaaaggagaacggggtatgccaggaatgccaggcaagcatggcgctaagggggctcctgggatcgcagttgcaggaatgaagggcgaacccggtatccccggaacgaagggagagaaaggagccgaggggtcccccggactgcccggactgctggggcagaaaggtgagaaaggggacgccggtaattctattggaggaggccgaggggagccaggccctcctggcctgcctggcccacccggtccaaagggggaagcaggagtcgacggacaagtgggtcccccaggacagccaggcgacaaaggggagcgcggtgccgcaggcgaacagggtcctgacggaccaaaaggctccaaaggtgagccaggcaaaggcgagatggttgattataacggcaacatcaatgaggcgttacaggaaattcggacgctggcattgatgggcccacccggactgcctgggcaaatagggccaccaggagcacccggtattcccggacagaagggggaaatcggactgccaggtccgcctggccacgacggggagaaaggcccacggggaaaaccaggggacatggggccacccggtccccagggacctcctggtaaggacgggcctcctggcgtgaagggtgaaaacgggcatcccggaagccctggcgaaaaaggcgagaaaggtgagactggacaagctggtagtccggtacccggtttgccaggacctgagggtccccctgggccacccggacttcagggggtacccggtcctaaaggcgaagccggattggatggagctaagggcgaaaaagggtttcaaggagaaaagggggacagaggccctctcggtctccctgggactcctgggcctattggcgtccccggaccagccggaccaaaaggcgagaggggaagcaaaggcgacccaggcatgaccgggcctacaggcgctgctggattgccaggcttgcacggcccacctggcgacaaaggaaatcggggagaaagaggcaagaaaggctccaggggccctaagggcgacaaaggtgaccagggcgctcccggtctggacgccccatgtccgttgggagaagatgggcttcctgtgcagggctgttggaacaagtag

SEQ ID NO: 4806 - DNA, 1833 bp, Artificial Sequence
  Description of Artificial Sequence: Synthetic coding sequence
atggtcgccgagcgtactcacaaggctgcagccacgggggctcggggacccggtgaactcggggctccaggtaccgtggccctcgtcgcagctcgcgcagagagaggggctagactgccgtcccctggctcttgcggtctccttacactggctctgtgttctctggccctgtcgctcctcgctcattttcgaacggcggagctgcaagctagggtgttgcgcctcgaagccgaacggggagaacaacagatggagaccgcgatactagggagagtgaaccaactcctggacgaaaaatggaagctccattcacggcgaaggagagaagcaccgaagacctctccgggatgtaattgcccgcctggacctcctggtcctaccggaaggcctggacttcccggacagccaggtacacggggatttcctggcttccccggacccatcggactcgacgggaagcccggacatcccggacccaagggcgacatggggttgaccggccctccgggtcagcccggtcctcaggggcagaagggcgagaaaggccagtgcggtgagtacccccacagagagtgcctttcctctatgccagccgcactgaggtcatcccaaatcattgcactgaaaggggaacagtcccaggccagcatccaggggcctccgggtcccccaggcccaccaggccctagtggacctctgggacacccgggattgcctggacctatgggccctcccggtctgcctggccctcctggccctaagggggacccagggattcaggggtatcatggtagaaaaggggaaaggggcatgcccggaatgccagggaaacacggcgctaaaggcgctcccggaatcgccgtcgccggaatgaaaggtgaacctggcatccccggaaccaagggagagaaaggcgcagaagggtcaccaggcctgcccggtctgctgggtcagaaaggtgagaagggcgacgctggcaacagcataggcggtggcaggggggagcccggaccacccggtctgccaggccctccgggtcctaagggcgaggcaggggtcgacggccaggtgggccctccaggacagcctggcgataagggtgaaagaggcgctgcaggcgagcaaggacccgatggccctaaagggagcaagggggaacccggtaaaggcgagatggtggactacaacggtaatataaacgaggctctgcaggaaattcggaccctggcgttgatgggacctcccggattaccgggacagattggccctccaggggctccaggcatacccggtcagaaaggggaaatcggactgcctggccctcccggtcacgatggtgagaaaggacctaggggcaagccaggtgacatgggaccccctggaccccagggccctccaggaaaggatgggcctcccggtgttaagggcgaaaacggacaccccggatccccaggcgagaaaggtgaaaaaggagagacagggcaggcgggtagccccgtcccaggcctcccgggacccgaaggaccgccaggccctcccggtctccagggcgtgcctggtcccaagggggaagctggcttggatggagctaagggggaaaaaggcttccagggagagaagggtgacagggggcctctgggtctgcctgggacccctgggccaatcggtgttcccggtcccgcaggtccaaagggtgagcggggatccaagggggaccccggtatgactggaccaaccggcgcagcaggtttgccaggcctgcatgggcctccaggcgacaagggcaatcgcggagaggatggattgcccgttcaaggatgctggaacaagtag

SEQ ID NO: 4807 - DNA, 1938 bp, Artificial Sequence
  Description of Artificial Sequence: Synthetic coding sequence
atggtagccgagcgtacacataaggcagctgcaacaggggctaggggaccaggagagctgggagctcccggaactgtcgctttggttgccgctcgcgcagaacgcggagccagactgcccagccctggaagttgcggcctgttaactctcgccctgtgcagtctggccctctcactcctagcccactttcgcactgccgaactgcaagccagagttcttcgactcgaagctgaacggggagagcaacagatggagactgccatattaggtcgagttaatcagctgcttgatgaaaaatggaaacttcattcccgcaggcgtcgagaggcaccaaagaccagtcccggatgcaactgcccacctgggcctccgggacaaccaggaaccaggggcttccccggattcccgggtcccatcggtttggatgggaagcccggacacccaggccctaaaggcgatatggggctgacaggaccccctggccagcccggacctcaagggcagaagggagagaaggggcaatgcggggaatacccacatcggctgctccccctccttaacagtgtgaggctagccccacctcctgtcatcaagcgtaggactttccagggagagcaatctcaggctagtattcagggcccaccaggaccaccaggacctcccggtccctctggaccgcttgggcaccctggtctgcctgggccaatgggaccacccggtctcccgggtcctccaggtcctaagggggatcccggaatccaaggataccacgggaggaagggcgagcggggaatgcccggtatgccgggtaaacacggtgctaaaggcgctcccggtatagctgtcgccggaatgaagggggagcccggaatcccaggcaccaagggcgagaaaggtgctgagggatcaccaggcctgcccggactgctcggccaaaagggcgaaaaaggtgacgcaggaaactccattgggggaggaaggggcgagccaggccctccaggtcttccagggcctcctggtccaaagggcgaggcgggtgtcgacggacaggttgggccaccaggccagccaggagataaaggtgaacgaggcgcagctggagaacagggacctgacggccctaaaggcagcaaaggcgaacccggaaagggagaaatggttgactataatggaaatattaacgaagccctgcaggaaatccgtactctggcactgatgggccctccgggactccctggacagatcggtcccccaggggcacccggtattcccggtcagaagggtgagatcgggctcccagggcctccagggcatgacggcgaaaagggacctcggggaaagcctggggacatggggcctcctggtccccagggtcccccaggaaaggacggcccacccggagtgaagggcgaaaacggtcatccaggatcgcctggggagaagggggagaagggcgagaccgggcaggccggaagccccgttccaggccttcccggaccagaggggccaccgggtccgccaggccttcagggcgtgcccggaccaaagggagaggccggactggatggtgccaaaggcgaaaaaggatttcagggtgagaagggcgaccggggacctttggggctacctggagcgtctggtctggacgggaggcctgggcctcctggcacacccggacccattggtgtgccgggacctgctggccctaaaggagaaagagggtctaaaggggatccaggcatgacagggcctacgggagctgctggactgcccggattgcacggtccgccaggtgataaggggaataggggggagaggggtaaaaaaggcagtcgcggtcctaagggagacaaaggtgaccagggcgcacccggacttgacgcaccatgtcctctaggggaggacggcctcccagtccagggctgctggaataagtag

SEQ ID NO: 4808 - DNA, 5106 bp, Artificial Sequence
  Description of Artificial Sequence: Synthetic coding sequence
atgaagatttttcagcgtaaaatgagatactggctcctgccccctttcttggctatcgtatacttctgtaccattgtgcagggccaggtcgcccctccaacacgtctgagatacaatgtcatcagccacgactctatccagattagttggaaggcgccacgaggcaagttcggtggatacaaactgcttgtaacccccacgagtggaggcaagacaaatcagttgaatctgcagaatactgctaccaaggcaattattcagggcttgatgccggaccagaactacactgttcagatcatcgcctataacaaggataaagaaagcaagcctgctcagggccagtttagaataaaagacttggagaagcgcaaggatcccaaaccaagggtgaaggtagtcgaccggggtaatggaagtcgacctagcagtccggaagaggtgaagttcgtctgccagacccctgctatcgcggacatagtcatcctcgtcgacggatcttggtccatcggacgctttaattttcgcctggtgaggcatttcttggagaatcttgtgaccgcctttgacgtcggcagcgagaagacccggattggcgtcaagaacgcggatgtcaatgaactgcaggagattgctagcgaacccgattccacccacgtgtacaatgtggccgaattcgacctaatgcacaccgtggtcgaatccttgaccaggaccctgtgcagcagagtagaggagcaggatcgggaaatcaaggcatccgcacacgcaatcacagggccaccaacagaacttatcacctctgaggtgaccgctcgtagttttatggtgaattggactcacgcccctgggaacgtcgaaaaatatagagtggtctactatcctacacgaggaggaaagccagacgaagtagtcgtcgacggcacagtgtccagtaccgtcttgaagaatctcatgagcctgacggagtaccagattgctgtgttcgcgatctacgcccatacggcctcggaaggcctccggggaaccgaaacgaccttagcccttcccatggcctcagacttgcttctgtatgacgtcaccgagaacagcatgagagttaaatgggacgcggtgccgggagcctccgggtatctgatcctgtacgcgcctcttacagaaggcttggccggagacgaaaaggagatgaagataggggaaacccacacagacatcgaactcagcgggctgttgccaaacacagagtacactgtcaccgtgtacgctatgttcggcgaagaggcgagtgaccctgtaacaggacaagagacaaccctggcccttagtccgccacgcaatctgcgaattagcaatgtagggagtaactccgctaggctcacatgggatcctacttctcgccagattaacggctatagaattgtttataacaacgccgacggcactgagatcaacgaggttgaagtcgatccgataacaacattcccactaaagggcctcacaccactgactgaatatacaatagctatattcagcatttacgatgaaggccagtcagaaccattgaccggggtcttcacgaccgaggaagtccccgctcagcagtacctggagattgatgaggtgactacggacagttttagggttacatggcaccccctgtcggccgatgaaggacttcataagctcatgtggattcctgtctatggcggtaaaactgaggaggtggttctgaaggaggagcaggatagccacgtgatagaagggttagaaccgggaaccgaatatgaggtgtcattgctcgccgtgttggacgatggctccgagagtgaagtggtcaccgcagtggggactacgctggactcattctggaccgagccggcaactactattgttcccaccacatcagtaacaagcgtgtttcagacgggtatccgtaatttagtggtgggagacgagacgacctcttccctaagagtgaaatgggacatctcagattcagatgttcaacagttccgcgtcacatatatgacggcccagggtgatccggaagaagaggtcattgggaccgtcatggtccctggttcccagaacaatcttctgttgaagccacttctgcccgacaccgagtataaggttacagtgacgcccatctatactgacggagaaggggttagcgtgagcgcaccaggaaagaccctgccttctagcggaccccagaatctgcgcgtctctgaggagtggtacaacaggctacgcattacttgggatcccccttctagcccggtgaaaggatatcgcattgtgtataagcccgtatctgtgccaggacctacattagaaacatttgttggggctgacatcaacaccatcctgatcaccaatctgctctccggaatggactacaacgtgaagatctttgcctctcaagcctcaggattctcagacgcattgacgggcatggtgaaaaccctctttctgggcgtgaccaatctccaggccaagcacgtggaaatgactagcctctgcgcccattggcaggttcataggcatgccacagcctacagagtcgtgattgagtcccttcaggaccgacagaaacaggaatccaccgtgggcggaggtacgaccaggcattgcttctatggccttcaacccgatagcgagtataaaatttctgtgtatacaaaactccaagaaattgaaggaccatctgtgtcaatcatggaaaagactcaatccctgccaacgagacctccaacgttcccgccaacaataccaccagccaaggaggtatgtaaagctgctaaagccgacctcgtgttcatggttgacggctcctggagtatcggcgatgagaactttaataagattatctcattcctgtattcaaccgtgggggcactgaataaaatcggaacagacggcactcaagtggcaatggtgcagttcacagatgacccaaggactgaatttaagctaaatgcatacaagacaaaagagaccctgttagatgctattaagcacattagttacaagggtgggaacacgaaaacgggcaaggcaataaagtatgttagggacactctttttacagccgagtcagggactaggagaggtattccaaaagtgatcgtggttatcaccgatggtcgttctcaagacgatgtgaacaagattagtagagaaatgcagcttgatggctactcaattttcgcaatcggcgtggcggatgccgattactctgaacttgtatccattggatcaaagcctagtgcacgacatgtattcttcgtagacgacttcgacgccttcaaaaagatcgaagacgagctgatcacttttgtctgcgagaccgccagtgccacttgccctgtggttcataaagacggaatcgacttagcaggatttaagatgatggaaatgtttgggctcgtggaaaaagactttagtagcgtggaaggcgtgtcaatggagccagggactttcaatgtctttccctgttaccagctccacaaggacgcgctggtgagccagcccactcgctacctgcacccagaggggttgccttccgactacactataagcttcttgtttcggatcctgcctgacacaccccaggaaccattcgcactgtgggaaattctcaacaagaactctgaccccttggtgggagttatcctggataacgggggaaagacccttacttactttaattatgatcagagcggggatttccagactgtcacctttgaaggcccagaaatcaggaaaatcttttacggttcctttcataagctccatatcgtggtatccgaaaccctggtcaaagtggtgatcgactgcaaacaggtgggggagaaagccatgaatgcgagtgctaatatcacatcagacggagtggaggtcctcggcaaaatggtgcggagtagaggcccaggaggaaatagcgccccatttcagttacagatgtttgatattgtatgttctacgtcgtgggcaaacaccgataagtgctgcgaactaccgggtctgagagatgatgagtcatgccccgacctccctcacagctgtagttgctctgaaaccaacgaggtggctctcggtcccgcaggtccacctggcggtcccggtttaagaggacccaaaggtcagcaaggcgaacccggacctaaaggacccgacggccctagaggtgaaatcggactgcctgggcctcaaggccctcccggtccacagggcccaagtggactgtccatacagggtatgcccggaatgcccggtgagaagggtgagaagggtgatacaggtctgccaggaccccaaggcatacctggtggagtgggttcccccggtcgggacggctcacccggacagagaggactccccggaaaggacggatcgagtggtccacccggtccgcctggcccaatcggcattccaggaacgcccggtgttccaggaatcactggttccatgggaccccagggcgctctcggccctcccggtgtacctggagcgaagggcgagcgcggagaacggggtgaccttcagagccaagctatggtgaggtctgtcgctcggcaagtttgcgagcagcttatccagtcgcacatggccagatacaccgccattctaaaccagattccatctcacagcagttccattaggacggtgcaagggccacctggagagccaggtcggcctggttctccaggtgcgcctggagaacaaggccctcctggcacacccggttttcccggtaatgcgggtgtcccgggaacacctggggagcgcggtctgactggaataaagggcgagaaaggcaatcccggtgttgggactcagggcccaagaggcccaccagggcctgctgggccttcaggagaatccaggcccggaagcccaggcccaccagggtccccagggcctaggggaccccctggccacctcggggttcccggtccacagggaccctctggacaacccggatattgtgacccttccagttgctctgcgtacggggtacgagcgcctcaccccgatcagccggagtttacccccgttcaggacgagctggaagctatggagttgtgggggccaggagtgtaa

SEQ ID NO: 4809 - DNA, 5390 bp, Artificial Sequence
  Description of Artificial Sequence: Synthetic coding sequence
atgaagatattccagagaaagatgcgttactggctgctgcctccatttctggctatcgtgtatttctgcaccatcgtgcaggggcaggttgcaccaccgaccaggttacggtataatgtgataagtcatgattccatccagatatcctggaaagcgccaagagggaaatttggaggatataagctgctagtaacccccaccagtggcggtaaaacaaaccaactgaatctacaaaatacagcgacaaaggcaatcatccaggggcttatgcccgaccagaactacacagtgcagattatcgcgtacaacaaagataaagagtcaaaaccagcccagggacaattccggatcaaggacttggaaaagcgaaaagacccgaagccccgtgtcaaggtggttgacaggggcaatgggtcaaggcctagcagccctgaagaggtgaagttcgtgtgccagactcctgccattgctgacattgtcatcttagtggatggaagttggtccatcgggagatttaactttcgactggtacgacactttctcgagaacctagtcaccgccttcgacgttggctccgagaagactcggatcgggctcgcccaatattcaggtgatccaagaatcgaatggcatctgaacgcattttccaccaaggacgaggtgattgaagctgttcggaacctaccatataagggtgggaatacccttaccggcctggctctgaattatattttcgaaaacagtttcaaaccggaggccggtagtcgtacaggagttagcaagatcggcattttaatcaccgacggaaaatcccaggatgacattatcccaccctcccgcaatttgcgggaatccggcgtcgagttgttcgctattggggtgaaaaacgccgatgttaacgagctgcaggagatcgcctccgagcccgatagcacacatgtctacaacgtggctgaattcgatctgatgcacacagtggttgagtccctcacccgtactctctgctctcgtgtggaggagcaagatagagagatcaaagctagtgcccatgccattacgggacctcccactgaactgataacatccgaagtgacggcacgctcatttatggtgaactggactcacgcacccggaaacgtcgaaaaataccgagtagtatactatcccacaagagggggaaaacccgacgaggttgtagtggatggtaccgtctcttccactgtcctaaagaatctgatgtcactcactgagtaccagatcgctgttttcgccatctacgcgcacactgcctccgaggggctccgcggaacagagaccaccttggcactgccaatggcatccgatttactcctttacgatgtaactgaaaactctatgagagtaaaatgggacgcagtgccaggagcgtcagggtaccttatcttatacgctcccctgactgaaggactcgccggtgacgagaaagaaatgaagataggggagacccatactgatatcgagctctccgggctactgccaaatacagagtacacagtgactgtatacgccatgttcggcgaggaagcttctgatcccgtgacagggcaagaaacaaccttagcattatcccctcctcgtaacctgagaatcagtaacgtagggtcgaacagtgcccgtttaacttgggatcccacatctaggcagattaacgggtacagaatcgtttacaataacgcggatggcactgaaataaatgaggttgaggttgatcctataacaacatttcctctgaaggggctcacgcccctgacggagtataccatcgctatttttagcatctatgatgagggacaatctgagcccctgacaggagtgtttaccacagaggaggttcctgcacagcagtacttagagatcgatgaagtcactacagattcgttcagggtcacttggcacccactctctgcagatgaagggctgcacaaacttatgtggatccccgtttacgggggtaagacggaagaagtcgtgctgaaggaagagcaggatagccacgtgatcgagggcttagaaccgggtaccgaatatgaggtgagtttactggccgtcctggacgatggttctgagagcgaagtggtgacagcagtgggaactacgctagactctttttggactgagcccgcaactacaatcgtccccacaaccagcgtgacatctgtctttcagaccgggatcagaaacttggtcgtgggcgatgagactaccagttcactgagggtgaaatgggatatctcggacagcgacgttcaacaatttcgggtcacctacatgaccgcacagggtgacccagaggaggaggttataggtactgtcatggtgcctggatcccagaacaatctgctgctgaaaccactgctccctgatacagagtacaaggtgaccgtgacccccatctacaccgacggtgagggggtaagcgtatcagctcccggtaagaccctccccagctctggaccacagaatcttagggtcagcgaggaatggtacaacagactgaggataacttgggaccccccttccagtcctgtaaaaggttatagaattgtgtataaacctgtatctgtgcccggacccaccttggagacctttgtcggagccgacatcaataccatcttgatcacgaacttgctttcagggatggactacaacgtgaagatctttgccagtcaggcaagcggcttttccgatgctttaacaggcatggtgaagacgctatttctgggagtgaccaatttacaagcaaagcacgttgaaatgacctctctctgcgcgcactggcaggtgcatcgtcatgctaccgcttacagggtcgttatcgagtccttgcaggacaggcagaaacaggagtctacagtcgggggtggtacaacaagacactgcttctacggactgcagcccgactcggaatacaaaatttctgtgtatacgaagcttcaggaaattgagggcccatccgttagcatcatggagaaaacacagtccctgccgacgaggccaccaacattcccccctaccattcccccagccaaagaagtgtgcaaggcagcaaaagccgatcttgtgttcatggttgatggtagctggtccatcggggacgagaacttcaacaagatcatctcgtttctttactctaccgtgggagcactaaataaaattggcacggacggcacacaagtcgccatggttcaattcactgacgaccccagaaccgagttcaagctgaacgcttataaaaccaaagagaccttactggatgcgatcaagcatatctcatacaaaggaggaaacacaaagaccggcaaagcgattaaatatgtacgggataccctattcaccgccgagtccgggactcggaggggaatcccaaaggtgatcgtagtgattacggacggccgtagccaagacgacgtcaacaagataagccgggagatgcaactggatggctattcaatattcgcgattggcgtcgccgacgcagactacagtgaacttgtgagcattggcagtaagccttctgcacgccatgtgtttttcgtggatgacttcgacgcctttaaaaagatcgaggacgagctgatcaccttcgtgtgcgagaccgctagcgctacctgtccagtagtccacaaggacggcatagacctcgctgggtttaaaatgatggagatgtttgggctggtcgaaaaggacttctcctcggtcgaaggcgtgtcgatggagcctgggactttcaacgtgttcccgtgttaccaattgcataaggatgccctagtcagtcagcctacgcggtatctgcaccccgagggtctgccgtccgactacaccatttcctttctgtttcggatcctccctgacacgcctcaggaaccattcgctctctgggagattcttaataaaaacagcgatccccttgtgggcgtgatccttgacaacgggggtaagacccttacttacttcaactatgatcagagtggagattttcaaactgtaacctttgagggcccagaaattaggaagatattctacggaagttttcataagcttcacattgttgtgtctgagacactggtaaaagtcgttattgattgtaaacaggttggcgaaaaggcaatgaatgccagcgctaacattacatccgacggggtggaggtattggggaaaatggtgaggagcaggggtcctggcggtaattctgcgccattccagctgcagatgttcgacatagtctgcagcacatcatgggccaacacagataaatgctgcgaactccctggcctaagagacgacgagagctgccctgacctaccccactcctgcagctgcagcgaaactaatgaggtagccctcggacccgctggacccccaggcggtccaggacttcggggtcctaagggccaacagggcgaacccggtcctaagggccctgacgggccaaggggtgaaattgggcttccgggaccccagggacctccgggaccccaagggccaagcggcctaagcatccagggtatgccaggtatgcccggagaaaaaggcgagaagggtgatacgggtctgcctgggcctcagggaatccctggaggtgtggggtcccccggacgggacggaagtccgggtcagcgcggtctgccaggcaaggatggatcttccgggccacccggtcctccaggccctatcggcatccccggaactccaggggtgccgggaatcactggctctatgggccctcaaggcgctctcgggcctccgggagttcccggtgcgaaaggcgagcggggagagcgcggagatctccaatcccaagcaatggtgaggagcgtagcccgacaagtctgtgaacagctcatccagtcccacatggcaagatacacagccatcctcaatcagattccaagtcattcatcttccattcgaaccgttcagggaccacccggtgagcccggtcggccagggagtcccggagcgcctggcgagcaagggcctccaggtacccctggtttccccggtaacgctggcgtgccaggcactccaggcgagcggggattgaccgggatcaagggcgaaaaggggaaccccggagtgggcactcagggcccacgagggcctccaggacctgctggtccatcgggcgagagtcgcccagggagtccaggccctcccggttcacctggtccaagggggcctcctggacatctcggggtccccggtccacagggaccaagcggccaacctgggtactgtgatcccagtagctgctccgcctacggcgtgagagcgccacacccagatcagcctgagttcacaccagtgcaggatgagctggaggcaatggaactgtggggacccggagttta

SEQ ID NO: 4810 - DNA, 5342 bp, Artificial Sequence
  Description of Artificial Sequence: Synthetic coding sequence
atgaagatttttcagcggaagatgaggtactggctgctgccgccattccttgcaattgtgtacttctgcacaatcgtgcaagggcaggtggccccaccaacgaggttgcggtataacgtgatttcccacgactcgatccagatctcctggaaagcgccacgtgggaagttcggcggatataagctgttggtgacacccacaagcggtgggaagactaaccagctcaatctgcaaaacacagctaccaaagcgataattcagggattaatgccagatcaaaattacaccgtgcagatcattgcgtacaacaaagataaggagtccaaacctgcccagggtcagtttaggatcaaagatctggagaaacgcaaagaccccaagcctcgtgtcaaggtggtcgatcgaggaaatgggagtcgacctagctctcccgaggaagtcaagtttgtttgtcagacaccggcaatcgctgacattgtcatcctagttgatggaagctggtctatcgggaggttcaactttcgactggtgcgccacttcctggagaacctggtcacggcatttgacgtgggttccgaaaagacaaggataggactcgcacagtattctggggatcccagaatcgaatggcatctcaacgcctttagcacaaaagatgaggtgatcgaagcagtgaggaatcttccatataagggcggtaacactctgactggactagccctgaattacatcttcgaaaactccttcaagccagaagctggttctagaaccggcgtcagcaaaatcggaattctcataactgacggaaaatctcaggacgatattatcccaccgagtcgcaatttgcgggagagtggagtggaactgttcgccattggtgtcaagaatgctgacgtgaacgaacttcaagagatagcatcagagcccgattcaacgcacgtgtataatgtggctgaattcgacctcatgcatacagtagtagagtccctgactagaaccctgtgttccagggttgaagaacaggatagagaaatcaaggcttccgcacatgctatcactggcccacccacagaactcattacatccgaagtcacggcacgtagctttatggtaaattggacgcacgccccaggaaacgtggaaaagtacagggtggtgtactatccgactcggggaggtaaacccgacgaggtggtggtggacggcaccgtgagcagcaccgtattaaagaaccttatgtcactgaccgagtatcagatagcagtgttcgctatctatgcccacacggcatcagaggggcttcgcggaaccgagaccactttggccctgccaatggcaagcgacctgctgctgtacgacgtaacagagaactcgatgcgagtgaaatgggatgcagtgcccggtgctagtggatacttaattctttacgccccactcaccgagggtttggctggggatgaaaaggaaatgaagatcggtgaaacacatacagatatcgaattatccggcctgcttcctaacacagaatacacggtgacagtctacgccatgtttggtgaagaagcgagtgaccccgtaacaggtcaagagactactcttgccctttctcctcctagaaacctgagaataagcaatgtcgggtccaacagtgctcgccttacatgggacccgaccagtcgacagatcaacggatacaggattgtgtacaataacgccgacgggacagaaatcaatgaggttgaagttgatcctattacaacattccctttgaagggattaactcccctgacagagtacacgatagctatcttttctatctacgatgaggggcagtccgaaccattgaccggcgttttcacaacagaggaagtgcctgcccagcaatatctggagatcgatgaagtcaccacagacagtttcagggtgacctggcatcccctctcagcggatgaggggctgcacaagcttatgtggatcccagtgtatggcggtaagaccgaggaggtggtactcaaagaggaacaagacagtcacgtgatcgaaggtctggaacccggaacggagtatgaagtgtccctcctggccgtcctagatgacggatcagagtccgaagtagtgacagcagtgggtacaacgctggattccttttggactgagcctgcaacaacgatcgttcctactacatccgtgacatcagtctttcaaaccggaatccgtaacctggtagtgggcgatgaaactactagcagcctccgtgtgaaatgggatatctctgattcggatgtgcagcaatttagggtcacatacatgaccgcccagggagaccctgaggaagaagtgatcggcacagtgatggtccctgggtcccagaacaatttgctgctgaaacccctactacctgatacagaatacaaagtgacagtcacccccatctatacagacggcgaaggggtgagcgtgtcagcacccggaaagacgctgccttcttcaggtcctcagaacctcagagtttctgaggaatggtacaatcgcttacgtatcacctgggacccgcctagctcccccgtgaaaggctaccgcatcgtgtacaaaccggtgtccgtacctgggccaactctggagacatttgttggcgctgacattaacacaatccttattaccaacttgctgagcggcatggattacaacgtgaaaatctttgcaagtcaggcatctggattctctgatgcactcaccggcatggtgaagacccttttcctgggcgtaacaaatctccaggctaaacacgtcgagatgacatccctttgcgcccattggcaggtgcaccgccacgccaccgcataccgggtcgtgatcgaatccttgcaggaccgccagaaacaagagagtactgttggaggagggactacacgccactgcttctacggattacagccagacagcgagtacaagatctccgtgtacaccaagctccaggagatcgagggaccctccgtgagcattatggaaaaaacacaaagcctgccaacgcggcctcctacgttccccccaaccatccccccagccaaagaggtttgtaaggccgcaaaggctgacttggttttcatggtggatggatcatggagcattggtgatgagaattttaacaaaattatctctttcctctactctaccgtgggagcgctgaataagattggcactgatggtacccaagtggccatggtgcagttcacagacgacccaaggaccgagtttaaattgaacgcctacaagacaaaagaaaccctcttagacgcaattaaacatatcagttataaagggggaaacacaaaaaccggaaaggctatcaaatatgtccgggacactctctttaccgcagagtccggcacaagaaggggaatccccaaggtaattgttgtgatcacagacggcagatcccaggatgatgtcaacaaaataagccgggagatgcaactcgatggatatagtatattcgcgattggcgtcgcggatgctgattactcagagctggtttcaatcgggagtaagcctagtgccaggcatgtgttcttcgtggacgattttgatgctttcaagaagatcgaggacgagcttataaccttcgtgtgtgaaaccgcaagtgcaacctgtcctgtggtacacaaggatgggatcgaccttgctggctttaaaatgatggagatgttcggccttgtggaaaaggacttctcaagtgtggagggcgtgtcgatggagccgggaacttttaacgtgtttccgtgctaccaactgcacaaagacgccctcgtgtcccaacccacccgatacttgcacccagagggactgccctctgattatacgatatccttcttattcaggattctgcctgataccccccaggagcccttcgctttgtgggaaattctgaacaagaactctgatccgcttgttggtgtgattcttgataacggtggaaaaaccctcacctactttaactacgatcaatccggcgattttcagactgtcaccttcgagggaccagagattcggaagatcttttacggcagtttccacaagctacacatcgtcgtgagtgaaactctggttaaggtggtgatcgactgtaaacaggtcggcgaaaaggccatgaatgccagtgctaacatcacttctgatggggtggaagtcctgggtaagatggtcaggagcaggggccctggaggcaactctgcaccctttcagctccagatgttcgatatcgtgtgctcgacctcatgggctaacacagacaagtgctgcgagttacctggcttgcgcgatgacgaatcctgcccagaccttccacatagctgttcatgtagtgagactaatgaggtggccctcggaccagctgggccaccgggaggcccaggactgcggggacccaaagggcagcagggggagccaggccctaagggtccagatgggccacggggtgagatcggactgcccggaccacagggcccacccggtccgcaagggccttctggcctgtccattcaggggatgcctggcatgccgggagaaaagggggagaaaggggacacgggtctgccagggccacaaggtattcctggcggtgttggctccccgggtcgggacggctcacccggacagcgcggattgccgggaaaggatggatcaagcggccctccagggcctcctggcccaatcggaatccccggtactccaggcgttccagggatcaccgggtccatgggaccgcagggggctctcggaccacctggcgtgcccggtgccaagggggagaggggggagcgtggggacctgcagtcccaggccatggtcaggtccgttgccagacaggtttgcgagcagctgatacagtcccatatggctcgatacacggccatactgaaccaaattccctctcactccagttccatcagaactgttcagggcccacccggtgagccgggtaggcccggatctccaggagcccctggcgagcaggggcctcctggcaccccaggattcccaggaaatgctggcgtgcccggtaccccaggcgagcggggattgacagggatcaagggcgagaagggaaatcctggggtgggtactcagggcccacgcggaccccctggccctgctggcccaagcggagagagtagacctggctctccaggtcccccaggtagcccaggacctcggggaccccctggtcaccttggagtgccaggtccccaggggcctagtggccagcccggatactgcgacccttctagttgtagtgcctatggagtgcgagacctgatcccctacaatgattatcaacatta

SEQ ID NO: 4811 - DNA, 1605 bp, Artificial Sequence
  Description of Artificial Sequence: Synthetic coding sequence
atgaagatttttcagaggaagatgaggtactggcttcttcctccgttcctggccatcgtatatttctgtactatagtgcaaggccaggtcgcccctccgaccaggcttaggtataacgtgatctctcatgactccattcagattagctggaaggcgccacgcggaaaattcggcggttacaagttgctcgtgactccaacatccgggggaaagacaaaccagttgaatcttcagaatacagcgactaaagccattattcaggggttgatgccggatcagaactacaccgtgcagatcatcgcttataataaggacaaggagagcaagcccgcacaggggcagttcagaataaaggacctcgagaaaaggaaggacccaaagccgagggtgaaggtggtggatcggggtaatgggagccggccatccagtccagaggaagtcaagttcgtgtgtcagacgccagcgatcgcggatatcgtaatcctagtggacggttcctggtctatagggaggtttaacttccgcctggtcaggcattttctggagaacttggtcacagccttcgatgtagggtccgaaaagactcggatcggactggcacagtactccggggacccccgaatcgaatggcacctcaatgcattttcaacgaaagacgaggttattgaggccgtccgaaacctgccgtataagggcggaaacactctcactggtctcgctctgaattacatcttcgagaactccttcaagccagaagcaggctcccgaacaggcgtcagtaaaattggtatccttatcactgatggaaaatctcaggacgatatcatccccccttcacgcaacttgcgtgaatctggcgtggagttgtttgctattggggtgaagaatgccgatgtgaatgagctgcaagagatcgcaagcgaacctgacagtacgcatgtatacaacgtcgccgaatttgatctgatgcacaccgtcgtcgagtcacttacgcggaccctttgcagtagggtcgaggagcaggatcgggagatcaaagcttctgcacacgctatcaccggtccacccaccgagctcatcacaagtgaggtgactgcgagaagtttcatggttaactggacccacgctcccggtaacgttgaaaaatatcgggtcgtgtactaccccacccgtggagggaagcctgatgaggtagttgtggatgggacggtcagtagtactgtgctcaagaatctaatgtccctgactgagtatcaaattgctgtctttgcaatttatgcccatactgcttccgagggactgcggggtaccgaaactacactggcactgccaatggcctccgacttgctcctgtacgatgtaactgagaattccatgcgcgtaaagtgggatgctgtgccgggtgccagtggttacttaattctatacgccccactcaccgaaggcctggccggtgacgagaaggaaatgaaaatcggggagactcacaccgatatcgagctttctgggctgctgcctaatacagaatacactgtgacagtgtacgccatgtttggtgaagaggcgtccgaccctgtcactgggcaggagacaacatccccttag

SEQ ID NO: 4812 - DNA, 3429 bp, Artificial Sequence
  Description of Artificial Sequence: Synthetic coding sequence
atgagattaacaggcccttggaaactatggctgtggatgtcaatcttccttctgccagcctccacgtccgtgacggtgagagacaaaacagaggagtcttgcccgatcctgcggatcgaaggtcatcagctcacgtatgataatatcaataagttggaagtgtcgggtttcgatctgggagactcgttctcactgcggagggcattctgcgagagcgacaaaacgtgtttcaagctggggagtgcactgttgatccgagatactatcaaaatctttcctaagggtctcccagaggagtacagcgtggctgctatgtttcgggtccgcagaaacgctaaaaaagaacggtggttcttatggcaagttctgaaccagcaaaacattcctcagatttccattgtcgtagacgggggaaagaaggttgttgaattcatgttccaggctaccgaaggggacgtgttaaattatatcttccgcaatagagaactgaggccgttatttgaccggcagtggcacaagctgggcatctcgatccagagccaggtcatttccttgtatatggattgtaacctgatcgccaggcggcagactgatgagaaggatacagtggattttcatgggaggacagtgattgcgacgcgtgcttcagacggtaagccagtggacatcgaactgcaccaactcaagatttattgttccgccaatctcatagcacaggagacctgctgcgagatttccgacacaaaatgtcctgagcaggacggctttggaaacatcgcctcctcttgggtgaccgcccacgccagcaagatgagcagctacctgccggcaaaacaggagctgaaggatcagtgtcagtgtatccccaacaagggcgaagcaggtctgcctggcgcaccaggctcaccaggccagaagggtcacaaaggcgagccaggggagaacggtctccatggcgctcccggattccctggacaaaaaggggaacaaggattcgaagggtctaagggggaaacgggagagaagggggagcagggtgagaagggagaccccgcactcgccggactgaatggcgagaatggcctgaagggagatcttggtccccacggcccacccggaccaaaaggagagaagggcgatactggaccccctggccctccagcactgcccggttccctagggatccagggcccacagggaccacccggaaaagaaggacaacggggacgtcgaggtaagacggggcctccaggaaaacctggaccccctggacctcctgggccacccggtatccagggaatacatcagaccctgggcggttactacaataaggataataaaggtaatgatgagcacgaggccggaggcctgaaaggcgataagggggagacaggccttcctggcttccctggctcagttgggcctaagggacagaaaggagagcctggcgaaccctttacaaaaggcgagaagggagatcgaggagaaccaggtgtgataggcagtcagggcgtgaaaggcgaacccggagatcctggaccccctggcctgataggttcgcccggacttaagggacagcaaggctccgctggatctatgggtcccaggggcccaccgggagacgtggggttgccaggagaacacgggatccccggtaaacagggaatcaagggagagaagggggatcccggtggcatcattgggccacctgggcttcctggcccaaaaggagaggctggtcccccaggaaagtctttgcccggagagccaggattggacggaaatccaggcgcacctgggcctcgagggcctaaaggagaacgaggcctaccaggcgtacacggaagtccaggagatattggcccacaaggaattggcattccgggtagaactggcgcacagggccctgctggggaaccaggaatccaaggcccaagggggctccctggtctacccggtacgcccggtacgcctggaaacgatggggtgccaggcagggacggtaagcccggacttcccggaccccctggagatcccattgccctgcctctgctcggcgatattggtgcacttctgaagaacttctgtggcaactgtcaggcaagtgtccctggattgaagagtaacaaaggggaggagggcggtgctggcgagcctggcaaatacgatagcatggcacgtaaaggagatatcggaccacggggtcctcccggaattcctggccgtgagggacccaagggcagcaagggcgagagaggctaccccggaattcccggagagaagggagatgagggcctgcaagggattcccggaatacctggcgcacccggtcctaccggtcccccaggcctaatgggtaggactgggcaccctggaccaaccggagccaagggggagaagggatccgacgggcctcccggtaaaccaggccctcccggtccgcctggcataccatttaacgagaggaatggaatgagctccctttataagattaaggggggagtcaacgtaccatcctatcccggaccgccagggcctccaggcccaaagggggacccgggaccggtgggcgagcccggagccatgggactgcctgggttggagggctttccgggagtgaagggcgatcgcggtcctgccggtccccctggaatcgctgggatgagtggaaagccaggggctcctggaccaccaggcgtccctggcgaaccaggcgagcggggaccagtcggcgacatcgggtttcccggaccagagggcccttctgggaagccagggatcaatggtaaagacggtatccctggagctcaggggatcatggggaagccaggcgataggggccctaagggtgagcgcggagatcagggcatccccggtgaccggggatcccagggagagcgcggtaagcccggactgaccgggatgaaaggtgctatcggaccaatgggccctcctggcaacaaagggagtatgggcagccccggacatcaagggcctccgggatcgcccggtattcctggcatcccagctgatgcggtgagcttcgaagaaatcaagaagtatatcaaccaagaagttctccgcatatttgaggagcggatggctgtgttcttgagccaactcaagctgcccgcagccatgctggcagcgcaggcatatggacgccctgggcctcccggaaaagacggcctaccgggaccacctggtgaccccggtcctcagggttacagagggcagaagggggagagaggtgaacctggtatcggcttgcccggttccccaggcctcccagggacttccgcattgggcctccctgggtcccctggcgctccaggaccacagggtccgccaggtccaagcgggcgttgcaatcccgaggactgcttataccctgtttcccatgctcatcagagaactgggggaaactag

SEQ ID NO: 4813 - DNA, 462 bp, Artificial Sequence
  Description of Artificial Sequence: Synthetic coding sequence
ggcattaacggcaaggatggaattccaggtgcccaagggatcatgggaaagccgggagacagaggccctaaaggagagagaggggaccagggaatcccaggggataggggcagtcagggagaaaggggcaagcccggtctgacagggatgaagggagccatcgggcctatgggacctccaggcaataagggaagcatgggctcccctggccaccaaggtccgccagggagccctgggatcccgggaataccggctgatgccgtgtcattcgaagagattaaaaagtatatcaaccaggaggtgctgcgaatattcgaagaaaggatggccgtcttcctttctcagctcaaactgccagccgcaatgctggccgctcaggcgtatgggcgtcccggtccgccagggaaagacggcctaccaggccctcccggagatcccggtccccaggaagtcgacgtatag

SEQ ID NO: 4814 - DNA, 4167 bp, Artificial Sequence
  Description of Artificial Sequence: Synthetic coding sequence
atggctccacggaggaataacggacagtgttggtgcctgctcatgctactgtccgtctctactcccctacctgctgtcacccaaacccgcggagcaacagagactgcttcacaaggacacctcgatctaacacagcttatcggagtgcccttaccctcctctgtcagcttcgtgacgggctacggcggatttcctgcatacagctttggacccggtgccaatgtgggccgtcctgccagaacgttgattccttctacgtttttccgtgattttgccatttctgtcgtggtgaagccctcatctaccagaggcggagtcttgtttgcaattaccgatgcattccagaaggtgatttatctgggactgagactctcaggcgtcgaagacggtcatcaacgtatcatcctatattatacagagcccggatcgcacgtgagtcaggaagcagcggcttttagcgtgcctgtcatgacccatcggtggaatcggttcgccatgatcgtccagggtgaggaagtcaccctgctggtgaattgcgaggagcattcaagaattccattccagcgcagctcacaggctctggcatttgaaagtagtgcaggaatctttatgggcaacgcaggcgctactggtttggagcgatttaccggatcgctgcagcagctaacagtgcatcccgatccacgaacccccgaggagctttgcgaccctgaagagtcatccgcgtccggcgagacatccggcctccaagaggccgacggagtcgccgagattctggaggccgtcacatacacgcaggccagccccaaagaggctaaagtggagcccattaatacacctcccaccccttcctctcctttcgaggacatggagttgtctggagaaccggtaccggaagggacactggaaacgaccaatatgagtatcatccaacattcgagccccaagcaaggatctggcgagattctgaatgacaccctggaaggggtgcatagcgttgatggtgaccctataacagattctggctccggtgctggcgcatttctggacattgcagaagaaaagaacctggcagctaccgctgctggtcttgccgaggttcctattagcactgcgggtgaagccgaagcttccagtgttccaactggaggaccaacgctgtctatgagcactgagaatccagaagagggggtaactcccggtccagataatgaagagcgcctggccgctacagctgctggtgaagctgaagctctcgccagtatgccgggagaagtggaggcctcgggggtcgcacctggagagctggacttgagcatgtccgcgcagtcactgggcgaagaagccaccgtagggccaagtagcgaggactcgctaacgaccgctgctgctgcaacagaagtgtctttgtctactttcgaagatgaggaagcgagtggagttcccactgacggtctcgcacccctgactgcaaccatggcaccagagagagcggttacgtctggccctggcgacgaagaggacctcgccgcagctactactgaagaaccactgatcaccgccggtggcgaggaaagcgggtcccctccacctgatggacctcccctgcctctccccactgtggccccagagcgttggattacgccggcacaacgagaacatgtgggtatgaagggacaggcagggcctaagggggaaaaaggtgatgcaggcgaagagctgcccggtcccccagaacctagcgggccagtaggtccaaccgccggtgctgaggccgagggttcaggtctggggtgggggagcgatgtgggcagcgggtctggcgaccttgtgggttcagaacaactgctgcgcggtcctcctggcccacctggcccaccagggttgcccggaattccaggaaaacctggaaccgacgtcttcatgggacccccagggtcaccaggcgaagatggacctgccggtgaacccggtcctccaggacctgagggccagcctggagtagacggcgcaaccggtctccctggcatgaaaggagaaaaaggagcccgagggccaaatggtagcgttggtgagaagggtgaccctggcaatcgagggctcccaggccctccagggaaaaaaggacaagcgggaccacctggggtgatgggccctccagggcctccaggtccccctggcccacccggtcctggctgcactatggggcttgggtttgaggatacagaaggtagtggtagtacccaactgctgaacgaacccaagctgtctaggcctactgccgcaattggccttaaaggagaaaaaggggaccggggacctaagggtgagcggggaatggacggggcaagtattgtgggtccccctggacctcggggaccccctggacacataaaggtgctgagcaattccctgatcaatatcacccacgggtttatgaatttctcagatattccggagttggttggaccacctgggccagacgggctaccagggttaccgggatttcctggaccaaggggccctaagggtgatacagggcttcctggcttcccgggtctaaaaggcgagcaaggcgagaaaggcgaacctggggcaattctcaccgaagacatccctctggaaaggctcatgggaaagaaaggcgaacccggaatgcacggtgctcctggcccaatgggtccaaagggcccacccggtcacaaaggagagttcggtctgcccggtagacccggaaggccaggccttaatggattaaaggggacaaagggagacccgggagtcattatgcagggacccccagggctcccgggacctccaggcccacccggaccacccggtgcagtcatcaatattaagggcgctattttccctatcccagttcggcctcactgtaagatgccagtggacaccgcccaccccggaagtccagagctgattacctttcatggagtcaagggggagaagggaagctgggggctccccggttcaaaaggggagaaaggtgaccagggagcccaggggcctcccggtcctccactcgatctcgcatatttgcgccacttcctgaataacctgaagggcgagaatggagataaggggttcaaaggcgagaaaggcgaaaaaggagacattaacggctcgtttttaatgagtggcccaccaggtctacctgggaatcccggacccgcaggacaaaagggggaaacggtggtggggcctcagggacccccaggcgcaccaggcttgcccggaccacccggattcggacgcccaggagacccagggcctccaggtcccccaggtccgcctgggccacctgctatactcggggcagccgtggccttacccggacccccaggtccccctggacagcccggactcccaggctcaaggaatcttgtcactgccttctctaatatggatgacatgctgcagaaggcacatctggtgattgagggaacattcatctacctgagagactccacggagtttttcatccgcgtaagggatggttggaaaaagctccagctgggcgagctcattcccatccccgctgattcaccaccccctcccgcactaagctccaacccccaccagcttctccctcccccaaatccaatcagctccgcgaattacgagaaacctgcactccacttagcggctctgaacatgcctttctcgggtgatatcagagctgactttcagtgctttaaacaagcccgtgctgctggcctgctcagcacctacagagcctttctgagctctcacctgcaggatctgagcacgatagtgagaaaagctgaaaggtacagtttaccgatcgttaatctcaaaggccaggtgctttttaacaactgggacagcatttttagcgggcacggcggacagttcaatatgcacataccaatttatagtttcgacggaagagacattatgacagacccctcgtggccacagaaagtgatctggcacggttcatccccccatggtgtccgactggtcgacaattactgtgaagcatggcgcaccgcagacacggccgttacaggcttggcaagtcccctatccaccggcaaaattctggaccagaaggcatattcttgcgctaataggcttatagtgctgtgtattgagaatagtttcatgaccgacgcccgaaaatag

SEQ ID NO: 4815 - DNA, 2238 bp, Artificial Sequence
  Description of Artificial Sequence: Synthetic coding sequence
atggcgccaaggcgtaacaacggacaatgttggtgcttacttatgctactgtcagtgccacttccaagctcagtgtcattcgtaacaggatatggaggtttccctgcatacagcttcgggccaggtgctaacgtgggtcgccctgccaggacgcttataccctcaactttcttcagggacttcgctataagtgtcgtagtcaaacccagttcgacacgcggaggggttctgtttgctattacagatgcgtttcaaaaagtcatttacttggggcttcggctatcaggggtggaggacggccatcagcggatcatcctgtactacaccgaacctggctcccatgtaagtcaagaagctgccgctttcagtgtgcccgtcatgacacatcggtggaacaggttcgcaatgatcgtgcagggggaggaggtcaccctcctcgttaactgtgaggaacacagccggatcccctttcagcgcagttcacaggctctggcctttgaatcctccgctggaatctttatggggaacgccggtgctactggcctcgaacgatttacggggtcacttcagcagcttaccgtgcaccctgaccctcgaaccccggaagagctatgtgacccagaggaatcgagcgcctccggggagacgagtggcctccaagaagcagacggggtggccgaaatactcgaagctgtgacctatactcaggcctcgcctaaggaggccaaggtggagcctatcaataccccacctacaccttctagcccctttgaggacatggagctgtctggagaacccgtcccagaaggtacactcgaaacaaccaacatgtccatcatccaacacagtagccctaagcaaggtagtggggagattctcaatgacaccctggagggagtccactccgtagatggtgatcccattacggatagtggctccggagcaggagcctttttggacatcgccgaggaaaagaacttagccgctactgccgcaggccttgcggaggtgccaatatccacagccggagaagccgaagctagcagtgtccctaccggaggcccaacactgtcaatgagcaccgagaacccagaagagggagttacccctggtcctgataacgaagaacggttagcagcaaccgccgcaggggaagccgaggctcttgcatcaatgcccggagaagtggaggcgtctggagtagcacccggagaacttgacctctctatgagcgctcagtcgctcggcgaggaggcgacagttgggccatcctctgaggatagtttgaccacagcagcggctgctaccgaagtctcactctcgacattcgaggatgaagaagcttcaggcgtgcctaccgatggactcgccccattgacagcgaccatggctcccgagcgcgcagtcacttccggccctggagatgaagaagacttggccgctgcgaccaccgaagaacctctgattacagctgggggtgaggaatctgggagccctccgccagatggtcctccgctgccattacctactgtggcccctgagcgctggatcacccccgcacaacgcgagcatgtcggcatgaagggtcaagcaggacccaaaggagagaaaggcgacgccggagaggaattgccgggtcctccggagccatcaggccctgtgggccctacggcaggagccgaggccgaaggctcgggtctgggatggggttcggacgtgggttccggatccggagaccttgtggggtcagagcagctcctcagaggccctcctggaccgccagggcctcccggtctaccaggtatcccaggaaagcctggaaccgatgtgttcatgggccctccagggagtccaggagaagacgggcctgccggtgagccagggccacctggtccagaggggcagccaggtgtggatggggctacaggccttcccggaatgaagggagaaaagggggctagaggcccaaatggtagcgtaggggaaaaaggagatcctggtaaccgaggactgcccggaccacctggcaagaagggccaggccggaccaccaggggtgatgggacctcctgggccacccggaccgccaggtcccccagggcctggctgcacaatgggtctggggtttgaggacactgagggctccggtagcacccagctgctcaacgagcctaaactatcatctcctacacccactccacagttttatgatttccatctggcaattgtggagctatag

SEQ ID NO: 4816 - DNA, 4815 bp, Artificial Sequence
  Description of Artificial Sequence: Synthetic coding sequence
atgtgggttagttgggcacctggcttgtggctactgggcttgtgggcgactttcggacatggagccaacactggggctcaatgccccccaagccaacaagaagggctgaagttggagcactcaagctccttgccagccaatgtgactggttttaacttgattcacagattgtccctgatgaagacatcagccataaagaaaattcgcaacccgaaggggccacttatcctcaggctgggcgctgccccagtgacacagccaacgcgccgtgtgttcccacggggactgcctgaggaatttgcactggtactcacactactacttaagaagcacacacatcaaaaaacctggtacctgtttcaagtgaccgatgctaacggatatcctcaaatcagtctcgaagtaaatagccaggaaaggtctctcgaactcagggcccagggacaggacggggacttcgtcagttgcatctttccagttccccagcttttcgacctcaggtggcacaagttgatgctgtccgtcgcgggtagagtcgcctctgtccacgttgattgcagtagtgcttcaagtcaaccattggggccacgaaggcccatgcggcctgtgggccacgttttcttgggactggatgcagagcaggggaagcctgtctcattcgaccttcagcaggtgcacatttactgcgacccagaactagtattagaagaaggctgttgtgagattctcccagcaggatgtcctccggagaccagcaaggcgaggagggatactcagtctaatgagttaattgaaattaaccctcagagcgagggaaaagtgtatacaagatgtttttgcctggaagagccacagaattccgaggtcgacgcccagctgacagggaggattagccaaaaggccgagcggggagctaaggtgcatcaggagaccgcggcagacgagtgccccccatgcgtgcatggagctcgtgattccaacgtctccgagtggcgagtgggtcctgagggagggaagggtgagcgcggtttgccgggtcctcctggcagcaaaggcgaaaaaggtgccagaggtaacgactgcgtgcgtatttcccctgatgccccacttcagtgcgcagagggaccaaagggggagaaaggagagagtggtgctcttgggccatccggcctgcctgggagtaccggggagaagggccagaaaggcgaaaagggtgacggcggaattaaaggtgtgcctggcaagcccggaagagacggtaggccaggagaaatatgcgttatcggccctaaaggtcagaaaggtgaccctgggttcgtgggacctgagggacttgcgggtgagccgggaccgcctggcttgcccggacctccgggtatcggacttcctggcactccaggcgaccctgggggacccccaggcccaaagggtgacaagggcagctctggtattcccggaaaggaggggcctgggggaaagcccggaaagcccggagtgaagggtgaaaagggcgacccatgtgaagtgtgcccaacactccctgagggattccagaatttcgtggggcttcctggcaagcctggccctaagggcgaacccggtgacccggtacccgcacgcggagaccccggaattcagggcatcaaaggcgagaaaggcgagccttgcctcagctgctcatcagtggtcggtgcccaacacctggtatcatcaacgggagcttccggcgacgtcgggagcccaggctttggactgccagggctgccggttaaggccggagtcccaggcctgtccccaggagggaatttcggcgaagccggacctgccggatcacctgggcctcccggtccagtgggcccagccggaatcaagggagctaaaggcgaaccctgtgaaccgtgcccggcactgtcaaacttgcaggacggggatgtaagggtcgtggccctgcctggcccatccggtgaaaagggggagccagggccacctgggttcggactgccgggaaaacagggcaaagccggagagcggggtctcaagggtcaaaaaggtgatgccggtaacccaggcgaccctggcacaccagggactactggaaggccgggattatcgggtgagccaggagttcagggcccagctggccctaagggggaaaaaggagatggctgtacggcctgtcctagcctgcaaggaaccgtcaccgatatggccggacggcctggacaacctggccctaaaggcgagcagggcccagaaggcgtagggagacctggtaaacccggtcagcctggcctgcccggagtacaaggaccacccggattgaagggggtgcaaggcgagcctggcccacccggtcgtggagttcagggaccacagggggagcccggagccccaggactgccaggaattcaggggctgccagggcctcggggaccgcctggacccaccggtgaaaaaggagcgcagggcagccccggagtgaagggggcaaccggccctgtaggccctccaggggcttccgtgtccgggccacccggacgtgatggccagcaggggcaaacggggcttaggggcacccctggcgagaaaggcccacggggagagaagggagagccgggagaatgctcctgccctagccagggcgacctaatttttagcggcatgcccggagctcctgggttatggatgggctcaagctggcagcccggtccacagggtcctcccggaattcctgggccaccaggtccccctggggtacccggtttacagggggtacccggtaataatggcctgcctggccagcccggactgacagctgagttaggcgcattggcattggggagccattggggatctcccagtatctgtggggattgtgtacaaggtcaaagagctcaccctggctacctcgtggagaagggagagaaaggtgatcagggaatccctggtgtgcccggattggacaattgcgcacagtgctttctgagcctggaaagaccaagagctgaagaggccaggggagacaattctgaaggggatcccggatgcgtggggtctccaggacttcccggaccaccagggctgccgggtcaaaggggggaagaggggcctccaggcatgcgaggatctcctgggccacctgggcctataggacctcctggatttcccggagctgttggctcccctggactcccgggactgcagggagagcgaggcttgacaggattaactggagacaagggagagcccggacctcccggtcagcctggctaccccggagccaccgggccacctggactgcccggaatcaagggtgagagaggatacaccgggtctgctggcgagaagggcgaaccgggacctcctggcagcgaaggcctcccaggccctcctggccctgcgggacccaggggagagcggggaccccaaggaaacagtggggagaagggggaccaaggtttccaaggccagcctgggtttcctggccctccagggccacctgggtttcccggtaaagtaggctcacctggacctccagggccacaggctgagaaggggtcggaagggatcagaggcccatcgggtctcccgggaagcccaggccctccaggtcccccaggcattcaggggcctgccggactcgatggactcgacggtaaagacggcaagccgggtctaagaggcgatcccggtcctgcgggaccccctggccttatgggcccacccggttttaaaggaaagacggggcaccccggactacccggaccaaagggcgactgcggtaaaccagggccacctggaagcacgggcaggcccggagctgaaggtgagcccggtgcaatgggcccacagggtcggccaggcccacctggacatgtcggtcccccaggcccacctgggcagccaggacccgcagggattagcgctgtggggctgaagggagatcgcggtgctacaggtgagaggggcctagccggtctgccaggacagccaggcccacctgggcatccaggccctcctggagagcccggaactgatggagctgctggaaaggaaggtcctccgggaaaacagggcttttacgggcctcctggccctaaaggggacccaggggctgccggacaaaaagggcaagctggcgaaaaaggacgcgctggcatgcccggaggacccggaaaaagcggctctatgggacctgtgggaccccctggcccagccggagagaggggacaccccggagcgccaggaccctcaggttctcccggactgcccggtgtgcccggtagtatgggtgatatggtcaactatgatgagatcaagaggttcatccggcaggaaattattaagatgttcgatgaaagaatggcatattacactagcagaatgcaatttcctatggagatggcagccgcacccggtcgcccaggcccacccggaaaggacggcgctccagggaggccaggtgcccctggaagccccggactccctggccagatagggagagaggggagacaagggctccctggagtgcgaggtttgccgggtactaaaggtgaaaagggtgatatcgggatcggcatcgcgggagagaatggtctccccggaccacccggaccccaggggccacccggatacgggaagatgggggcaaccggccctatgggacagcaaggtatacccggtatccctggcccacctggtcctatgggccagcccggaaaggccggacattgcaacccttctgactgtttcggggctatgcctatggagcagcaatatccaccgatgaagaccatgaagggccctttcggttag

SEQ ID NO: 4817 - DNA, 4815 bp, Artificial Sequence
  Description of Artificial Sequence: Synthetic coding sequence
atgtgggtatcctgggcacctggactgtggctgctgggtctctgggctaccttcggccacggtgcaaacactggagctcagtgtcctccaagtcaacaggaaggactgaagcttgagcatagctcctcactccctgctaacgtcacaggatttaatctgatacatcgcctgagtctcatgaagacgagtgccattaaaaaaatccggaatccgaaaggcccactgatccttcgactgggagccgctccagtcactcagccgaccaggcgggtgttcccacggggacttccggaagagtttgccctggtgctcaccctcctgctaaaaaaacatacccatcagaagacatggtatctctttcaggtgactgatgctaatggttaccctcagataagcctggaagttaacagtcaggaacgttcccttgaactgagagcccagggccaggacggcgattttgtgagctgcattttcccagtgccgcagctcttcgatctgcgatggcacaaactaatgctctccgtggccggtcgagttgcctccgttcacgtggattgttcctcagcgtctagtcagcccctgggccctcggaggcccatgcggcctgtcgggcacgtcttcctcggactcgacgccgagcaggggaagcctgtgagctttgacttgcaacaggtacacatatattgtgatccagagctcgttctagaagaagggtgttgcgagattttgcccgcaggatgtccgcctgaaacttctaaggcacgacgagatacccagtctaatgagcttatcgaaattaacccacagagtgaaggtaaagtatacactcgctgtttctgtctcgaggaaccccagaactcggaagtcgatgcacagcttactgggaggataagccagaaagccgaacgaggagctaaggtgcatcaagagaccgccgcagatgagtgcccaccctgtgttcacggagccagggattctaatgtcaccctagctccctcgggtcccaaaggtgggaagggcgaacgcggtcttcctggcccaccaggttcaaagggcgaaaaaggagccagagggaacgattgcgtgaggatctcaccagatgccccactccagtgtgcagaagggcctaagggggaaaaaggcgaatctggcgctctaggacctagtgggctccccggaagtaccggtgaaaaaggacagaagggggagaagggggatggaggcatcaaaggggtgccaggtaagcctggcagagatggcaggcctggcgagatttgcgtaatcggtcctaagggccagaagggggatcccggtttcgtcggccctgagggcttggccggagaacccggtcccccaggcctgccgggaccccctggaatcgggctccctggcactccaggggacccaggcggtccccctgggcctaagggggataagggaagctcaggtatccctggcaaagaaggtcctgggggaaaacccggaaagcccggtgtgaaaggagaaaagggggatccttgtgaggtgtgccccacccttccagaggggttccagaactttgtaggcttgccaggcaaacctgggcctaaaggtgaaccaggcgacccggtaccagcacgcggagatccgggtatccagggaatcaaaggagagaagggggaaccgtgcctcagctgcagctctgtcgtgggtgcccaacacctagtctcttccaccggcgcatctggtgacgtaggatctccgggtttcggactccccggattgccaggaagggcaggcgtgccgggtcttaagggcgaaaaaggaaattttggcgaggcaggccctgcaggcagcccaggccctccagggcctgtggggccagctgggatcaaaggggctaaaggtgagccctgcgaaccatgcccagcgttgtcaaatctacaggacggcgacgtgcgggtggtggccctcccaggcccttccggggaaaaaggcgaacccggaccaccgggattcggattaccgggaaagcagggcaaggccggagaaagagggctcaagggacagaagggagatgcaggcaatcccggagatccgggtacgcccggtactactgggaggccagggctgtccggtgaacccggtgtgcagggccctgccggtccaaagggagaaaaaggcgatggctgcacagcgtgcccttccctgcaggggacagtgaccgacatggctggtcgcccaggccaaccagggcctaaaggagaacagggccctgaaggagtgggaaggccaggtaagcctggacagccaggactccccggagtacagggcccacctggccttaagggggtccagggggagccaggaccccctggaagaggcgtacagggaccacaaggagaacctggcgcacctggcttgccgggaattcaggggttgccaggtccaagaggaccccctgggcctaccggagagaagggagcgcagggttcccccggagtaaagggtgcaaccggcccagtgggtcctcctggagctagcgtttcaggaccccctggcagggacggccagcagggacaaaccggcctgcgagggacacctggggaaaagggtccccgtggcgaaaagggtgagccaggcgagtgcagctgccccagccagggtgatctgatctttagcggtatgcccggagcccctggactctggatgggctcatcctggcagcccggacctcaagggccaccgggaattccaggccctcccggacccccaggtgtccccggattgcaaggagtaccagggaataacgggttgcctggccagcctggcttgactgccgaactgggctctcttccaatcgagcagcacctactgaagtctatttgtggggactgcgtgcaaggccaacgggcacaccccggataccttgtcgagaagggtgagaaaggcgatcagggtatccctggtgtgcccggactagataactgtgctcaatgctttttgagcctggaacgaccacgcgctgaggaggctcggggagacaactccgagggagatccaggttgtgttgggtcacccggattgcccggacccccagggctgcctggtcagaggggagaagaggggcctcctggtatgagagggagtccaggccctcccggaccgataggccctcccggtttccctggcgctgtcgggtctcccggactacctgggcttcagggcgagcggggactgacgggcctgactggcgataagggagaacctggaccacctgggcagcctggctatccgggtgcgactggccctcccggtctcccaggcattaaaggggaaagaggttacaccgggagcgccggagagaaaggagagccgggaccgccaggcagtgagggcctgcctggtcctccgggacccgctggtccacgcggagagaggggcccacaggggaattcaggagagaagggcgatcaagggttccaagggcaacctgggttcccgggaccccctggacccccagggttccccggaaaagtgggatccccaggacccccaggtccacaggcagaaaaaggttcagagggaattcgcggaccttccggtctcccagggtctccgggaccccctgggccacccggaatccaggggccagctggtctggatgggctcgacgggaaagatggaaagcctggcctgcgtggggatccaggaccagcaggcccacccggtctcatgggccctcccggtttcaaagggaagaccggccatcccggtctgccaggaccaaaaggggactgcggcaagcccggaccccctgggtcaactgggagaccaggagctgagggtgagccaggagcaatgggtcctcagggacggccaggacccccaggccacgtgggaccaccgggaccacctggacaaccaggaccggcaggtatctctgccgtgggcctgaaaggcgacaggggagccaccggagagcggggtctggcaggcctgcccggtcaacccggaccacctgggcaccctgggcctcccggagaacctgggaccgacggggcagctgggaaagaggggccaccaggtaaacagggtttctacggccctcctgggccaaagggcgacccaggggcagcgggtcagaagggccaggctggggagaaaggacgtgccggtatgcccggtggacctggcaagtcaggctccatgggccctgtggggcctccaggacccgcaggtgaaagaggtcaccctggcgcaccaggtccttccgggtcccctggactccctggggtgccaggctcaatgggtgacatggtgaattatgatgagatcaaacgcttcatccgccaggaaattatcaaaatgttcgatgaacgcatggcctactacaccagcaggatgcaattccccatggagatggcagccgctcctggtagaccgggtcctcccggaaaggacggtgccccaggccgaccaggcgctcccggatcaccgggattgccaggacagatcggcagagagggaagacaggggttaccgggagtgcgcggattaccaggcacaaagggagagaagggcgacataggaatcggaatcgctggtgaaaatgggctgcccggtccacccggaccacagggtcccccaggatacggaaagatgggcgcaactggaccgatgggccagcagggcatcccgggtattccaggacctcccggacctatgggccagccaggcaaagccggtcactgtaacccctctgactgttttggggcaatgccaatggaacagcagtatcctcctatgaaaacaatgaaaggtccctttgggtag

SEQ ID NO: 4818 - DNA, 4494 bp, Artificial Sequence
  Description of Artificial Sequence: Synthetic coding sequence
atggatgttacaaagaagaataagcgcgacggtacagaagtgaccgagagaatcgtgactgagacggtcaccacccgccttaccagtctacctcccaagggtgggacctccaacgggtacgctaaaaccgcctccttgggcggaggatctcgcctggaaaagcaaagcctaactcatggttcaagtggatacataaatagcactggctccacaagggggcatgctagcaccagcagttaccggagagcgcattcccccgcatcaaccttacctaactcccctggaagcacgttcgaaaggaagacacatgtgaccaggcacgcatatgaaggatcatcaagcggcaactcaagtcccgagtacccgaggaaagaatttgcttcaagctcaacaaggggtagatcccaaaccagagaatctgagatacgtgtgcgccttcagtccgcatctcctagtactcggtggacggaactggatgacgtgaaacggctgctgaagggatcccgctcggccagtgtttctccgacaaggaacagtagcaacaccctcccaattccaaaaaagggtacggtggaaactaaaattgtgactgcttcctctcagtcggtgtcaggtacttacgacgccaccatacttgacgctaatctcccgtctcatgtgtggtccagtaccctgcctgctgggtctagcatgggcacctatcacaacaatatgactacccagtcttccagcctactgaatactaatgcctattcagcaggctcggtattcggagtgcctaacaacatggctagttgttctcccacccttcatcccggtctttcaacttcctcgagtgtgtttggtatgcagaataacctggcccctagtcttacaacgctgtcacatggcacaactacaacatccacagcttatggtgtgaaaaagaatatgccccagtcaccagcagctgtcaatactggagtctctactagtgcagcatgcacaacttcagtccaatcggatgacttactgcacaaggattgtaagttcctcatcctggagaaggataacaccccagctaaaaaggaaatggagctcctgataatgactaaagattctgggaaagtctttactgcgtcccctgcatccattgccgctacatccttctcagaggacactcttaaaaaagaaaagcaggctgcatataatgctgattccggactgaaagccgaagccaacggtgacttaaagaccgtgtccacaaaaggcaagacaaccaccgcggatattcactcgtatgggagctccggaggcggaggctcaggcggtggtggtggagtgggtggcgctgggggtggcccatggggccctgccccagcatggtgtccctgtggaagttgctgtagctggtggaaatggctccttgggctgttgctgacttggcttctcttgctgggcttacttttcggcttgatagcacttgccgaagaggtgcgcaaactgaaggccagagttgatgaattagaacggataaggcgaagcatattaccatatggtgactcaatggatagaatcgagaaggacagactccaagggatggctccagctgccggtgctgatctggacaagatcgggcttcactcagattcccaggaggaactctggatgttcgtgagaaaaaaacttatgatggaacaggagaacgggaacctgagaggttctcctggtccaaagggggatatgggctccccgggacccaaaggagaccggggattccccggaacccctgggatccccggtccacttggtcatcctgggccacaggggccaaaaggccagaaaggcagtgtcggcgacccgggtatggaaggtcctatggggcagagaggtcgggagggcccaatggggcctcgaggcgaggctggtcctccgggatcaggagaaaagggggagcggggagcggctggagaacctggaccacacggacccccaggcgtgcctgggagcgtgggcccaaaaggtagctccggtagtccaggtcctcagggtccccctggcccagtaggactccaaggcctaaggggcgaagtggggctgccgggtgttaagggagataaagggccaatggggcctccaggtccaaaaggcgatcagggcgagaagggacctcggggacttacaggggaaccagggatgaggggccttcctggagcggtgggtgaacccggagccaagggggcaatgggcccagccggacctgacggccaccaaggcccacgaggggagcaagggctcactggtatgcccggaatcagaggcccaccaggaccttccggggaccctgggaagcctggcctcaccggcccacaagggcctcaaggcctgcctggcacgcccggaagacctggcatcaaaggggagcccggtgctcccggaaagattgtgacttccgaggggtcctcaatgctcacagtccccggacccccaggacccccaggagccatgggcccacctggcccacctggcgctcccggaccagcagggcctgcaggactacctgggcaccaggaggtcctgaatttgcaggggcctccaggtcctcccggacctaggggacctcccggtcccagcattcccggtccccctgggccacggggtcctcctggcgaaggattacctgggcctcccggaccgccaggttccttcctgagcaacagtgaaactttcctgagcggcccacctggacctcccggaccacccggacccaagggtgatcaggggccacccggaccaagaggtcatcagggggaacagggactgcccggattcagtacctccggttcgtcgtcattcggtctgaacctccaggggccacccggtccccctggaccccagggacctaaaggcgacaagggcgaccctggtgtaccgggtgctcttggaattcctagcggaccatccgagggaggatcgtccagtactatgtacgtgagtggaccaccaggcccacctggcccacccggaccaccaggtagtatctcctctagtggccaggaaatccagcagtatatttccgagtatatgcagagcgacagtattcgcagctacctgtctggtgttcaaggccctcccggacctccaggtcctcccggtccagtgacgaccataaccggtgagacatttgactacagtgagttggccagtcatgtggtgtcttacctacgtacctctggctacggggtgtctctgttctcatcctctatctcaagcgaggatatccttgccgtcctgcagagggatgacgtccggcagtatctacgccagtatctgatgggcccacggggtccgccaggtccaccaggcgcatcaggtgatggatcactgcttagtttagactatgctgagctgtccagtagaatacttagttacatgagctcttcaggaatcagcattggccttcctggtcccccaggacctcctggcttacccggaacgtcttacgaagaattgctgagtttgttacggggtagcgaattccgcggtatcgtcggcccaccgggtccacctggccctccaggtattcctgggaatgtatggagctccatcagcgtagaggatcttagctcctatctgcacacagcagggctgagttttatccctggtccaccaggtcccccaggccctcccggtccgagggggcctcctggggtgagcggtgccttggcaacctatgccgctgagaactctgacagttttagaagtgaactgatttcttatctgacttcaccggatgtacgttcattcatcgtgggccctccaggccctcccggtcctcaggggcctcctggcgattctcggttgctgtccacagatgccagccattccagagggtcttctagcagttcccattcatcgtcagtccgcagggggagcagttattcttcgagtatgtccactggcggaggaggagcagggtcactcggagccggtggtgcttttggggaagccgctggagacaggggcccttacgggacagacatcggaccgggtggcggatacggcgcagccgctgaggggggtatgtacgccggaaatgggggacttctgggcgctgatttcgccggtgatctcgattacaacgagcttgctgtgcgagtgagtgaatcaatgcaaagacaggggttgctccagggaatggcctacacggtccagggtccccctggacagccagggccacaaggcccacccggaatctcaaaggtattcagcgcctattcaaatgtgactgctgacctaatggattttttccagacctacggtgctatccagggtccaccaggccagaagggtgaaatgggcaccccaggacctaaaggtgatcgcggaccagccggtccaccaggccacccaggtccacctggtccacgcggacataagggcgagaaaggagataagggggatcaggtgtatgcaggaaggcggagaaggagatcgattgctgtgaagccatag

SEQ ID NO: 4819 - DNA, 1254 bp, Artificial Sequence
  Description of Artificial Sequence: Synthetic coding sequence
atggacgtaactaaaaaaaacaagcgcgatgggaccgaggtcaccgaacggattgtgaccgaaactgtcaccacaagactgacttcacttcccccaaaaggtggcacatccaatggctatgcgaagaccgcatccctcgggggaggtagtaggttagaaaaacagagtctgactcacggctcctcggggtatatcaatagtactgggtctacgaggggtcatgcaagcacttcttcttacagacgcgcacacagtccagccagtacgttgcccaatagtccgggatcgacttttgaacggaaaacccatgtgactagacatgcttacgaaggttcctcatccgggaattcttctcctgagtatccaaggaaggagtttgcctcctcctccactcgcggtcgctcgcaaacaagagaaagtgaaatcagagtgagattacagtccgcgtccccttctacgcggtggaccgagctcgacgatgtgaagcgccttctgaaagggtccagatcggctagtgtgagcccgacccggaacagtagcaacacattgcctatcccgaaaaaaggcacagtggagaccaaaatcgtgacggcctcgagtcagtctgtctctggaacctacgatgctacaattttggacgccaacctcccatcacacgtgtggagttcgactctgcctgcaggttcctcgatgggcacataccacaataatatgacaactcagtcctcttcattacttaatacaaatgcttactctgccggtagcgtgtttggcgtccctaacaatatggcatcttgcagtcccaccctgcacccaggactgtccacctcaagtagcgtgttcggcatgcaaaacaacctggctccatcattgacgacactttcgcacggcaccacgacaacatctaccgcctacggagtgaaaaaaaacatgccacagtcacccgcagcggttaataccggagtctccaccagcgcagcctgtactacgtcggtgcagtccgacgatcttcttcacaaggactgcaagttcttgattcttgagaaagataatactcctgccaagaaggaaatggaattactcattatgaccaaggattcagggaaagtatttacagcgtcgcctgccagtatcgccgctacttccttcagtgaggataccttaaagaaagagaagcaagcggcttataatgccgattcaggcttgaaggctgaagccaacggaaagaacaagtatgactgttgccctccgtag

SEQ ID NO: 4820 - DNA, 201 bp, Artificial Sequence
  Description of Artificial Sequence: Synthetic coding sequence
tagtatggcgctattcaagggcctcccggacagaagggagagatgggcaccccgggaccaaaaggggaccgaggtcctgctggccctcccggacacccgggacctcctggaccccgtgggcacaagggggagaagggggacaagggtgatcaggtgtacgcaggacgcaggcgcagacgaagcatcgctgttaaaccttag

SEQ ID NO: 4821 - DNA, 1815 bp, Artificial Sequence
  Description of Artificial Sequence: Synthetic coding sequence
atggacgtgactaaaaaaaacaagcgcgacggcacagaagtgactgaaagaattgtgaccgagactgtaacgacccgcttgacgagcctgcccccaaagggtgggacatcaaacggttacgcgaagactgcttctttaggcggtggttcccgcctggagaagcagtcattgactcacggaagtagtggatacataaacagcactggctcaacccggggacacgcctctaccagttcttataggcgagctcattccccggcatcgactctccccaactcgcccggatccacttttgagcggaagacacatgtgacaagacacgcctatgaagcatctagctccactcgcggaaggagtcaaacccgcgaatccgagatccgagtcaggctccagtctgcgagcccctccacaagatggactgagcttgacgatgtgaaaagactgctgaagggatcaagatcggccagcgtgtcgcccacacgaaacagctccaatacgctacccatcccaaagaaggggaccgtcgagaccaaaattgtgaccgcatcatcccaatcagtgtcaggcacatatgacgctacaattctcgacgctaatctgccctcacacgtctggagctccactctgcctgccggttcgtctatgggcacatatcataacaatatgaccacacagtcctcctcgctgctcaacactaatgcctatagcgccggatcggtatttggagtgcccaataacatggctagctgttctcctaccctgcatcctgggctgtccaccagctccagcgtttttggcatgcagaacaatctggcgccttccctgaccacactgtcacatgggacgaccaccactagcacagcctatggcgtgaagaagaatatgccgcagtcaccagcggcagtaaacacgggcgtgtctacttctgccgcatgcactactagtgtacagagtgatgacctcctgcacaaagattgtaaattccttatcttggagaaagacaacactccggctaagaaagaaatggaattactgattatgaccaaagactcgggcaaggtcttcacggcaagtcctgcctcgattgcagctacgtcttttagcgaagatacccttaaaaaggagaaacaggccgcttacaatgcagactcaggtttgaaagctgaagctaacggtgatcttaagactgtgagtacaaaaggcaaaaccaccaccgctgacattcactcctacggttcaagcgggggtggagggagtgggggaggaggcggtgtcgggggagcgggaggaggaccatggggtcccgcacctgcctggtgtccctgcggctcgtgctgtagttggtggaagtggctgctaggtctgctcttgacgtggctgctgttgcttggtttgttgttcgggttgatcgcccttgcagaggaagttagaaagttaaaggccagggtagatgagttggaaagaatacggagatctattcttccctatggagatagtatggataggattgaaaaggaccgcttgcagggcatggcgcctgctgctggtgcagacttagacaagatcggccttcactcggacagccaggaggaactgtggatgtttgtccgtaagaagctgatgatggagcaagagaacggaaatctcagaggaagcccagggccaaaaggcgacatgggatccccaggacccaaaggtgatcgagggttccctggcactcctgggattcccggacccctcggccatcccggtccacagggaccaaagggacaaaagggaagcgtgggcgaccccggaatggaggggccaatgtag

SEQ ID NO: 4822 - DNA, 3951 bp, Artificial Sequence
  Description of Artificial Sequence: Synthetic coding sequence
atgagctccggcgatcctgcccatctgggactctgtctctggctctggcttggagcgacgttagggcgagagcaggtgcaggctagcggcctgcttagactggccgtgctgccagaagatcgccttcagatgaagtggcgagagagtgagggaagcggactcggctatctcgttcaggtgaaaccgatggctggggactcagagcaggaagttatcctaactaccaaaactcccaaggcaaccgtcggtggattgtctcctagtaaaggatatactttacagatcttcgagctgaccggctcgggaaggttcttgctggctcggagggaattcgttatcgaagatctcaagagtagctcgctggacagatcttcgcaacggcctcttggatccggggcacccgaaccaacccccagtcataccgggtctcctgatcccgaacaggcatccgagccacaagtggccttcaccccctcacaggacccaaggactcccgcaggacctcaatttcggtgcctaccgccagtacctgcagatatggtgttcctggtggatggctcttggagtatcgggcattcccacttccagcaggttaaagatttcctagcctctgtcatagctccattcgaaataggcccagacaaagtgcaggttggactgacacagtatagtggggacgcacaaacagagtgggatttgaatagcttatcaacaaaagaacaggtcctggctgcggtcaggcggcttcggtacaagggtgggaatacttttacgggcctggcgctcactcacgtcctgggacaaaacttgcagccggctgccggactccgcccagaggctgctaaagtcgttatcctggtgacagacggtaagtctcaggatgacgttcataccgctgcacgggtgctgaaggatctaggtgttaatgtattcgcagtcggggttaaaaacgccgacgaggcagagctccgcctgctcgccagccccccaagagatatcacggtgcactccgtcctggacttcctccagctgggagccttagccggtcttctgtcccggctgatctgtcaacggttgcagggcggaagtccaagacagggcccagcagctgccccagcgctcgacactcttccggcaccaacttctttggtgcttagccaggtgaccagcagctccatcaggctgtcctggactcccgcacccagacaccccctcaagtatttgattgtttggcgcgcaagccgtggaggcaccccaagggaagtagtggtggagggccctgcagccagcacagagctgcataacctcgccagtcggaccgagtacctggtttccgtatttccaatctatgaaggtggcgtgggggaagggctgagaggattggtgactacagcgcctctcccccctcctcgggctttaaccctggctgctgttacacctcgaacagtacatctcacctggcagcctagcgcaggggctacccactacctagtccggtgttcaccagcatctcctaaaggagaggaggaagagcgcgaggttcaggtgggcagaccagaagtgcttctggatggtctcgaaccagggcgtgattacgaagtctcggtccagtccctccggggtccagaagggtcggaggcgcgaggaattcgagcgagaacccccacgctggccccacctcgccatctgggcttctccgacgtgtcccatgatgcggcacgcgtgttttgggaaggcgcaccgcgacctgttcgccttgtgcgagtgacatacgtttcctcggagggcggtcattctggccaaaccgaggcacctggcaacgctacttcagccactcttggacccctcagctcaagtacgacctatactgtgcgagtgacctgcctgtatcccggtggcggtagctcaacactgactgggagagttactacaaagaaggcaccatctccctcacagctatctatgactgagcttcctggagacgctgtccagctggcctgggtggccgcagcaccatcaggagtcctagtataccagatcacatggactcccttaggggaaggcaaagcccacgaaatctcagtgccagggaacctcgggacggcggtactgcctggattaggccgtcataccgagtacgatgttaccatcctggcttattatcgcgatggcgctcggtctgatcctgtcagtttgcgatacaccccctcgacagtaagtaggagccccccatccaatttggccctggctagtgagactcccgactcgctgcaggtgtcttggactccacctctgggacgagtcctccactactggttaacttacgctcccgctagtggcctaggccctgaaaaatcagtctctgtaccaggcgctagatcacatgtcacacttccagatcttcaggctgcaacaaagtaccgagtgctggtgtccgcaatctatgccgctggaaggtctgaggccgtgagtgctaccgggcagactgcgtgccccgctcttcggcctgatggctctcttccgggttttgacctgatggtcgcattcagcctcgtcgagaaagcctacgccagcatccggggagttgcaatggaaccatctgccttcggcggtacacccacctttacactatttaaagacgctcagctaacaaggagggtgtccgacgtgtacccggcacctctgccccctgaacacaccatcgtattcctggttcggctgctgcccgaaacaccgagagaggccttcgccctctggcagatgactgctgaggactttcagccgctgctgggcgtgctgcttgatgccggaaagaagtccttgacctacttccacagggatccccgagcagccctgcaagaggcaacatttgatccccaggaggtccggaaaatattcttcgggagttttcacaaggtgcacgtcgccgttggccgatccaaagtgagattatatgtcgattgccggaaggtggcagagagacctctgggcgaaatgggatcccccccagctgccggatttgtaacactaggccgtctggcgaaggcgagaggtccaaggtcctcatccgcggcatttcagttgcagatgctgcaaatcgtatgctccgatacatgggccgacgaagaccggtgttgcgagctcccagccagcagagatggtgaaacttgccctgcattcgtaagtgcctgctcctgttcttctgaaaccccaggcccacccggacctcaggggcctccgggactccccggaaggaacgggacacccggagaacagggttttccgggacccagaggggagccaggccctccaggtcagatgggaccagagggacctgggggacagcagggatcaccaggcacgcaggggagggcagtgcaggggcctgtgggaccaccaggagtgaaaggagaaaagggggatcatgggctgcctggactccagggccacccgggacaccagggtatcccgggaagggttggtctgcagggtccaaaaggcatgcgcggtttggaaggtactgctggcctaccaggcccacctggcccaaggggatttcagggtatggccggagcaagaggcacgagcggcgagcgcggacctcctggcacagtgggcccaacgggtctgcctggccctaaaggagagcgtggagagaagggggagccccagtcactggctacattgtaccagctcgtatcccaggcttctcacgttagtaagttcgactccttccacgagaataccagaccaccaatgcccattctcgagcagaaactcgaacccggaactgagccccttgggtctccgggtacaagatcaaaggccctggtacctggagagtggggacgaggtggaagacacctcgaggggagaggcgagcccggagctgtgggacaaatgggtagtcccggacagcagggcgcttctacacagggattgtgggagtag

SEQ ID NO: 4823 - DNA, 3855 bp, Artificial Sequence
  Description of Artificial Sequence: Synthetic coding sequence
atgtctagcggggaccccgctcatcttggcctgtgcctttggctgtggttgggcgcaacacttgggagggagcaggtccaagcttcgggcttacttcgcctggccgtgctgcctgaggatcggttgcagatgaaatggcgtgaatccgaggggagcggcctcggctacctcgtgcaggtgaagccaatggcaggcgatagcgaacaggaagtaatcttaaccaccaaaacccctaaggcaacagtcggcggactaagcccgagcaaaggttacacgctccaaatcttcgaattaactggatcgggtcggtttcttctggccagaagagaatttgttattgaagacctgaaatctagctccctggatcggtcctctcagcggccactgggatccggtgcccctgaacccacaccttctcacaccggttcacctgaccctgaacaagcatccgagccccaggttgctttcactccaagtcaagacccacgcacacccgcagggccacagttcagatgtcttcctcccgtacctgctgatatggtgtttctcgtggacgggagctggtcgatcggccacagccacttccagcaggtgaaagactttctcgccagcgttatcgccccattcgagataggcccagacaaggtccaggtgggcctgacacagtactccggcgatgcccagaccgagtgggaccttaattcactttctaccaaagagcaggtgcttgctgccgttcgtagactgaggtataagggcggtaatacattcaccggcctggctctcacacatgtattagggcaaaatctgcaacccgcagccggactgcggcctgaagcagctaaagttgtaattttggtgacagatggaaagagtcaagacgatgtgcacactgctgccagggtcctgaaagacttgggcgtgaatgtctttgccgtgggagtcaagaatgctgatgaggctgaattgagactcttggcaagccctcctagggatatcacggtccatagtgtccttgacttccttcaactaggcgctctggccggtcttctgagcaggcttatctgtcagagactccagggaggtagcccgaggcagggcccagcggctgcccctgcgctcgacaccctccctgcccctacgagcttggtcctcagccaggttacctcttcctcaatacgattgagctggactcctgctccacggcacccactcaaatatctgattgtgtggcgggcaagtagagggggaacgcctagggaggtggtagtagagggaccagcagcctctactgaactccacaacttggccagtcgtacagaatacctggtgtccgtgttcccaatctacgaaggcggtgttggcgagggtttaagaggcctggtcactaccgcaccactgccgccacctagagccctcaccctcgctgcggtgactcctcggactgttcacctaacgtggcaaccctctgcaggggcaacacattacctggtcagatgtagccccgctagccccaaaggagaggaggaggagcgggaggtgcaagttgggcgaccagaggtgctcctcgacggtctggagcccggaagagactacgaagtctccgtgcagtcgctgcgtggccctgaggggagtgaggcacggggtattagggcaaggactcctacattggctccgcctcggcacttggggtttagcgacgtctctcacgatgcggcacgggtgttttgggaaggagcaccgagacctgtgcgcttagtgcgggtcacctatgtgtcaagcgagggcggacactccgggcagacagaggcacctggcaacgccacttcagcaactttggggccactatcttctagtaccacttataccgttcgagtgacttgtctgtatcctgggggtggctccagcaccctgactggtcgggtgacaactaagaaagccccttcgccaagccagcttagtatgaccgagctccctggggacgctgttcagctggcttgggtcgccgcagcccctagtggtgtcctggtgtaccagatcacctggacgcccctcggtgaaggtaaggcgcacgagatctcagtgccaggcaatctaggtaccgccgtcctgcctggtctgggacggcatacagagtatgacgtcacaattctggcttactatagagatggtgctagatccgacccagtctcgttgaggtataccccctcaacggtctcccgttcacctccttcaaatttagcgctggctagcgaaactccggatagccttcaggtgtcctggacgcctcctctcggcagagtgttgcattattggttgacgtacgctcccgcatccgggctggggccagagaagagcgtgtccgtccctggggctagatcgcacgtaaccttaccagacttacaggctgctaccaagtacagggtgttagtgtccgccatctatgctgccggacgcagcgaagctgtatccgctaccgggcagactgcctgcccagctctcaggcccgatgggtccctccctggttttgacctgatggtggccttttctctggtcgaaaaggcttatgctagtatccggggagtggccatggagccctccgcctttggcggaaccccaaccttcacactcttcaaagatgcacaacttaccagaagagtgtctgacgtgtaccccgctcccttaccaccagaacatacgattgtgttcctggtccgactgcttcctgagaccccccgagaggctttcgcactgtggcagatgactgccgaggattttcagcccctacttggcgttctcttagacgcgggtaaaaaatctttgacctatttccaccgtgacccccgagcagctcttcaggaggccacttttgaccctcaggaagtgaggaaaatattcttcgggtcctttcacaaagtgcacgtggcagtcggacgcagcaaagttcgtttgtatgttgactgcaggaaagtggcagagcggcctctcggtgagatgggttccccccctgctgccggatttgtgactctaggcaggctcgccaaagcaagagggcctcgcagctcctcagccgcttttcaactgcagatgttgcagatcgtgtgtagtgacacctgggcagacgaggatcggtgctgcgaattgcctgcctctagagacggtgagacatgtcctgccttcgtttccgcctgctcctgcagcagcgaaaccccgggacctccaggccctcaggggccaccgggactccccggaagaaacggaacccctggcgagcaggggtttccaggccctaggggcccaccaggtgtgaaaggagaaaagggggatcacgggctgccaggactgcaaggccatcccggacaccaagggatcccagggagggtcggattacagggtcctaaggggatgcgcggactggaaggcaccgccggactgccagggcctccaggtcccaggggttttcagggtatggccggagctaggggcacttcaggggagaggggccctcctggaaccgtcggccctactggcctccctgggccaaagggagaacgtggggagaagggagaaccccagtccctggcaacattgtaccaacttgtgtcgcaggcatcccacgtttctaagtttgacagtttccatgaaaacaccagacccccaatgcccattttggaacagaagctcgaacctgggactgagcccttaggttcaccaggcactagaagcaaggcactggtccctggcgaatggggaagagggggtaggcatttagaaggtcggggagaacccggagctgtgggacaaatgggatctcctggccagcagggcgcaagtacccagggtctttgggagtag

SEQ ID NO: 4824 - DNA, 3894 bp, Artificial Sequence
  Description of Artificial Sequence: Synthetic coding sequence
atgtcctctggtgaccccgcacatctgggactgtgcctttggctgtggctcggagcaaccctcgggagggagcaggttcaggcctcagggctcctgaggctcgcggtattacctgaggatagactgcaaatgaagtggcgcgagtccgagggaagcggtctaggttacctcgtgcaggttaagcccatggcgggagactcagagcaggaagttatcctgaccaccaagactcccaaggccactgtggggggtctgtcgccgagcaagggctacactctgcagatttttgagctgactggctccggcaggtttctgctggcccgtcgtgaattcgtgattgaggaccttaaatcctcctccctggacagaagttctcagcgtccactgggaagcggcgctcccgagcccactccatcccacacaggctctcccgaccccgagcaggcgagcgagccacaggtcgcctttacaccatcacaagatccaaggactccagggggatctgaatggagggaaacaggcccacaatttcgctgtcttcctcctgtgcccgctgacatggtgttcttggttgacggttcttggtccatcggacactcccacttccaacaagtcaaggatttcctggcgagtgtaattgccccattcgaaattggccctgataaagtccaggtgggtttgactcagtacagcggcgacgctcagaccgaatgggatctgaattccctctccaccaaggagcaggtcctcgccgctgtcaggaggctgagatacaaagggggtaatactttcacaggactggctctgactcatgtcctcggacagaacttacagcctgccgcagggctgcgcccagaagccgctaaggtggtcattcttgtgacagacgggaagtctcaagacgatgtacataccgccgcaagggtcctgaaagatctcggagtgaatgtgttcgctgtgggagtgaaaaatgcggacgaggcagagcttagacttctggccagtcctcctagagatatcaccgttcattctgttctggattttcttcagctgggcgctttagcaggactgctttcaagactcatctgccagcgtttacagggtggcagccctagacaagggccagccgctgccccagcattagacacactgccagcacctaccagcctcgtgctctctcaagttacatcctcttcaatcagattgtcgtggacacccgctccgaggcaccccctaaaatacttgattgtgtggcgagcctcccgtggaggaacccccagagaggtggtggtcgaaggtcccgcagcttccactgaattacacaatctggccagtcgtaccgagtacttagtatctgtattccctatctacgaaggcggagttggtgagggcctcagagggctcgtgacaacagcgcctttgcccccaccacgcgcattgactctggccgctgtgacacctcgcactgtgcacctgacttggcagccctcggccggagccacacattatctggtccggtgctcccccgcttctcccaagggggaggaggaggagagagaagtgcaagttggcagaccagaagttctgctggatggcttggagcccggaagagattatgaggtgtcggtccagtctctgcgaggtcccgagggatccgaagctcggggtataagagcaagaacccctacactcgccccacccaggcaccttggcttctcagacgtcagtcatgatgcggctagggtcttctgggaaggagcaccaaggccagtgcgactcgttcgggtcacatacgtttcctcagaaggagggcatagtgggcagactgaagctccaggaaacgccacatccgcgaccctcggtccactctctagttcaaccacgtacacagtccgtgtcacgtgcctgtatccaggagggggatcttctacactgactggtcgcgtaacaacaaagaaggcacccagtcccagtcagctgagcatgacagagctccctggcgacgccgtacagctcgcctgggtcgccgcagcgccttctggtgtgttggtctaccagatcacatggaccccactgggggaggggaaagcacatgagatcagtgtgccgggtaacttgggcaccgccgtgttgcccggactcggccgtcataccgagtatgacgtaaccatactggcctactaccgagacggagcacggagcgatcccgtgagcctgcgatacacaccgtcaacagtgtccaggtctcccccaagcaacttggcccttgccagtgagacccccgattccttgcaggtgagttggacaccgccactaggacgggtcctccactattggttgacctatgcccctgcctctggactgggaccagagaaaagcgtctcagtacccggagctcgcagtcatgtgacactgcctgatttgcaggctgccaccaagtaccgcgtcctcgtgtccgccatctatgctgcagggcgatcagaggccgtatccgcaactggtcagaccgcctgccccgctctcagaccggacgggagtcttcccggattcgatctcatggttgccttcagcttggttgagaaagcctatgcctcgattagaggagtggctatggaacccagtgctttcggaggaacccctactttcaccttgttcaaggatgctcagcttacgcgaagagtttctgacgtgtacccagcgccattgcccccagaacataccatcgtctttctcgttagactgttgcccgagactccacgagaggccttcgcactgtggcaaatgaccgccgaggacttccagcctttgctgggcgtcctgctagatgccggtaaaaagagtctgacttatttccatcgagaccccagagcagccttgcaagaagcaactttcgacccacaggaggtgagaaaaatatttttcgggtctttccataaggtccacgtggctgttgggaggtccaaggttagactgtatgtggattgtagaaaagtagcggagagaccgctcggggaaatgggttctcccccagcagccggttttgtgacgctgggcaggctggctaaggcacggggacccaggtcaagtagcgccgcattccaactccagatgcttcaaatcgtctgcagcgacacatgggctgatgaagatcggtgttgtgagctgccagcaagccgagacggggaaacctgcccagccttcgtgagcgcatgcagctgttccagcgaaacacccggaccaccaggaccacaaggtccaccaggcctgccaggcagaaacgggacccctggcgagcaggggttcccaggaccaagggggcctcctggagtgaaaggcgagaaaggcgatcacgggctccctggcctgcaggggcaccccggacatcaggggatacctggtagggtggggttgcaaggccctaaagggatgcgagggctggagggaacagcaggactgccgggacctccaggaccgagggggttccagggaatggccggagcgaggggcacatctggagagaggggtccacctgggacggtcggaccaaccggcttacctgggccaaagggagaaaggggggaaaagggcgagccccaaagtctggccactttataccagttggtctcacaagcctgcgaatccgcaatccagacccatgtatctaagttcgactcctttcatgaaaacacacggccaccaatgccaatcctggaacagaaactggaacctggtacggagccattgggaagcccaggaacgcggtctaaggcactggtcccaggcgagtggggaaggggtggcaggcacctagagggcagaggcgagccaggcgctgtcggtcagatggggagcccaggacagcaaggcgcaagtacccagggcctttgggaatag

SEQ ID NO: 4825 - DNA, 3894 bp, Artificial Sequence
  Description of Artificial Sequence: Synthetic coding sequence
atgtccagtggtgatcctgctcacctgggattatgcttgtggctttggctaggcgcaactctcggaagagagcaggtgcaggcatctgggctccttcgtctggcagttctgccagaggacaggcttcagatgaagtggagggaatccgagggctcgggactgggttacctggttcaggtcaaacctatggcaggggatagcgaacaggaagtgattctaacaaccaagacacctaaagcaaccgtgggaggtctcagcccatctaaggggtacaccctgcaaatctttgagttaaccgggtccgggcgtttcctactggctcgacgcgaattcgtgattgaagatttgaagtcatcctccttggaccgctcaagtcaacggcctctcggatctggggcacctgagccaaccccgagccatacgggctcccctgatcctgaacaggccagtgagccccaggtggcttttaccccatcacaggatccacgcacccccggagggagtgagtggcgcgagaccgggccacagtttcgctgcctgccgcctgtgccagctgacatggtattcctggtggatgggtcatggagcattgggcattcacattttcagcaggttaaagattttctcgccagcgtgattgcaccttttgagattggcccagataaggttcaggttggactgactcaatatagcggcgacgcccaaactgaatgggacctgaacagcttgtccacaaaggaacaggttctcgctgcggtgagaaggctccgatataaaggaggaaacaccttcaccggactggccctaactcacgtgctgggccagaacctgcaaccagccgcaggcctccggcctgaagctgccaaggtggtgattttggttactgacggaaagagccaagatgatgtgcatactgcagctcgagtgctgaaagacttaggggtgaacgtgtttgcagttggcgttaagaatgccgacgaagccgaattacgactgctggcatccccccctcgggacattactgttcattccgtgctggatttcctccagctcggcgctctagcaggacttctctcaagattgatctgccagcgtttgcaagggggatctccccgacagggccctgccgctgcacccgcattggacaccttgcctgcacccactagcctcgttctgagccaggtgacatctagctctattaggctgtcatggacgcctgcccctcggcatccactgaaatacctcatcgtgtggagagcttcgcggggagggacgccaagggaagtggtagtggagggacctgccgctagcaccgagctgcacaacctcgctagtcgcacagaatatctggtgagcgtgttccctatctacgaaggaggagtgggggaaggcctacgtggcctagtcacgaccgcccctctgccacccccaagagccctgaccttggctgctgttacccccaggaccgtccacctgacatggcagccatctgcgggtgcaacccattacctggtgagatgctctcctgcatctcccaaaggggaagaagaggagagggaggtacaggtcgggagaccagaggtccttctcgacggattagagccaggtcgggattacgaggtctctgtgcagtctctcagaggtcctgagggatccgaggcgagaggaatccgagcacgaacccctacccttgctcctccaaggcacctggggtttagtgatgtctcccatgacgctgccagagtgttctgggagggtgctcctaggcccgtaaggctggtcagagtgacgtatgtatcctcagaaggcggacattcgggccagactgaggctccaggtaatgcaacatccgccactttgggccctctgtcatctagcaccacttacaccgtgcgagtgacatgcctctatcctggaggtggcagttctactctgactggaagggttactactaagaaggctccctccccatcccaactgagcatgacagagttaccaggtgacgcggttcagctggcctgggtcgctgcggctccctctggtgtgttggtatatcagattacatggacacctctcggcgagggcaaggctcacgagatctctgtcccagggaacctgggaaccgccgtgctgcctggactgggcagacatacagagtatgatgtcacaatcttagcttattatagggatggagcccgttcagatcctgtgtcactgcggtacactccgtcaactgtttcacgctcaccgcctagtaatctggctctggccagcgagacgcccgacagcctccaagtgagctggacacctccgttaggacgggtgttacactattggctgacctatgctccagccagtggactgggacccgagaagagtgtttcagtgcccggagcacgctcccacgtgacgctaccagatctgcaggctgccacaaaatatagagtattggtttcagccatatacgcagcaggccgatccgaggcagtgagtgccaccggtcagactgcttgtcctgccctccgaccagacggcagcctccccggttttgatctcatggtggcattcagtctggtagaaaaagcctatgcgtctatacggggagtggccatggaaccttctgcattcggcggtacccctacgttcactctgttcaaggatgcgcagctaacgcgcagggtcagcgacgtataccccgcacccctgccacctgagcacactatcgtgttcctcgtgaggctgctgcccgaaactcccagagaggcctttgccttgtggcagatgactgcagaggactttcagcctctgttaggtgttcttcttgatgctgggaaaaagagtttaacatactttcatcgggacccaagggctgctctccaggaggccaccttcgatccacaagaggtgcgcaagatcttcttcgggagttttcataaggtgcatgtggccgttggccgatcaaaggttcgcttatatgtggactgccggaaagttgctgaacgcccactcggagaaatgggatcccctccagcagccggattcgtgacactgggcagattagccaaagccaggggaccccgttcgagtagcgccgctttccagctccagatgctgcaaatcgtctgctctgatacatgggccgacgaagaccgctgctgtgaactccccgctagccgtgacggcgagacatgcccggcatttgtgtcagcttgttcttgtagctctgaaacaccagggccacctgggcctcaggggcctcccggactgcctggtcgcaatggcacacctggtgaacagggatttccaggcccacggggacctcccggagtcaagggcgaaaaaggagatcatggacttccaggtctgcagggccacccaggacaccagggaatcccagggcgtgtgggactgcagggcccaaagggtatgcgaggattggaggggaccgctgggttgcctggcccaccaggaccccgaggctttcagggcatggcgggtgcaagagggacctcaggagagagagggccacccggaacggtcggacccactgggctcccaggacctaagggcgaacggggagaaaagggagagccccagtctctggccactttgtaccaactggtgtctcaggcctgtgagagcgccattcagacgcatgtctcaaagtttgactccttccatgaaaacactcggccacctatgcctattcttgagcagaaactggaacccggaaccgaacccctggggtctccaggtactcgctccaaggccctcgtgcccggagaatggggacggggaggcagacatctggagggaagaggggaacctggagctgttggccaaatgggatcccctggacaacaaggtgctagtacacagggtctctgggagtag

SEQ ID NO: 4826 - DNA, 2874 bp, Artificial Sequence
  Description of Artificial Sequence: Synthetic coding sequence
atggcacattacataactttcctttgtatggtcctggtgttactgctgcaaaattctgtactcgctgaagatggcgaagtccgctcgtcctgcagaaccgcgcctacagatctcgtctttattctggacgggtcttactctgtgggccctgaaaatttcgagattgtgaagaagtggctagtcaacatcactaaaaacttcgacattggtcctaagttcatccaggtgggcgtggtgcaatattctgactaccctgtgctggaaataccccttgggagttatgattccggggagcatctcactgctgccgtggaaagcattctgtacctcggtggtaacacaaagaccggcaaggccatccagttcgccctcgactatctgttcgcaaaaagttcaagatttctcacaaagatagcagtagtcctgacggacgggaagagccaggatgacgttaaggatgctgcccaggccgctagagacagcaaaatcactctgttcgcaataggagtgggaagcgaaaccgaagacgcagaattacgggcaatagccaataaacccagttctacctacgtgttctacgttgaggattacattgccatcagtaagattcgcgaggtgatgaaacagaaactttgcgaagaatccgtgtgcccaacaagaatccctgttgcggctcgtgacgagcgcggttttgatatcctgctaggccttgatgttaataaaaaggtcaagaaaagaatacagttgtcacccaagaagattaaagggtacgaggtgacctcaaaggttgatctcagtgaattgacgagcaacgtgttccccgaaggactaccaccctcgtacgtctttgtcagtacccaaagattcaaagttaaaaagatttgggacctgtggagaatacttaccatcgacgggcgtccgcaaatcgctgttacacttaatggtgtggataagatcttactcttcacgactacctctgtgataaacgggtctcaagtggtgacctttgccaacccgcaagtgaagactctgttcgatgagggctggcaccagatccgcctcctcgtgaccgaacaggatgtcacactatacattgatgaccagcagatcgagaataaaccactacaccctgtgctagggatcctgattaacggtcagacccagataggtaaatattctggcaaggaggagacggtgcagttcgatgttcagaagctcaggatatattgcgatccagagcagaataaccgtgaaaccgcatgtgagataccgggtttcaatggagaatgtttgaatggcccatcagacgtgggctctacacccgcaccttgcatttgccctcccggtaagcccggtcttcagggcccaaagggggaccccggacttccaggcaatccaggctacccaggacagcctggccaagacgggaagccaggataccaggggattgctggaacaccaggagttccgggaagcccaggtatacagggtgccaggggactcccaggatataaaggggaacctggaagagatggggacaagggtgacaggggactgcctggcttccccggactgcatggtatgccgggaagcaaaggtgagatgggagccaagggtgacaaaggtagcccaggattctacggcaaaaaaggagccaagggcgaaaagggaaacgccggatttccaggcctcccaggacctgccggagagccaggcagacacgggaaagacggactgatgggcagccccggattcaaaggggaggctggaagcccaggagcacctggacaggacggtacaaggggagaacctggcattccagggttccccggaaatagggggcttatgggacagaaaggagagattggtccacctggccagcaaggaaagaagggcgctcctggcatgcctggacttatgggcagcaacggcagccccggacaacccggaaccccgggatcaaagggttccaagggggagcccggaatccagggcatgccaggagccagtgggctcaagggtgaacctggcgcaactggctctcccggtgaacccggttacatgggtctcccagggatacaaggcaagaaaggcgataagggaaaccaaggtgagaaggggatccagggtcagaagggcgagaacggcagacagggaattccagggcagcaggggatccaaggacaccacggggcaaaaggcgaacggggagagaaaggtgagccaggggtcagaggcgcaatcggttccaaaggcgaaagtggggttgatgggctaatggggcctgccggtcctaaaggccaacctggcgatccaggacctcagggaccacccggactcgatggcaaacctgggagagaattctccgagcagtttattaggcaggtctgcacagatgtgatccgggcacaacttccagtattgctacagtcaggacgaattaggaattgcgatcattgcctgagccaacacggctcccccggtatccccggtccgccaggcccaattggcccagagggtcctcgcggactgcctggcctgcccggaagggacggagtgcccggactggtgggcgtgccaggacggccaggcgttagggggctcaaaggcctgcccggtaggaacggcgagaagggctcccagggatttggctatccaggcgaacaaggcccaccaggacctcccggaccggagggcccacccggtatctccaaagaaggtcctcccggtgaccctggtctgccaggcaaggacggagatcatggaaagccgggtatccaggggcagcctggaccccctggcatttgtgatccttcactttgtttctcagtcattgcgcgacgcgaccccttcagaaagggacccaattattag

SEQ ID NO: 4827 - DNA, 972 bp, Artificial Sequence
  Description of Artificial Sequence: Synthetic coding sequence
atgattgcctcgggtatccccggtttccctggaaaccgaggtctgatggggcaaaagggagagattggtccccctggccaacagggaaaaaaaggggctcctggcatgccaggactgatggggagcaacgggagcccaggacagcctggcacaccaggctctaaggggagcaagggggagccagggatacagggcatgcccggagcatcaggacttaagggggagcccggagccaccggcagccccggtgaacctggatatatgggtctgccaggtatccagggcaagaagggcgataaaggcaaccagggggaaaagggaatccagggacagaagggggagaacggcaggcaaggcataccaggacagcagggaatccagggtcatcacggagctaagggcgagcggggtgaaaaaggcgagcctggtgtccgtggcgcaatcggctctaagggcgaaagcggcgtggacggactgatgggccctgcaggaccgaagggacagccaggtgaccccggtccacagggtcctcctgggttagacggcaagcccggacgtgagtttagtgagcaattcatccgccaggtttgcacagacgtgatcagaggcccagagggcccaaggggcttacctggcctgcctggaagagatggggtgccgggattggtgggagttccagggaggcccggtgtgagaggtctgaaggggctcccaggtaggaatggcgagaagggatctcaagggttcggctaccccggtgagcaaggtcccccagggcctccagggccagaaggtccacccggaatctccaaagaagggcctccaggtgacccaggcctgccaggcaaggacggggaccacggaaaacccggaatacagggacagccaggtcctcccggaatatgtgacccatccttgtgtttctctgtcatcgcaaggcgtgatccctttcgaaaaggtccaaattactag

SEQ ID NO: 4828 - DNA, 2865 bp, Artificial Sequence
  Description of Artificial Sequence: Synthetic coding sequence
atggcccattatattacatttttatgtatggtgctggtccttctgttacaaaacagcgtgttagccgaggacggcgaggtccgctcttcctgtcggacagcccctaccgatctggtgtttattctcgacggctcatactccgtcggaccagaaaacttcgaaatcgttaaaaaatggttagtgaacatcacgaaaaattttgatatcggtcccaaatttatacaggttggggtcgttcagtattccgattatcccgttcttgagattccgttagggtcatacgacagcggtgagcacctaaccgccgctgtagaaagcatcctgtacctcggtggcaacacgaagacggggaaagccatacagttcgccctggactacctttttgctaagtccagcaggttccttaccaagatcgctgttgtgctgactgatggaaaaagccaggacgacgtcaaagacgcggctcaggcggcaagagacagtaagattacccttttcgcaatcggggtgggaagcgaaaccgaggacgccgagctccgcgctatcgccaacaagccctcatcaacatacgtgttttatgtcgaggactacattgccataagcaaaatcagggaggttatgaaacagaagttgtgtgaagagtcagtgtgtccaactcgaatcccggtggccgctagagacgagcggggatttgatattctgttagggctggacgtgaataagaaggtaaagaagagaattcagctgagcccaaagaaaatcaaaggctacgaggtcacatcaaaggtcgacctctccgaattgacatccaacgtgttccctgaaggccttcctccgtcatatgtgttcgtgagcacccagaggttcaaggtgaaaaaaatttgggacctgtggcgcatactcacaatagacgggcgtccacaaattgcagttactttgaatggagttgacaagattttgctgttcaccaccacctctgtcattaatggatcccaagtcgtcacatttgcgaaccctcaagttaagacattgtttgatgaggggtggcatcagatcagactcctcgttacagagcaggatgtcacgctctacatcgatgatcagcaaattgagaataagccgctacatccagtgctgggaattctcatcaacggacagacccagatcggcaaatacagcggcaaggaagaaacagtacaattcgacgtgcaaaagcttaggatttattgcgatccagaacagaataacagggagaccgcatgtgagattcccggattttgtctgaacgggccttctgatgtggggtccactcctgcaccttgtatttgtcccccaggcaagcccggtctccagggcccaaagggcgatcccggtttacccggaaatcccggataccctggacagcccggtcaggatggaaagcctggctaccaaggaatcgctggaacgcccggagtgccaggctccccgggtattcaaggtgctaggggtctccccggatataagggcgaacccggaagagatggagataaaggagatagaggcctccctggttttccagggctccacggcatgcctggctccaagggagagatgggggctaaaggtgacaaaggttctccagggttttatgggaagaaaggcgcaaagggtgaaaaagggaacgcgggttttcctggactcccgggaccagcaggcgagcccggacggcacggaaaggacgggttgatgggctcccctgggtttaaaggggaagccggttcaccaggtgcccctgggcaggacggtaccagaggcgaaccaggaataccaggatttcctggcaataggggactgatgggacagaagggggaaattgggcctccaggccaacagggaaaaaagggagcacctggcatgcccggtcttatggggtcgaacgggagcccaggtcagccagggactcccggatccaagggctcaaagggcgagcccggtattcagggaatgccaggagcctccggattaaaaggagagcccggagctacaggatcaccgggagagcctgggtacatgggcctgccaggcattcaaggcaagaagggcgataagggcaatcagggcgaaaagggcatccaggggcaaaaaggggaaaacgggcgtcaaggcattcctggacagcagggcattcagggccaccacggggcaaaaggggagcgtggcgagaagggagagccaggagtaagaggagctatcggctccaagggcgaatcaggcgtagatggcctcatggggcctgccggacctaagggacagcccggtgaccctggaccgcagggacctccaggcttggacgggaaacctgggagagagttctctgaacaatttattcgccaggtttgcactgacgttattcgtgcacagctacctgtgctgctgcaatccggcaggatcaggaattgtgaccactgtttatcacaacatggttctcctggcattccaggtcccccaggccctattggacctgaagggcctagaggcctcccaggacttcctggtagagatggggtccccggacttgtgggtgtgcccggtcgaccaggcgtcagaggtctgaaaggcttgcccggacggaatggggagaagggatctcaagggtttggctatcctggtgagcaagggccaccaggcccaccgggacctgagggccctcccggtatttccaaagaaggaccgccaggcgacccaggccttccaggaaaggacggagaccacgggaaaccgggaatccaaggccagcccggtcctcctgggatctgcgacccttcattatgtttcagtgtgattgcccgtagggacccatttcgaaagggccctaactattag

SEQ ID NO: 4829 - DNA, 411 bp, Artificial Sequence
  Description of Artificial Sequence: Synthetic coding sequence
atggcccattatataactttcctctgcatggttctggtgctgttgctgcagaatagtgtcttagccgaggatggagaagtgaggagcagctgtcgcactgctcctacagatcttgtgtttatacttgacggttcttacagtgttggacctgagaacttcgaaattgtgaagaaatggctggttaatatcaccaagaatttcgatatcgggcctaaattcatccaggtgggcgtagttcagtactccgactaccccgttcttgaaatccctctcgggagctatgattcgggagagcacctgacagcagctgtagagtctatcctgtatctcggcggaaacaccaagacagggaaggcaatacagtttgccctggattacctctttgcgaagagcagtaggttcttgacgtag

SEQ ID NO: 4830 - DNA, 2865 bp, Artificial Sequence
  Description of Artificial Sequence: Synthetic coding sequence
atggctcactatatcacctttttatgtatggtgctagtgttgctcctgcagaatagcgttcttgccgaggatggtgaagtccggtcctcctgcaggactgctcctacagatttggtgttcattctcgacggctcttattctgtggggcctgagaattttgagatcgtaaagaagtggctggttaacatcactaagaactttgacatcggtccaaagtttatccaggtgggagttgtgcagtatagcgattaccctgttctggagatcccactaggaagctatgattcaggagaacacctgacggctgctgtggagtcaattttgtacctagggggaaatacaaagacaggtaaggcaatccagtttgccctggattatctgtttgctaaatcgtctcgattccttactaagattgccgtcgttttaactgacggtaagtctcaagatgacgtgaaagacgcagctcaagccgctagggactccaagattacacttttcgccatcggcgtgggatcggagacagaagatgcagagctgcgagcaatcgcgaacaagccatcctccacatacgttttctacgtcgaagactacatcgccatttctaaaattagggaagtcatgaagcaaaagctatgcgaagagtctgtttgccccacacggatcccagtggcagcgagagatgaacgcggattcgatatcctgctggggctggatgttaacaagaaggtgaaaaagcgcattcagctttcaccaaaaaaaatcaaaggatatgaggtaacctccaaggtcgatctgagcgaattaactagcaacgtgttccctgaaggtctacctccaagctatgtgtttgtgtcaacgcaacgttttaaagtgaagaagatctgggatctctggaggattctaacaattgatgggcgacctcagattgctgtgacactgaatggggtggacaagatcctcctctttaccactacatccgtgatcaacgggtctcaagtggtcacattcgccaatcctcaggttaaaacgctcttcgatgagggatggcaccagatccgtctgttggtcacagagcaggatgttaccttatacatagatgatcaacaaatcgaaaacaaaccgttacatcctgtgttagggattctgatcaacggacagacacagataggaaaatactctgggaaagaggaaacagtgcagttcgacgttcagaagctgagaatttattgcgatccagagcagaacaatagggagacagcttgtgagatcccgggattttgcctcaacggcccttccgacgtgggaagcacacccgcaccttgcatctgtcccccaggtaagcccggacttcagggtcctaaaggggacccaggtctgccaggaaacccaggttaccctggtcagcctggtcaggacggtaagcccggttaccagggcatagccggaacccctggcgtgccaggatctccaggtattcagggtgccagggggttaccaggctataagggtgaacctggaagggacggagacaaaggcgacagggggcttcctggcttccccggactccacggaatgcctggatctaaaggcgagatgggagcaaaaggtgacaaagggtcaccaggtttttacggcaagaaaggcgctaagggagaaaagggcaatgccggatttccaggactacctggcccagctggcgagcccggtcgtcacggaaaggatggattgatgggatctccaggttttaaaggcgaggccggatcgccaggtgcccctgggcaggacggaacaaggggcgaacccggaattcctggatttcctggaaatcgcggactcatgggtcagaaaggggagattggcccacccggacaacagggcaagaagggggcaccgggaatgcctggcctgatggggagtaacggatccccaggccagcccggaactcctggttccaaggggtcaaaaggtgagcctgggatccaggggatgccgggagcctccggattaaaaggagaacccggtgccacaggctctccaggagagcctgggtatatggggctgcccggtatccaaggcaaaaaaggggacaagggcaaccagggcgagaaaggtatccaaggccagaagggggaaaacggcaggcaggggattccgggacagcaggggatccaggggcatcacggagccaagggcgaaagaggagaaaagggtgaaccgggtgtgagaggggctataggcagtaaaggtgaatctggtgtggatggccttatggggcctgcaggcccaaagggtcagcccggagatcccggtcctcagggacccccagggcttgacggtaaacccggaagagaattcagcgaacagttcatcaggcaggtgtgcaccgatgtaatacgggctcagctaccagttctgctgcagagcggcaggataagaaactgcgatcactgcctaagtcagcacggctctccaggaatccctggacctccaggacccattggaccagaaggtccacgagggctgcctggtctgcccggacgtgatggggtgcccggactagtcggtgtacccggaaggcccggtgtcagaggcctaaaggggctcccagggagaaatggcgaaaaaggctcacagggcttcggatacccgggtgaacagggcccacccggacctccaggccctgaaggccctccaggcataagcaaagaaggacccccaggggatccaggtttgcccggaaaggatggggaccacgggaaaccaggaatccagggtcagcccggtcccccaggaatctgtgaccctagcttgtgcttttcagtcatcgctcgaagggacccctttcgtaagggccctaactactag

SEQ ID NO: 4831 - DNA, 2874 bp, Artificial Sequence
  Description of Artificial Sequence: Synthetic coding sequence
atggctcactatattaccttcctatgcatggtgctcgtactgctgctgcaaaactcagtgcttgccgaggatggggaggtccgttcatcatgccggactgcacccactgatctggtgtttattttggatggaagctattcagttggcccagaaaacttcgagattgtaaagaagtggctggtcaatatcacgaaaaattttgacattggtccaaaatttattcaggtaggagtcgttcaatacagtgattaccctgtgctagagatccccctggggtcgtacgatagcggcgagcatctgaccgcagctgttgaatcgatcctctacctggggggaaataccaaaacaggcaaagctattcagtttgccctagattacctcttcgctaaatcatccagattcctgactaagatcgctgtggttttaacagacggaaaaagccaggatgatgtcaaagacgctgcacaggccgctcgagattcaaagataaccctgttcgccattggagttggctctgaaaccgaggacgctgagctgagagcaattgccaataagccttcatcaacctatgtgttttacgttgaagattatatcgctatttccaagattcgagaggtaatgaaacaaaagttgtgcgaagagagtgtctgtccgaccaggatccccgtggccgcaagggacgaacggggtttcgacatccttcttggccttgacgtgaataagaaagtcaagaagagaatccagcttagcccaaaaaagatcaagggctacgaggtgacttctaaggtcgatctgtctgaattgacttccaacgtatttcccgagggcttgccaccatcgtacgtgttcgtttctactcagaggtttaaagtgaagaagatctgggatctgtggcggattctgaccatagatggcagaccacagatagccgtgaccctgaacggggtcgataagattctcctgttcacaaccaccagcgtgattaacggaagtcaggtggtaacgttcgcaaaccctcaggtaaagaccctctttgacgaaggttggcaccagatcagattgctagttaccgagcaggatgtgacgctctacattgacgatcagcagatagaaaacaaacctttgcatccagtgttgggcatcctgataaatggacagacacagatcggtaagtacagtgggaaagaagaaacagtgcaattcgatgtccagaagctgaggatatattgtgaccccgagcagaacaaccgggaaactgcatgcgaaattcccggttttgttatggagtgcctgaacggcccttccgacgtcggtagtactccagccccatgtatctgccccccagggaagccaggactgcagggccctaaaggtgaccccggactgcctggtaatcctggatatccgggtcaacccggacaggacggcaaaccaggctaccagggcatcgcaggaacgcccggtgtgccagggtcccccggaattcagggtgcacgagggctacccggatacaagggggaacccggaagggatggagataaaggggaccgcggtctgcccggattcccaggcctgcacggcatgccaggttcaaagggggagatgggagctaagggggataaaggctcccctggtttctacgggaaaaagggagccaagggggaaaagggcaacgcaggtttccctggcctacccggacccgcaggcgagcccggacgtcacgggaaggatggcctgatggggtcccccggatttaaaggcgaggctggaagcccaggcgctcccggacaggatggaacccggggtgaacccggaatcccagggtttcccggaaaccggggattgatggggcagaagggggaaattggccctcccggacagcagggaaaaaaaggggctccaggcatgcccggtctgatgggatcgaacggtagccctggccagccaggcacccccggatctaagggttccaagggcgagccaggcatccagggaatgcctggggcttctggcctgaagggagaacctggcgcaacgggctcacccggagaacctgggtatatgggtctcccaggtatccaaggaaagaaaggcgacaagggaaaccaaggagagaaaggcatccaaggccagaagggggaaaacggccgacaaggcatccccggacagcaggggattcagggccaccacggcgctaaaggcgagcgcggagaaaaaggagagcccggagtgagaggggctatcggttctaaaggggagagcggagtagatggactgatgggtcctgcgggacctaaggggcagcctggcgacccaggcccacaaggacctcccggactggatggcaagccagggagggagttttccgagcagttcattagacaggtgtgtactgatgtgataagagctcagcttccagtgcttttgcagtccggacggattcgcaactgcgaccactgcctgtcgcagcacgggtcacccggtatccctggacctcccggaccaataggaccagaaggtcccagaggactccccggtttgcccggacgagatggagtccccggactggtaggcgtgcctggacgcccaggcgtacgcggtctgaagggtttacctggaaggaacggcgagaagggatctcagggattcgggtaccccggagagcagggcccacctggtccccctggtcctgagggccctcccggaataagcaaagaggggccacctggggaccccggactgcccggtaaagacggagaccacgggaagccagggatccagggtcagcccggaccccctggcatttgcgatccctccctctgtttttctgtgatagctcgtcgtgatcctttcaggaaaggacctaattactag

SEQ ID NO: 4832 - DNA, 4881 bp, Artificial Sequence
  Description of Artificial Sequence: Synthetic coding sequence
atggccggactcagaggcaatgccgttgcaggcttactgtggatgctcttattgtggtccggcggaggaggttgccaggctcaaagggcgggatgcaagtcagtgcattatgaccttgtgttcctgttggacacatcttccagcgttggaaaagaagattttgagaaagtgcggcagtgggtggcaaacttggtggacacattcgaggtcggtcctgatagaacccgagtgggagttgtcagatactctgaccggcctaccaccgcattcgaacttggactgttcggatcacaggaggaagtgaaagctgccgcacggagactggcttaccacggcggtaacaccaatactggggacgcactacgctatattaccgctagaagtttctcaccccacgccggtggccgtcctcgggatagggcatataagcaggtcgctattttgctgaccgacggccgaagccaggaccttgtcttggacgccgctgctgcagcccaccgggcaggtatcaggattttcgccgtgggtgtgggagaagccctcaaggaagaattggaggaaatcgcctcagaaccaaagagcgctcatgtctttcacgtttcagatttcaacgcaatagataagattcggggaaagttacgcaggcggttgtgcgaaaacgtgctttgtcctagtgttcgggtggagggcgaccggtttaaacacacaaatggcggaacaaaggagatcacagggttcgacctgatggacctattctcagtcaaagaaatcctggggaagagggaaaacggcgcacagtcgagctacgtgcggatgggatccttcccagtggtccagtccactgaagacgtcttcccccagggattacccgatgaatatgcatttgtaaccactttcaggtttagaaagacctctcgaaaagaggactggtatatctggcaggttatcgatcagtattcgatcccgcaggtgtctatccgtttagacggagaaaacaaggccgtcgaatataatgcagttggtgccatgaaggatgctgtaagggttgtgtttagagggagtagagtgaatgatctcttcgatcgcgattggcataaaatggcacttagcattcaggcccagaacgtgtcattacatattgactgcgctctggtacagactctgccgatagaagaaagagagaatatagacatacagggtaagacagtaattggaaaacgcttgtacgactccgtgcccatagattttgatctgcagaggatcgtcatttactgcgactccaggcacgccgaattggaaacatgttgcgatatccccagtggtccatgccaggtgaccgtggtcacagagccccctcctcccccaccaccacagcgacctcctacccctggctctgaacagataggcttcctgaaaacgatcaattgtagttgtcccgcaggtgagaagggcgagatgggcgtggccggaccgatggggctacctggccctaagggcgacattggcgcaattggccctgtgggagctcctggtccgaagggggaaaaaggagacgtggggattggcccttttggccagggagagaaaggagagaagggctctttgggcctgcctggccctccaggacgcgatggctctaaaggtatgcgcggagagcccggagaacttggagagcctgggctcccgggagaagtcggaatgcgcggacctcagggccctcctggtttgcctggccctcccggacgggtcggtgcacctggcctccaaggagagagaggagaaaaaggcactagaggagagaaaggcgagaggggactggacggctttcctggcaaaccaggggacacaggccagcagggacgacctggaccttcaggcgtggccggaccacagggagagaagggcgacgtaggaccagcgggtccgccaggagtaccagggtccgtggtgcagcaggaaggcctaaaaggcgagcaaggggcaccaggacctcggggtcatcagggtgctcctggtccccctggggcacggggacccataggtccggagggtagggatggtccccctggcctccagggactccgagggaagaagggggacatgggtcctccagggatccctggtttacttggactgcagggaccccctggccctcctggggtaccaggtccgccagggcctggaggaagtcctggacttcccggtgaaattggttttcccggtaaacctggcccacccggaccaaccggaccccctgggaaggatggtcctaacggcccacccggaccacccggaaccaaaggggaaccaggagagcgtggagaggatgggctgcctgggaagcccggactgcggggtgaaatcggcgaacaaggcctggccggacgaccaggagaaaagggcgaggctggcctgccaggagcccctgggttccctggggtacgaggtgaaaaaggggaccagggtgagaagggagaactgggcctcccgggactcaaaggcgaccggggagaaaaaggcgaggcagggccagcgggtccccctggcctgcctggcacaaccagcctgttcacaccccaccctcggatgcctggcgaacagggtcctaagggagaaaagggggaccctggtctgccgggtgaaccgggacttcaaggtcgacctggagaactcggccctcaggggccaactggtccgccaggggcaaaggggcaggagggcgctcacggagcaccgggagctgccggtaatcctggggctccagggcatgtaggcgcacctggaccctcaggcccaccagggagtgtcggggctcccggattacgaggcacaccaggtaaagacggggaacggggagaaaaaggagcagcgggagaggagggcagcccaggcccagtgggtccgagaggggaccccggtgcaccaggccttccaggaccccctggcaaaggaaaagacggtgaaccaggattaagaggctcacctggacttcccggacccctggggactaaagccgcttgtggcaaggttcggggatccgagaactgcgccttggggggacagtgcgtcaagggcgaccgtggcgcacccggaattccgggttctccagggagcagaggagacccaggcataggcgtggcaggacctcccggaccatcaggaccccctggagacaaaggctcccccggatccagaggcctgccaggctttccaggacctcaaggacctgctggaagggatggcgctcctggtaacccaggagagcgcggacccccagggaagcctgggctatccagcttactgtcccccggtgacataaatctcttggccaaagatgtctgcaacgattgccctccaggccctcctggattgccaggcctgcctggcttcaaaggggacaagggagtgccagggaaaccgggaagggagggaaccgagggaaagaagggcgaggctggtcctcccggactacctggaccacccggtatcgccggaccccagggctctcagggagaacgcggagctgatggagaagtcgggcagaaaggagaccagggacatcccggtgtcccaggatttatgggccctccaggaaatccaggacctcctggcgcagacgggattgccggagcagccggtcctccgggaatccagggcagccctgggaaagaggggccaccaggccctcagggtccatcaggcctgcccggtatccccggtgaagagggtaaagaaggcagagatggtaagccaggcccacccggagagccaggcaaggctggagagcctggactccccggaccagaaggggctcggggtcctccaggattcaaaggtcacactggagattccggggctcctgggccaaggggcgagtccggcgcaatgggactccctggtcaggaagggcttccaggcaaggatggcgatacaggcccaaccggaccacaaggtccccaaggccctagaggtccgcctggaaagaatggctctcccggaagccccggagaacccggaccatcaggtacccctggacagaaggggtctaagggcgaaaacggatcaccaggcctgccaggattcctcggaccccgaggaccacccggagaaccgggagagaaaggcgttccaggcaaggagggagtgccgggaaaacccggagagccgggattcaagggcgagcggggagaccccggaattaagggggataaagggcctccaggaggaaagggtcagccgggtgacccaggtatcccgggacacaaaggtcacaccgggctgatgggccctcaaggactcccaggggaaaacggcccagttggaccccctgggcctcccggtcagcctgggttccctgggctgcgaggggagagtcctagtatggagaccctgaggagacttatacaagaggagctgggcaaacaacttgaaacacggctcgcctacctgctggctcagatgccgccagcctacatgaagagctcacaaggaagaccaggcccaccgggtccccctggcaaagacgggttgcctggtagggcgggaccaatgggagaacctggcagacccggtcagggcggactggaagggccaagtgggccaatcgggcctaaaggagagcgtggcgcaaaaggagatcccggagcccctggtgtgggactacgcggagagatggggccaccaggtattcctggccagcccggagagccaggatatgccaaggatggcctgcccggaattcccggacctcagggtgagacaggccctgccggtcacccaggactccccggtccaccaggccctcctggacagtgtgatccatctcagtgcgcctactttgcctctttggctgctaggcccggaaatgtgaaaggcccttag

SEQ ID NO: 4833 - DNA, 4821 bp, Artificial Sequence
  Description of Artificial Sequence: Synthetic coding sequence
atggctggcctccgcggaaatgctgtggctggactgctgtggatgctgcttctatggagtggcggaggcggatgtcaggcccaacgggcagggtgcaagagcgtccattatgaccttgtttttctgcttgatacctccagctccgtgggcaaagaagacttcgaaaaggtcaggcaatgggtggcaaacttggtggacactttcgaagtcggacccgaccggacccgagtgggtgtggtccgatatagcgatcgccctaccacagcatttgaactggggctctttgggtctcaggaggaagtgaaggcagcagcaagacggctggcataccacgggggaaacacaaatacaggtgatgccttgcgctacatcaccgcgaggagctttagtccacatgccggagggagaccgagggatcgcgcttacaagcaggttgccatcctgctgacagacgggcgaagtcaggacctggtattggacgccgctgccgcagcccaccgcgctggtatcagaatcttcgccgttggcgtgggggaggccctcaaggaagagctcgaggagatcgcttcggagcccaaaagcgcgcacgtgttccatgtcagtgactttaatgccatcgataaaatccgcggaaaactcaggcgcagattgtgcgagaacgtcctctgtccttcagtcagggtggaaggggaccgtttcaagcatacaaatggcggaactaaagagatcacagggttcgatctgatggatctcttttcagtaaaagagattcttggcaaacgagagaacggtgctcagtctagctatgtacgtatgggcagctttcctgtggtacagtccacagaggatgtctttccccaaggccttcccgacgaatatgcgtttgtgactacctttagatttagaaaaacgagccgaaaggaggactggtacatctggcaggtcatcgaccagtactctatcccacaagtatccattcgtctcgacggcgagaataaggcagttgagtataacgcggttggagctatgaaagacgcggtgcgagtagtcttcaggggctccagagtgaatgatctgttcgatcgggactggcataagatggcactgagcattcaggcgcagaatgtgtcacttcatatcgactgcgcccttgttcagaccctgcctatcgaggagcgcgaaaacatcgatattcaagggaagaccgtgataggcaagcgactttatgatagtgtgcctattgattttgacctacagcgcatcgtgatctactgcgatagtaggcatgctgaattagagacgtgttgtgatatacctagtggcccatgccaggttactgtggtgacagagccacccccaccaccccctcctcagaggcctcctactcctgggtccgagcagattgggtttcttaagactattaattgtagctgcccggcaggcgagaagggcgagatgggggtcgctggaccgatgggcctgcccggtcccaagggagatatcggcgcaatcggccctgtaggagctccgggtcctaaaggagagaagggggatgtcggaatcgggccttttggacagggcgagaagggggaaaagggttctttgggcctccccggtcctccgggacgcgatggtagtaaggggatgagaggagagccaggcgaactgggggaacctggcctgcctggcgaggtgggtatgcgcggtcctcagggaccaccgggtctgcctggtcccccaggtagagtcggcgcacccggtctccagggtgaacgcggtgagaaagggaccaggggagaaaaaggcgaaagagggctggacggttttcctggtaagccaggcgatacaggtcagcaaggacgaccgggtccatctggtgtcgccggaccccagggggaaaagggtgatgtgggacctgcaggaccccctggagtgccaggtagtgttgtacagcaggagggactgaagggagagcagggggctcctggccctcgaggtcaccagggggctcctggacctcccggagcccgtggtcctatcggccctgaaggtagggatggcccaccgggtcttcaaggattacggggaaaaaaaggtgatatgggacctcccggaattcctggcctgcttggactgcagggtcctccagggccacctggtgtacccggaccccctgggccaggcggatcgccaggattgccaggagaaatcggatttcccggaaagcccggtcccccaggccctaccggtcctccaggaaaggacggccctaacggtcccccaggacctcccggaaccaaaggcgaacctggagagaggggtgaagatgggcttccgggaaaacccggactgaggggcgaaattggtgagcagggactggccggtcgaccgggagaaaaaggggaggcgggattgccaggtgcacctggctttccaggggttagaggggaaaaaggagaccaaggggagaaaggagagctggggctgcccggactgaaaggtgacaggggcgaaaaaggtgaagctggcccagccggacctccaggcctgcctggcaccactagtctgtttaccccacacccacggatgcctggcgagcagggacccaagggagagaagggagatcccggactgcccggagaaccgggactccagggtcggcctggggagctcggacctcaagggcctacgggtcctccaggagcgaaaggtcaggagggggctcacggcgcacccggagccgctggcaacccaggggcaccaggtcatgtcggggctccagggccttcaggaccacccggttccgtgggcgctccaggcctccgcggtacaccgggaaaggatggcgagagaggggaaaagggcgcagccggtgaggaggggtccccgggacccgtagggccacgcggagaccctggtgcacctggactacctgggcctcccggtaaaggaaaggacggcgaacctggcttgagaggttccccaggcctgcccggaccgctcggcactaagggtgatcgcggagccccaggtatccccggaagtccaggatcaagaggagaccctggaataggagtcgccggaccaccaggccctagcggaccaccaggtgacaagggaagccccggaagtaggggtctgcctggttttcccggacctcaggggcctgcaggacgagatggggctccagggaaccctggggagagagggcctcctggtaaacctggcctgtccagcttgctgtctcccggtgatattaatctgctggccaaagatgtgtgtaatgactgtcctcccggacccccaggactacccggacttcctggctttaaaggggacaagggagtgcctggtaagcctggtagggaaggcaccgaggggaaaaaaggagaggcaggtcccccagggcttcccggacctccaggcattgctggccctcaggggtctcagggggaaagaggggctgacggcgaagtgggacagaaaggcgaccagggacatcctggtgttccagggttcatgggtccaccagggaacccgggacctcccggtgctgatggtatagcaggcgcagcgggacccccaggtatccaaggttcccccggaaaggagggtcctccaggtccgcagggccctagcggactgcctgggattccaggggaggagggaaaggagggtcgcgacggtaaacctgggcctcctggagagccgggaaaggccggtgaacctgggctcccagggccagaaggagcacgcggaccacccggtttcaaaggccacaccggagactctggcgctcccggacctagaggcgagtccggtgccatgggactgcctgggcaggagggtttgcccggaaaggacggcgacacgggaccaaccggtcctcaagggcctcagggccctcgcggtcccccaggaaagaatgggtcacctggctccccaggcgaacctggcccttcgggcacacccggacaaaagggctcgaagggagagaacgggtctcctgggctcccaggtttcctgggcccacgcggaccaccaggcgaaccaggggagaaaggggttcctggcaaggaaggtgttcctgggaagcctggagaacctggctttaagggggaaagaggagatccgggaatcaagggagataaaggccctcctggcggaaagggccaacctggggacccgggaatcccaggccataagggccatacaggcttgatgggtcctcaaggcctgcccggagagaatggacccgtaggaccgccaggtcctcctggccagcccggattccccggtctcaggggcgagagcccaagtatggaaactttacgcaggctgattcaggaagaactcggcaagcagctggaaactcgtctagcgtacctcctggcccagatgccaccagcatatatgaaatcttcgcagggacgacccggtccgccagggcctccaggtaaagacggactgcccggaagagcagggcctatgggagagcccggacgtccaggccagggtggccttgagggaccatcgggccctatcgggccaaagggtgagcgtggggcaaagggagaccctggtgcaccgggagtgggactgcgtggcgagatgggtcctcccggaatacctgggcagcctggtgaacccggttacgcaaaagacggacttcccggtattccgggaccgcagggagagacagggccagcaggtcaccccggtctgccaggtccccctgggccacccggacagtgcgacccatcacagtgcgcctactttgcctcgctggcagcacgaccaggaaacgtcaagggcccatag

SEQ ID NO: 4834 - DNA, 3960 bp, Artificial Sequence
  Description of Artificial Sequence: Synthetic coding sequence
atggctggcttgaggggaaacgctgttgccggtcttctgtggatgttactgctgtggtctggcggaggcggttgccaggctcagcgagctggatgtaaatctgttcactatgatctggtttttcttttagacacatccagctcagtgggaaaggaggatttcgagaaggtccgacagtgggtagccaacctggttgacacctttgaagtgggtcctgaccgcacaagggtcggggtcgtgcgctactctgacaggcccaccactgccttcgagttgggtctgttcggttctcaggaggaggtcaaagccgcagcgagacggctggcctatcatggaggaaataccaacacaggagacgcactgagatatatcactgcgcgaagcttctccccacatgctgggggacgcccacgggacagggcatataaacaggtggctatcctccttaccgatggcagaagtcaagatctggttttggacgcggcagctgcagcccatcgagctggtattaggattttcgcggtgggggttggggaagccctgaaagaggaattggaagaaatcgcctccgaacccaaaagcgcccatgtgtttcatgtgtccgatttcaacgcaatcgataagataaggggtaaactgagaagaaggctctgcgaaaacgtgctgtgcccatccgttcgtgtggagggagacagattcaaacacacaaatgggggaaccaaggagatcacaggctttgacctgatggacctgttctctgttaaagaaattctgggaaagcgggagaacggcgctcagagcagctatgtacggatgggtagcttccctgtcgtgcagtccactgaagacgttttcccccagggcctgccggacgaatacgcgttcgtaacgacgttcaggtttaggaagacgagtcgcaaggaggactggtacatctggcaggtcattgatcagtatagcatcccccaggtgtccatccggctcgacggggagaataaggccgtggagtataacgccgtagctggcccacagggagaaaagggcgatgtgggtcccgcaggtcctccaggggtgcctggttccgtagtgcagcaggaaggtttgaagggggagcagggagcgccagggcctagagggcatcagggtgccccaggtcctccaggggcacgtgggcctatcggaccagaaggacgggatggccctcctggattgcaaggtttgcgcggtaagaaaggcgacatgggccctcccggaatccccggactcctggggctgcagggcccacctggtccacctggggtgccaggcccaccgggaccaggtggttctccgggtttgcccggagagatcggatttcccggaaaacctggcccaccaggtccaaccgggccaccaggtaaggacggtccaaatgggccaccaggaccgccaggcaccaagggcgaacctggcgagaggggcgaggatggactgcccggaaagcccggattgcgcggagaaattggagagcaaggtctggcaggcaggcctggagagaagggtgaggctggattgccaggagctcctgggttcccaggcgttaggggggagaaaggagatcagggggaaaagggggagctgggcctgccgggactgaaaggcgaccgcggagaaaagggagaggctggcccagccggaccaccaggcctgccgggaactacgagcctttttacgccacacccacggatgcctggggagcagggaccaaaaggagagaagggggatcccggactgcccggagaacccggactgcagggacgtcccggagaactagggccacaggggccaactggtcccccaggcgctaaggggcaggaaggagcacacggagccccaggtgcagctgggaaccctggtgctcccggacacgttggggcacctggcccatccggcccacccggatctgttggcgctccagggttgcgcggtactcccggtaaggatggggagaggggcgagaagggcgctgctggtgaagaaggctcacccggacccgtgggtcccaggggggaccccggtgcaccaggtctacctggcccacccggaaaaggtaaagatggcgagcctgggctccgaggttcacccggtctgcctggtcccctaggcacgaaaggagacagaggagcaccaggaatcccaggcagtcccggtagtcgaggtgaccctggaattggggttgctgggcctccaggtccatccggaccacccggagataaggggagtcccggatctcgcggactgcccggtttccccggaccccagggtccagcaggaagggatggagcaccaggcaaccccggagagcgagggcctccaggaaaacccggactttcatcactgctgagccccggtgatattaacctcctggctaaggacgtgtgtaacgattgcccccctgggccacctgggctgcccggtctccctggatttaagggtgacaagggggtgcccggaaagccgggaagagaaggcacagagggcaaaaaaggcgaagccggtccaccaggtctgcccggtccccctggcatcgccggaccacaaggcagccaaggcgagaggggcgctgacggggaggtcgggcaaaagggggaccaaggacaccccggagtgcccggattcatgggccctccagggaatccaggaccccctggcgcagacgggattgctggtgccgctgggcctcccggaatacaggggtctcccggaaaagagggtcctcctggtcctcagggcccttctgggctccccggaattcctggcgaagagggaaaagaagggagggatggcaagcctgggcctcctggcgagcccggtaaggccggtgaacccggactcccagggcctgagggagcgaggggtcccccaggattcaagggacacacaggtgacagcggtgctcctgggccaagaggagagtctggagctatgggactccccggacaggaaggccttccaggaaaggacggggacacgggccctactggaccacagggacctcaagggccacggggaccacccggtaaaaatggtagccccggtagtccaggggagcccggaccctctgggactcccggtcaaaagggaagtaagggcgaaaatggtagcccgggactgcctggctttctaggcccacggggtcctcccggagagccaggggaaaagggggtgcctggaaaggaaggggtccccggaaaacccggagagccaggctttaaaggtgaacgaggagaccccggaatcaaaggtgataaaggccctccaggtggaaaggggcagccaggagacccaggtatccctgggcacaagggccacacgggcctgatgggcccacaaggcttgcctggtgagaatggtcccgttgggccacctggaccgccagggcagcccggatttcctggactccggggtgaaagcccctccatggaaacgcttcgacggctgattcaagaggagctgggtaaacagttagaaacaagattggcgtacctgctggcccagatgccaccagcttatatgaaatcaagtcaagggcgaccaggtcctccaggccctccgggaaaggatgggttacccggacgcgcaggccctatgggagagccagggagacctggccagggtggcttagaaggcccaagtggccctatcggtcctaagggggagagaggcgctaagggcgatccaggcgctccaggcgtgggactgagaggggagatgggccctcctggaattcccggacagccaggtgagcctggatatgccaaagacgggctcccagggattcctgggcctcaaggcgaaacggggcctgctgggcatccagggttaccaggacccccaggccctccgggacagtgcgatccctcccagtgtgcttactttgctagtcttgcagcgcgaccgggtaacgtgaaggggccatag

SEQ ID NO: 4835 - DNA, 5144 bp, Artificial Sequence
  Description of Artificial Sequence: Synthetic coding sequence
atgcacctccgcgcacacaggacaaggaggggcaaggtatcccccacggccaaaacaaagagcctgctgcacttcattgtgctgtgcgtcgctggcgtggtggtgcacgcccaggagcagggtattgatatcttacaccagttgggcctgggaggcaaggatgtgagacactctagccccgctactgccgtgccgtcagcttcaacccctcttccacagggtgttcacctcacggaaagtggcgttattttcaagaatgacgcctatatcgagactcctttcgtcaagatcctccccgtgaatttgggccagccgttcactattctgactgggctgcagtcccaccgtgttaataatgccttcctgttcagcattcgcaataagaaccgcctgcagctgggcgtgcagcttctcccaaagaaactagtggtacatattcggggtaaacagcccgctgtattcaattattctgtgcatgatgagcagtggcattcatttgcgatcacaatacgaaaccagtccgtgtccatgtttgtggaatgtggtaaaaaatatttcagtactgagactatcccagaagtccagacatttgatagcaactccgttttcacactgggcagtatgaataataactcaatccattttgaggggatcgtgtgtcagctcgacatcatcccatctgcagaggccagtgccgattattgtcggtatgtcaagcagcagtgcaggcaagcagataaatatcagcccgaaacaagcattccgtgcacgactctaatccccacaaaaatacccgagcactcacctcccccaaagctcttcgccgagaaggtactgtcagaagatactttcactgaaggaaagtcaattccgaacattatcaaaaacgattccgagaccgtttacaagaggcaggaacaccagattagtaggagccagctctccagcctccagtcaggtaatgtgtccgccgtggatttaactaatcacggcattcaggccaaggagatgatcaccgaggaggatactcaaactaatttctccttatcagtcaccacacatcggatctccgaagctaagatgaatactaaggagaaattttcctctctgcttaacatgtccgataatatcacccagcatgacgatcgggtgaccggattgagcttgtttaagaagatgccgagtattctgccccagatcaagcaggacactattactaaccttaaaaaggccatcacagccaaccttcataccaatgagttaatggagatgcagcccatactcaacaccagcctacaccgagttactaatgagcccagtgtagacaatcatctggatttgcggaaggaaggggaattctatcccgacgcgacttatcccatcgagaactcctatgagacagagctatatgattattactattacgaggacctaaataccatgttggaaatggagtatctgagaggcccaaagggcgacacagggccacccggaccaccaggacccgcaggcatcccaggcccttctggaaagcggggacctagaggtataccaggtcctcacgggaatcccggtctgccgggactgcctggccctaaagggcctaagggagatccaggttttagtcctgggcagcccgtgcccggtgaaaagggcgatcagggactttctggattgatgggccctccaggtatgcagggagataagggtctgaagggccatccaggattgcctgggcttccaggcgaacaggggattccgggtttcgcgggaaacatcgggagccctggataccctggtcgacagggacttgccggtcccgagggtaacccgggtcccaaaggtgcccaaggcttcataggatcccccggtgaagctggccagctgggccctgaaggtgaacgcggaatacctggtattagaggcaaaaagggcttcaaagggaggcagggtttccccggagactttggcgatagaggcccagccggactggatggctctccagggctggtaggcggaactggccctccaggattccctggacttcgcggatcagtgggaccggtgggacctataggaccagcaggtattcccggtcccatgggcctgtctgggaataagggccttcccggtatcaagggagataagggcgagcaggggaccgcaggagagctgggcgagcctggatacccaggagataagggtgcggtagggcttccgggtccgcctggaatgaggggcaagagtggacccagcggtcagaccggtgaccccggtttgcagggaccttctggcccacccggacccgaaggttttccgggagatatcggaattccagggcagaacggtccagaaggccctaaagggctgctcggcaaccggggaccacccggtccgccaggactgaaaggaacccaaggtgaggagggccctattggggcatttggagaactggggcctagagggaaacctggccagaaaggctacgcgggagagccagggccagaggggctgaagggtgaagtcggcgatcaaggcaacatcggaaagatcggcgaaacgggcccagtgggtctccctggcgaggtggggatgactgggtccataggagaaaagggcgagcgcggaagcccaggaccactgggtccccagggtgagaagggcgtgatgggctatcccggtcctcccggtgtgcccggacccatcggccctctggggctaccaggccacgtaggagcacgaggccctcccggttctcagggccctaaaggacagcggggaagtcggggacctgatggactgctgggagagcaagggatccagggggcaaagggagagaagggcgaccagggaaagcgcggtccccatggcctgataggtaaaacaggcaaccctggagagcggggattccagggaaagccgggtctgcaggggttgccaggcagcaccggtgacaggggcctccctggcgagcctggacttcgcggactgcagggtgacgtaggtccaccgggagagatgggaatggaaggcccaccagggacagagggagagtccggattgcagggtgaacctggcgctaaaggggacgtcggcactgccggaagtgtcggcggtaccggtgagcctgggttgcgtggcgagcccggagcccctggtgaggaaggcctgcagggcaaagacggcttgaaaggagtcccgggaggaagggggctccctggcgaagacggtgaaaagggtgagatggggctgccagggattattgggccactgggaaggtctgggcaaaccggcctgccaggtccggaaggcatagtagggattccaggccaacgtggacggcctggaaaaaagggcgataagggccaaatcgggcctaccggagaggtgggctccagggggcctccaggaaagattggcaaatctggaccaaaaggggcacgcggtacccgcggtgccgtcggccatttgggactgatgggcccagacggagaacccggtatacctggatacagaggacaccaaggtcagccaggcccttctggtctacccggaccaaaaggcgagaaaggctatcctggcgaggacagcacagtactcggccctcccggtccacgcggagaaccaggaccagtgggagaccaaggagaaagaggagaacccggagctgaaggctataagggtcacgtgggggtccccggactccgcggagcgacggggcagcagggaccacctggggagcccggagaccaaggagaacaaggcctgaagggagagagaggcagtgagggtaacaagggcaagaagggggctccaggcccatccggcaagccaggtatcccagggctgcaggggttgctgggcccaaaaggcatccagggctatcacggagcagatggcatctctggcaatcccggtaaaattggcccaccaggaaaacagggtcttcccggtattcgtggaggacctggaaggacaggcctggcaggagcaccgggtccccctggggtcaaagggtcctccggcctgcccggatccccaggaattcaaggcccaaaaggcgagcaaggattgcccggacagcctggaatccagggaaaacgcggtcatcggggtgcccagggtgaccagggcccttgcggagatccaggacttaaggggcaaccaggtgagtatggcgtgcagggactgaccggctttcagggattccccggaccgaaaggcccagaaggagatgccggaatcgtcgggatctcgggacctaagggacctatcggccatagaggcaacaccggccctctgggaagagaaggcatcattgggccaaccggtcggaccggtccccgaggggagaagggatttcgtggtgaaactgggcctcagggtccacgaggccagcccggaccccctgggccaccgggtgctcccggaccacgcaaacagatggacattaacgcagcaatccaggcattgatagagtcaaatactgcgctgcagatggaatcctaccagaataccgaggtgacgttaatagaccatagtgaggagatcttcaagactttaaactacctgagcaatttgctgcattccatcaaaaatccgctgggcactagggataaccccgctaggatttgtaaggacttgctgaactgcgagcagaaggtcagcgatggcaagtattggatagatcccaatttgggatgcccaagtgacgccattgaggtgttttgcaatttttcggccggaggtcagacttgcctgccccctgtatctgtcactaagctcgagttcggcgtgggcaaggtgcagatgaacttcctccatcttctgtcctcggaagcgacccacatcataaccattcattgtctcaatacccctcggtggacatctactcagacctcaggacctggactgccgattgggtttaaggggtggaatgggcaaatcttcaaggtgaacacactcctcgaacccaaagttctctcagacgattgcaagatccaagacggctcctggcataaagccacgttcttgtttcacacacaggagccaaaccagttgcccgtgatcgaggttcagaagctgcctcacctgaagacagagcgcaagtactacatagacagctcctctgtttgtttcctcta

SEQ ID NO: 4836 - DNA, 5081 bp, Artificial Sequence
  Description of Artificial Sequence: Synthetic coding sequence
atgcacctccgcgcacaccgcactcgtcgcggaaaagtgtcacctactgcaaagacaaagtcactcctccacttcatagtattgtgcgtggcaggcgtggttgtccacgcccaggagcagggcattgacattctacatcagctgggactgggcggaaaggacgttcgacactcttctcccgctacggcggtacctagcgcctctactccccttcctcagggcgtgcatctgactgaaagcggtgttatcttcaagaacgatgcttacatcgagaccccctttgtgaagattcttccagtgaatctcggacagccatttactatcctgactggccttcagtcccacagagtcaacaacgcatttctgttctcaattcgcaacaaaaaccgactgcagctcggtgttcagctgctacccaagaaactggttgtccatatacggggtaagcaaccggctgtgtttaactacagtgtgcatgatgagcagtggcactctttcgctattacgattcgaaaccagtcagtaagcatgttcgtggaatgcggtaaaaaatattttagtacagaaaccatcccggaagtgcagaccttcgactctaatagtgtctttacactaggctccatgaacaataacagtattcattttgaagggattgtgtgccagctcgatattattccaagcgcggaggcgagtgctgactactgtcgttacgtcaaacaacagtgccggcaagcagacaaataccagcctgaaactagcattccttgtactacactcatcccgactaaaatcccggaacactctccacctcccaaactgtttgccgagaaggttctgagcgaggacactttcacagagggcaagtcaatcccaaacatcatcaagaacgactcagagaccgtatataagcggcaggaacaccagatatcgcgcagccagctctccagcttgcagtcaggcaatgtgtccgccgttgacttgacaaatcacggtatccaggccaaggagatgattacggaagaggacacccaaaccaacttcagcttgagtgtcacaacacatcgcatatctgaggccaagatgaacacaaaggagaaattctccagccttctcaatatgtccgataacataacacagcacgatgatagagtgacaggcttgtccctgtttaaaaaaatgccatccattctcccacaaatcaaacaagacaccatcacaaatctgaagaaagccattaccgccaatctgcacacaaacgaactgatggagatgcagcccatcctcaacacctcattacaccgagtgacaaacgagccctcagtggataatcaccttgacctccggaaagaaggggaattttatccagatgctacatatcccattgagaacagttacgagaccgaactttatgactattattactatgaggacctgaacaccatgctcgagatggaatacctaaggggccctaaaggggataccgggcctcctggccctccagggccagcgggtatcccaggcccaagcgggaaaaggggcccaaggggcatacccggtccacacggaaacccagggctgccaggtctgccgggacccaaaggacctaaaggggacccagggttttcaccaggccagccagtgccaggcgaaaaaggtgatcaggggctctcagggctgatgggccctccaggcatgcagggggataagggacttaagggacatcctgggctgccaggcctccccggtgagcagggcattcccggatttgccggaaacattggttcaccgggatacccaggaagacaggggctcgctgggccagaggggaacccgggtccaaaaggcgcacaggggttcatcggcagtccgggagaagccggacagctcggtccagagggggaaaggggaatccccggaattagaggtaaaaagggattcaaaggcagacagggctttcccggagatttcggggatcgaggacccgctggacttgacggtagcccagggttggttggagggactgggccaccagggttccctggcctgcgtgggtctgtgggcccagtgggccctatcggacccgctggcattccgggacctatgggcttaagtggcaacaagggccttcccggaattaaaggggataaaggggaacagggcacagccggtgaactaggtgagccgggttatcctggggacaagggcgctgttgggctgccaggcccacccggaatgcgaggcaaatcaggcccttccggacagaccggagatcccggtttgcagggaccctcaggcccaccaggacctgaagggttccccggagatatagggatcccagggcagaatggcccagagggacccaaaggtctcctgggaaaccggggtcctccaggaccgccagggttaaaggggactcaaggggaggaggggccaatcggtgctttcggcgagctgggtcctaggggcaagcccggacaaaagggatatgcaggagaacccggtccagagggcctcaagggcgaggtgggcgatcaaggaaacatcggaaagatcggggaaactgggcctgtcgggctgccgggagaagtgggtatgactggatctattggagagaagggggaacgcggtagcccaggcccactgggaccccagggagaaaagggagtgatgggataccccggaccccctggtgtgcctggcccaatcggccctttaggcctccccggacacgttggggctagggggcctcccggttcccaggggcctaagggccaacggggaagtcgcggaccagatggcctgctcggcgagcagggcatacagggcgcaaaaggagaaaagggggaccaagggaagagaggacctcacggtctcatcggaaagactggaaacccaggggaaagagggttccagggtaagcccggactccagggcctcccaggttctaccggcgaccgaggcctccccggagaacccggattaaggggacttcaaggcgatgtgggacctccaggcgagatggggatggaaggacctccgggtaccgagggggagtctggccttcaaggagagcccggtgccaagggcgatgttggcactgctggatccgtcgggggtacaggcgagcccggactgcgcggagaaccaggagcgccaggggaagaaggtctgcagggaaaggacggtcttaaaggcgtgcctggtggcagaggactgccaggtgaggatggtgagaagggcgagatgggcctgccaggcataatagggcctctgggacgaagtggccaaacaggcctcccaggtcccgaaggcatcgtgggtattccaggacaacgcggtcggccaggaaagaagggggacaaagggcagattggccctacaggggaagtaggctctaggggaccccctggaaaaatcggaaaaagtggtcccaagggtgcgagaggaactaggggtgcggtgggccatctcgggcttatgggccctgatggagagcccggaattcccggatacaggggccatcaggggcagcctggtccctcaggcctgccgggtccaaagggggaaaaggggtaccccggagaggacagtacagtgctcggtcccccaggccctaggggagaaccaggtcccgtaggcgatcagggcgagcgcggagagccgggagcagaaggatacaagggccacgtcggtgtgccgggactgagaggcgcaacaggccagcagggtcctcctggcgaacccggagaccagggagagcagggccttaagggagagcggggatctgaaggtaacaaggggaagaagggggctcccggaccatccgggaaaccgggtatccccggtctgcagggattgctgggacccaagggaatacaagggtaccatggggcagacggcatcagcggcaatccaggtaagattggacccccaggaaaacagggactgccaggcatacggggagggccagggagaactggactggccggagcaccaggcccacccggagtaaagggttcatctggtttgccagggtcgcccggaatccaaggcccaaaaggcgaacaagggctgcccggtcagccaggcatccagggaaagcggggacatcgaggagcccagggcgatcagggcccatgcggggacccagggcttaagggacagccaggagagtacggcgtccagggacttaccgggtttcagggctttcctggacctaagggtccagagggggacgctggtatcgtgggcatttcaggtcctaaaggccctatcgggcatagaggaaatacgggcccattaggtcgcgagggaatcatcggacccaccggcagaacgggaccacgcggagaaaagggctttcgcggagaaaccaagcagatggacattaacgcagctatccaggccctcatcgagtcaaacaccgccctgcagatggaaagttatcaaaatactgaggtgaccctgatagaccactccgaagaaatttttaaaactcttaattacttaagcaacctgctgcattcgattaagaacccactggggactcgcgacaaccccgctcgcatttgtaaggatctgctcaactgtgaacagaaggtgtctgacggtaagtactggatcgaccccaatttgggatgcccctctgatgcgatcgaagttttttgcaactttagcgctggtggccagacctgtctgcctccagtgtccgtcacaaaattggagtttggggtgggaaaggttcaaatgaactttctccatctgctcagttcggaggcgacccatattattacaatccactgcttaaacacaccgagatggacatccactcaaacaagcggtcccggactgcctatcggattcaaaggctggaatggacagatctttaaggtcaacacactgctcgaaccaaaagtgttatcagatgactgcaaaatccaggacgggtcttggcacaaggctacatttctctttcatacacaggaacctaaccagttgcccgtcatcgaagtgcagaaactccctcacttgaagacggaacgcaagtactatattgacagcagctcagtttgtttcctgta

SEQ ID NO: 4837 - DNA, 246 bp, Artificial Sequence
  Description of Artificial Sequence: Synthetic coding sequence
atgcacctgcgggctcacaggactaggaggggaaaggtgtcccccactgctaaaacaaaaagccttcttcatttcattgtgctgtgcgtggctggagtagtcgtccacgcccaggaacagggcattgatattcttcaccagctcggcctggggggtaaagacgtgcgacatagcagcccagccactgcagttccatcagcctccacacccctgccacagggtgtacatctgaccgagagcggctag

SEQ ID NO: 4838 - DNA, 1971 bp, Artificial Sequence
  Description of Artificial Sequence: Synthetic coding sequence
atgctcttaaagaagcatgccggtaagggcggagggagggagcctcgctcagaggaccccacccctgcagagcaacattgcgccagaacaatgccgccttgcgccgttctagcagctttgctgtccgtggtggctgtggtcagctgcctgtacctgggggtgaagactaatgatttgcaggccaggatcgcagcacttgaatctgccaaaggagctccctccattcatctgctcccggacactctcgaccacctgaaaaccatggtccaagagaaagtggaacgactgctggcccagaagtcttatgagcacatggcaaaaattcgaatcgcccgtgaggccccatctgagtgcaactgccccgctggcccaccgggaaagcgagggaagaggggtcggcgtggggagtccgccggaccccctggagcccctgcaccttctcagggaccgccaggccctaagggagacaaaggcgaacagggggaccagggaccgcgaatggtgtttcccaagatcaaccacggcttcctgagcgcggatcaacagcttattaagaggcggctcatcaagggcgatcaggggcaggccggacctcctggcccaccaggccctcctggaccacgagggcctcctggcgacacaggcaaagatgggccacggggaatgccgggagtgcccggtgagcccggtaagcccggagagcaagggctgatgggccctcttgggccacccggtcagaagggctcaattggcgctccagggatacccggaatgaatggtcagaaaggagagcctggcctgccaggggctgtgggtcagaatggcatccccggtccaaaaggggagcccggtgagcaaggagaaaaaggggatgctggcgagaacggcccaaagggcgatacaggtgagaagggcgaccctggatccagcgctgccggaataaagggggaacctggtgagtcaggacggccagggcagaagggagaacccggtcttccaggtcttcccggactgcctgggatcaaaggcgaacctggatttatagggcctcaaggggaacctggacttcccggactccctggtacaaagggagagcggggagaggctggtccaccgggaagaggcgagcgcggagaacccggagcccctggtccaaaaggcaaacagggggagtccggtacacggggaccaaagggctcaaaaggcgatagaggggagaagggcgacagcggagcacaaggccctagggggccaccgggacaaaaaggggatcagggggctacggagattatcgactataatgggaacttgcacgaggcccttcaaagaataactacactgactgtgaccgggcctccaggtccacccggtccacagggcctccaagggcctaagggggagcagggttcacccggtatacccggaatggacggagagcaaggcctgaagggctcgaaaggggacatgggagacccgggaatgaccggtgagaaaggcggaatcggacttcccggacttcctggagcaaacggtatgaagggcgaaaaaggggactccggtatgccaggcccacaagggccatcgatcattggcccacctggcccaccagggcctcatggcccaccaggcccaatgggccctcacggcctacccggaccaaaaggcacagatggtcccatgggacctcatgggcctgccggtccgaagggagagagaggggagaagggcgcaatgggggagccaggccctagaggcccatacggactgccaggcaaagacggagagcctgggctcgatggatttccgggaccacggggagagaagggggatctcggggagaagggggagaaggggttcagaggagtgaagggagagaaaggcgagcctggccaacccggtctcgacgggcttgacgcaccctgccaactgggccctgacggactgcccatgcctggttgttggcaaaagtag

SEQ ID NO: 4839 - DNA, 1929 bp, Artificial Sequence
  Description of Artificial Sequence: Synthetic coding sequence
atgctactaaaaaaacatgctgggaaaggcggaggtcgtgagccccgttccgaggaccctactcccgcagagcagcactgtgctaggaccatgcctccttgcgccgtgctagcagcactcctatccgtggttgccgtggtctcctgcctatacctcggcgttaaaacaaacgatctccaagctcgcattgccgcactggaaagcgcgaagggagcaccctcaatacacctgctgcccgacactttggatcaccttaaaaccatggtgcaagagaaggtagagagactcctggcccaaaaatcgtatgaacacatggccaagattcggatagccagggaggctccctctgaatgtaactgtccagccggacctccagggaagagagggaagcggggaaggcgcggagagtctggccctccaggacagcccggacctcaggggcctcctggaccgaagggtgataagggggagcagggtgaccagggccctcggatggtgtttccgaaaattaaccacggcttcctttccgccgatcaacaactgatcaaacggaggctaattaagggcgaccaagggcaggcgggaccacctggtcccccaggtccccctggacctagggggccacctggagatacagggaaagatggtccaagaggtatgccaggggtgcccggagagccaggtaagcctggggaacaaggactcatgggccctttaggaccccctggccagaaaggcagtattggcgctccagggattcccggaatgaatggccagaagggtgagcccggactccccggagcagtgggccagaatgggatcccaggtcccaaaggcgagccgggagaacaaggggaaaaaggagatgcaggcgagaatggtcccaagggcgacacaggcgaaaagggcgaccctggcagttcagcggctggcattaagggcgagcctggagagtcagggaggccagggcaaaaaggtgaaccaggactgcccggtctgccgggtctgccagggattaagggggaacctggttttatcggccctcagggcgagccaggcctcccaggactgcctggtactaaaggagaacggggagaagctggaccacccggacgcggagagcgaggcgaacctggggcacctggccctaagggcaaacagggcgagtccggaacccgaggtcctaagggatcaaagggtgaccgcggtgaaaaaggagacagcggcgctcaaggacccagggggccacccggacaaaaaggtgaccagggtgcaaccgaaatcatcgattacaacggaaacctacacgaagctctgcagaggatcaccactctgacagttaccggccctcccggtccccctggccctcaagggctccaaggtccgaaaggcgagcagggaagtcccggaatccccggtatggatggagaacagggtctgaaagggtccaaaggggatatgggggatcccggaatgactggagaaaagggtggaatcgggttgcccggtcttcctggcgctaacggcatgaaaggcgaaaaaggcgactccggaatgccaggcccacaaggcccatcgatcattggccctcccggacctccagggcctcacggtccccctggtccgatgggccctcatggccttccgggacctaaaggaacagacggccctatgggtccacacggtccggctggaccgaaaggcgaacgaggggaaaagggagctatgggagaacctggtcctcgcggaccatatggtttaccgggaaaggatggtgagcccggtctggatgggttccctggtccaagaggcgagaagggcgatctcggggagaagggggaaaaagtgacctccccttctcagcatgtgccctgtctgattttactgttgctctccgcgctacttttcagcctctgcgatagtatctag

SEQ ID NO: 4840 - DNA, 1965 bp, Artificial Sequence
  Description of Artificial Sequence: Synthetic coding sequence
atgctgctcaagaagcacgctgggaaaggaggtggacgcgagccacgcagtgaggaccctactcctgccgagcaacactgcgccagaacaatgccgccttgtgccgttctcgccgctcttctatcggtggtggcagtggtgagctgtctgtatctcggggtgaaaacaaatgaccttcaggcacgcatcgctgcactcgagtccgctaaaggcgcaccgtccatacatttgttgccagacacacttgatcacctcaagacgatggtgcaggagaaagtagagcgcttgctggctcagaagagctacgagcacatggccaagattaggatcgcaagagaggccccaagcgagtgtaattgcccagccggaccacccggaaaacgcggtaagcgcggacggagaggtgagtccggccctcccggacaaccaggtccccagggcccacccggaccaaaaggtgacaaaggagagcaaggagaccaggggccacggatggtttttcctaagatcaaccatgggtttctctctgctgaccagcagctgattaagcgaagacttattaaaggcgatcagggccaggcaggccctcccggaccaccagggcctccgggaccacggggacctccaggagacaccggtaaggatgggccacgcggaatgcccggtgtgcccggagaaccgggtaagcccggagagcaaggcctgatgggacccctgggccctccaggtcagaaaggctctattggcgctcctggcattcctggcatgaacggtcagaagggagagccgggacttcccggtgccgtggggcagaatgggatccctggacccaaaggcgaacccggtgagcagggggaaaaaggtgatgccggagagaatggtcccaagggtgatactggcgaaaagggcgacccgggaagcagtgctgcaggaattaaaggggagcccggagaaagcggcaggccaggccagaagggcgagcccggactgccagggctccccggattgccagggataaaaggcgagccaggatttataggtccacagggagaaccaggcctcccaggcctcccgggtacaaaaggagagaggggagaagcagggccaccaggaagaggggaacgtggagagccaggagcgcctgggcctaaaggaaagcagggagaaagtgggacaaggggacccaagggttctaaaggcgatcggggagagaagggtgactccggagctcagggacccaggggacctccaggtcagaaaggagatcaaggagctaccgagattattgactacaatggcaacctgcacgaggccctgcagcggatcaccaccctgacagttaccgggcctccgggtccacccggaccccagggcctccaaggtcctaagggggagcagggctcccccggaattcccggtatggacggtgaacaaggcctgaagggatctaagggcgacatgggagacccgggaatgactggcgaaaagggcggtatcggcctgcccggtctgcctggcgcaaacggaatgaagggagagaaaggagatagcggaatgcctggtccacagggaccatcaatcatcggtcccccaggtccccctggcccacatggccctccaggacctatgggacctcacggcctcccaggtccgaaggggactgacggtcccatgggacctcacggtcctgccggaccaaaaggcgagaggggagaaaaaggcgctatgggggaaccaggccctcggggtccatacggattgcctggcaaagatggagaaccaggcctcgacgggtttcccggaccgaggggtgaaaagggcgacctgggtgaaaagggggaaaaagggtttcgcggtgtaaagggggaaaagggggaacctggacaacccggtcttgacggtctagacgccccttgtcagctcggccctgatggcctgcctatgccaggctgctggcagaaatag

SEQ ID NO: 4841 - DNA, 1752 bp, Artificial Sequence
  Description of Artificial Sequence: Synthetic coding sequence
atgctgctcaagaaacatgcgggaaaaggaggcggacgagaaccaagatccgaggatcctacccctgcagaacagcactgtgcacggaccatgccaccttgcgccgtcctggctgctctgctgtcggtcgtcgccgttgtgtcttgcctttatctgggcgtgaaaaccaatgacctgcaggcacgcatcgctgcgctcgagtccgccaagggcgcacctagcatccatttgctgcctgacactttggatcacctgaaaacaatggttcaggagaaagtcgaacggttgctggctcagaagtcctatgaacacatggcaaaaatcagaatcgcccgagaagctccatccgagtgcaattgtccagcaggccctcccggaaagcgcggaaaaaggggcaggcggggtgagtccgctggcccaccgggtggtcccccaggtcctaaaggagataagggcgagcaaggagatcaagggccacgaatggtgtttcctaaaatcaatcacggatttctgtccgccgatcagcagctaattaagaggcggctaattaaaggggaccagggacaggccggtccacctggaccccctgggccacctggcccacggggacctccaggggatacgggcaaagacggtcccagaggcatgcctggcgtgcctggcgagcctggcaagccaggggagcagggtttaatggggccactgggtcctcctggccagaaagggtctatcggagcccctggaatccccggaatgaatggccagaaaggagagcctggccttccaggcgctgttggccagaacggcatcccaggcccaaaaggggagccaggcgagcagggtgaaaagggcgatgcaggtgaaaatggtcctaagggcgacaccggagagaaaggtgaccccggaagctcagctgccggaatcaaaggcgagcccggtgagtccggcaggcctggccaaaagggcgaacccggatttattggaccacagggcgagcccggtctccctggattgccaggaaccaagggcgagcgtggcgaagctggaccacccggaagaggagagcgtggggaaccaggtgctcccggtccaaaaggaaaacagggcgagtccggcactcggggtccgaaggggtcaaaaggagatagaggtgagaagggagatagcggggcacaggggcctaggggcccaccgggacagaaaggggaccagggcgctacggaaattatcgattacaatggcaacctgcatgaggcgctgcagagaataaccactctgactgttacgggtcccccaggccctcctggccctcaagggttgcaagggccaaaaggggagcagggcagtcctggtattccagggatggatggcgagcagggtctgaagggatccaaaggcgacatgggcgatccaggaatgactggagagaaaggaggcatcggactccccggactcccgggagccaatgggatgaagggcgagaagggtgattccggaatgccagggcctcagggtccatcaattatcggaccccctgggcctccgggaccccacggtccacccggaccaatgggacctcatggcctcccaggacctaaaggaaccgatggacccatggggcctcatggtcccgctggcccaaagggggagcgtggtgagaagggtgctatgggcgaaccgggaccaagaggcccttatggcttgccacaaggcccagatgggctgcccatgccaggctgttggcaaaaatag

SEQ ID NO: 4842 - DNA, 1497 bp, Artificial Sequence
  Description of Artificial Sequence: Synthetic coding sequence
atgctgcttaaaaaacatgcaggcaaaggaggagggagggaacctcgctccgaggatccaacccctgcagaacagcattgcgccaggaccatgcctccttgcgccgttcttgcagctctgcttagtgtcgtggccgtcgtgagttgcctttatcttggcgtcaaaaccaatgaccttcaggccagaattgccgcactagaatcggctaagggagcccctagcattcacttgttgcctgacacactggaccatctcaagacaatggttcaggaaaaagtcgagcgcctgctggcccagaagtcctacgagcacatggccaagatacgcatcgccagagaagctccatccgagtgcaactgtcccgcaggtccgccaggaaagcgtggaaagagaggcagacggggtgagtccgccggacccccaggagcacctgctccgagtcagggcccacccggaccaaaaggcgataaaggagaacagggggaccagggccctcggggaccactggggcctccaggccagaaaggctctattggcgcacctggaattcctgggatgaatggtcagaagggagaaccgggtctgcctggggctgttggacagaacggtatccccggaccaaaaggggaacccggagagcaaggggagaaaggcgacgccggagagaacggcccaaaaggcgatacaggagagaagggggatccaggctcatccgcagccggtatcaaaggcgagccaggcgagtccggccgtcctggccagaaaggtgagccagggttaccaggtctgcccggactccccggaatcaagggggaacccggatttataggtccccagggcgagccgggactcccagggttgccaggcaccaaaggtgagaggggggaggcaggaccacccggacggggtgaacgcggagaaccaggagctccaggccctaaaggtaagcagggcgaatccggaacccgcggtccaaagggttctaaaggcgacagaggtgagaaaggagattccggagcccaaggcccaaggggtcctccagggcagaagggtgaccagggagctacggaaatcatcgactataacggaaatctgcatgaggcgctacaacgtataaccaccctgacagtgacagggcctcctggtccgcctggccctcagggcctgcaaggtcctaaaggtgaacagggctcacccggaatccctggcatggacggagagcagggactcaaaggctcaaaaggggatatgggagatcccggttcacagtggaatgaacggaggaagcgcagattctggaatgccggttccactggtagcttttaccataggcccacaaggcctacgcgatctccatggcctacctggccgcatggaacgtcttggacaagctggaccaagggatctatttggctgcgacggaaagccagaatccctggctacagatggtcatacggcaccccctggccatgtaggtctcagcggagaaagtcatag

SEQ ID NO: 4843 - DNA, 213 bp, Artificial Sequence
  Description of Artificial Sequence: Synthetic coding sequence
atgctgctgaagaaacatgcaggtaaggggggagggcgagaacctcgctctgaagaccccaccccggcagagcaacattgcgctcgtaccatgccaccttgcgctgtgttggcagccctactgtctgttgtggccgttgtttcttgtctatatctgggcgtgaaaaccaacgatctgcaggccagaatcgcagcactcgagtcagcgaagtag

SEQ ID NO: 4844 - DNA, 90 bp, Artificial Sequence
  Description of Artificial Sequence: Synthetic coding sequence
taaggcccaaggggcgaaaaaggtgacctgggcgagaagggcgaaaaaggaccagacggacttcccatgcccggatgctggcagaagtag

SEQ ID NO: 4845 - DNA, 5582 bp, Artificial Sequence
  Description of Artificial Sequence: Synthetic coding sequence
atgggtgccggtagcgctcggggagctcgaggcactgctgccgctgcagccgctaggggcggaggattcttgttcagctggatactagtctcttttgcttgccaccttgcctctacgcagggcgctcccgaagatgtcgatatcctgcagcggctcggattgagttggacaaaggctggatcaccagccccaccaggggtcattcctttccagagcgggttcatctttacccagagggcccgtttacaggcacctacaggcacagtgattcccgcagccctcggaacagaactggcgctggtcctcagcctatgcagccatagagtcaaccacgcgtttctctttgccgtgagatctcagaaacggaaattacaactgggattacaattcttgcccggaaagactgtggtgcacctaggatcccgccgttctgttgcttttgatttggacatgcacgatggccgttggcaccacctggctttggagcttagaggccgaacggtgactctggtgaccgcatgtgggcagcgaagagttcccgtgctgctccccttccatagagaccccgcactggacccaggcggatccttcttattcggtaagatgaatccccacgcagtgcagttcgaaggagccctctgtcagtttagtatctacccggtgacccaggtcgcccataactattgtactcatctaaggaagcagtgcgggcaagccgacacctatcagagccctctgggaccgctcttctctcaggactcagggaggccctttacttttcagtcggatctggccctattgggcctggaaaacctcaccaccgcaacccccgctttgggcagccttcccgctggcagggggcctcgaggcactgttgcacccgctacccctacaaagcctcagcggacttcaccaactaacccccatcagcacatggccgtggggggacctgcacagacacccctgcttcccgctaaattaagcgcttctaacgccctggacccgatgctgcccgcttcagtgggcggaagcactaggaccccccgacctgctgctgcccagcccagccagaagatcaccgccactaagattccaaaatctctgccgacgaagcctagcgcaccatccacgagcattgtgccaatcaagtcaccccacccgacacagaagactgcaccgtcgagcttcacgaagtctgccctccccacacagaaacaggttcctccaacttccagaccagttccagctagagtgtcccgccctgccgaaaaaccgatccaaagaaacccaggaatgcctagacccccaccaccatctacacggccactcccccctactacttctagcagcaagaagccaatcccgacactggcaagaaccgaggccaagattacatcacatgcttctaagcctgcttccgccagaacttctacacataaacccccaccctttaccgcacttagctcttcacctgcacctaccccaggttcaacccgatctacacgtcccccagccactatggttcccccaacaagtggtacaagcacacccaggaccgccccagccgtgcccacccctggtagcgcccctactggttcaaagaagccgattggatccgaggcatccaagaaagccggaccaaaatccagccccaggaagcccgttcctcttagaccaggaaaggctgcacgggatgttccattatcagatctgaccacaagaccttcacccagacagcctcagccatcacaacaaacaactcccgctctggtgcttgcccctgctcagttcttgagcagttctcccagacccacttcctctgggtacagtatctttcatttagctggctccacgccttttcctcttctgatggggcctccagggcctaagggcgattgtgggctccccggaccaccaggtctgcccggactcccaggcatccccggtgcgaggggccctaggggacctccaggcccttatgggaaccccggactgcctggccctccaggcgctaagggccagaagggtgacccaggactgtctccaggaaaagctcacgacggcgcaaaaggcgatatggggctgcccggactgtcaggcaatcctggcccaccgggtcgcaaggggcataaggggtatcccggaccagctggacaccccggtgaacaagggcagcccggtcccgaaggctccccgggtgccaagggataccccggtaggcagggcctgccgggaccagtgggagatccagggccaaaagggagccggggttatatcggactgccaggcctgttcgggctgcctggatccgatggtgaacgcggtttgcctggagtgcctggcaaacggggtaagatggggatgccaggatttcccggagtttttggagagagagggccacccggactggacggcaaccccggagagctgggactccccggacccccaggagtgccaggtctcattggcgacctgggcgtgctcggacccatcggctatccaggcccaaaaggtatgaagggactcatgggatccgttggggagcccggtctaaaaggagacaaaggggaacagggcgtgcctggagtgagcggtgacccgggttttcaaggcgacaagggctcccagggcctgcccggatttccaggtgctcgcggtaaacctgggccattggggaaagtcggcgacaaaggatctataggctttccgggaccacctggcccagaagggtttccaggggacattggcccaccaggtgacaacggaccagaggggatgaaggggaaacctggagcgcgagggctgcccggtccaaggggacagcttgggcctgagggcgatgagggccctatgggccctcccggtgcacctggattggaaggccagcccggacggaaaggatttccaggccgaccaggactggacggggtgaagggtgaacccggtgaccctggaaggccaggtcctgtcggcgagcaggggttcatgggctttattgggctagtaggggaaccgggaattgtcggtgagaagggggaccggggaatgatgggtcctccaggggtgcctggtccgaaaggcagcatgggtcaccccggaatgcccggaggcatgggtacaccaggcgagcccggaccccagggaccccctggttctaggggacccccagggatgaggggcgctaagggccgaaggggtccccgagggccagacgggcctgcaggtgagcagggatctcgcggactcaagggaccacctgggcctcagggacgacctggacggccaggccagcagggggtggccggagagcggggacacttgggcagtcgcggattccccggaatcccagggcctagcggcccacccggtaccaagggattgcctggggagcccggtcctcagggaccccaggggccaatcgggcctcctggagagatgggacccaaggggcctcctggcgctgtgggtgaacctggactgcctggcgaagccggaatgaagggggatctggggccattgggcacacccggagaacagggcctgattggacagcggggtgagcccggtctagagggcgacagtggccctatgggtcccgacggcctgaagggtgatagaggggacccaggtccagacggagaacacggcgaaaagggtcaggagggcctgatgggcgaggatggtcctcctggccctcccggagtcactggcgtgcgcggtcctgaaggaaagtcagggaaacagggtgaaaagggcaggactggtgctaaaggggctaagggatatcagggacagctgggcgaaatgggcgttccaggcgatcccggtccccctgggaccccagggcctaagggctcacggggaagtctcggtcctaccggcgcaccaggcagaatgggagcacagggcgaaccaggactggcaggatacgatggtcacaagggcatagtcggtccacttggcccacccggaccaaagggtgagaagggcgaacagggcgaggacgggaaagcagaggggccaccagggccaccaggagaccggggaccggtcggggatagaggggacagaggggaacccggagatccaggataccccggtcaggaaggagtgcagggtctacgaggcaagccaggccagcaaggacagcctggacatcccggtccccgaggatggccaggacctaaagggagtaagggggctgagggtcctaaaggcaagcagggaaaggccggagcgcctgggaggcgtggtgtacaggggctgcaaggcctccccggacctcgtggcgtagtggggcgacagggcctggagggaatagccggacccgacggcctgcccggacgggacggccaagccggtcagcagggcgagcagggcgatgatggggatcctggtccgatgggccctgctggcaaacgaggaaacccaggtgtggcagggcttcctggggctcagggacctcctggatttaagggcgaaagcggactcccaggacagctcggtcctcccggaaagcgtggcaccgaaggtagaactggcctcccagggaaccagggagagccgggatctaagggccagcctggcgatagcggagagatgggattcccagggatggccggactctttgggccaaagggcccacccggtgacattggctttaagggcatccaaggacccagggggccaccaggactcatggggaaggagggaatcgtgggaccactgggcatactcgggccaagcggactccctggacctaaaggagataaggggtcaaggggagattgggggttgcagggtcccagaggcccaccaggccctcgcggacggccaggtccccctggcccacctggcggacctattcagctgcagcaggacgacctcggagctgccttccagacctggatggatacttcaggtgctctgcgccctgagagttattcttatcctgaccgcctggtccttgatcagggcggtgagatatttaagacactacactatttgtccaatttgattcagtctattaagactcctctcgggacaaaggaaaaccctgctcgggtgtgcagagacctaatggactgtgaacagaagatggtggacgggacttattgggtcgaccccaacttagggtgctcttccgatactatcgaggtgtcttgcaatttcacgcacggcggtcagacctgccttaaacccataactgcatcgaaggtggaatttgctattagccgagtacagatgaactttcttcatcttctgagcagcgaggtgacccagcacatcacgatccactgcctcaacatgacagtatggcaagagggaaccggccaaacaccagccaaacaggccgtcagattcagggcttggaacggacagatcttcgaggctggaggccagttccggcctgaggtgtctatggacggttgtaaggtccaggacggcagatggcaccaaaccttattcacatttcgcacgcaggatcctcagcagctacccatcatatctgttgacaatctccccccagcgtcatctggtaaacagtacaggctggaggtgggccctgcttgttttctcta

SEQ ID NO: 4846 - DNA, 5603 bp, Artificial Sequence
  Description of Artificial Sequence: Synthetic coding sequence
atgggggctggctctgccaggggtgccaggggcactgcagcagcagctgccgcacgaggcggtggctttttgttcagctggatcttggtgtcatttgcgtgtcacctagcctccacccagggcgctccagaagacgtagacatcctgcaacgattgggcctgtcttggactaaggccggatctccagccccacctggtgtgattcccttccaatcaggcttcatcttcacacagcgggcacgactgcaggcacccactgggacagtgataccggctgccctgggaacagagctggctttagtccttagtttatgcagtcaccgcgtgaatcacgcttttttatttgcggtccggagccagaagcggaagctgcaacttggcctgcagttcttgccaggcaagaccgtagtgcacttgggttcacgtcggagtgtggcttttgatctggacatgcatgacggcaggtggcatcatctggctttagaattacggggacgaacagtgactctcgttaccgcatgcggacaaaggcgagtgcccgttctgctgccgttccacagagaccccgctttggaccccggaggctctttcctgttcgggaaaatgaaccctcacgccgtacagttcgagggggcactgtgccaatttagcatttacccggtaacccaggtcgcacataattattgcacgcatctgagaaaacagtgtggccaggctgatacgtatcagtccccactcgggccattattctctcaggactcagggcgtcctttcacctttcagtccgacctggctctcttggggctcgagaatctgactactgccacaccagctctgggcagtttgccagccggtcgcggaccaaggggaaccgtcgctcctgctactcctaccaagccacagagaactagccctacaaatccacaccagcatatggccgtcggcggtcctgctcagacaccattgctcccagccaagctgtctgccagtaacgctctggacccaatgcttcccgcatcagtcgggggttctacgaggactcccagacccgctgcggctcaaccatcacagaagataaccgcaacaaaaattccaaagtctttgcctaccaagccatctgccccatctacctctattgttcccataaagtctcctcatccaactcagaagacagcaccatcatcgtttacgaagagtgctctgccaactcagaagcaggtacccccaacaagtcgccctgtgcccgctagggtcagcaggccagccgagaagcctatacagaggaatcccggaatgccccgtccaccgcctccaagtactcgacctctgccgccaactacctcatccagcaaaaagccaattccaacattggcacgcaccgaggcaaagattacatcccacgctagtaaacctgctagtgccagaacgagcacacataagccccctccattcactgctctgagtagtagtccagcccctacaccgggaagcacccgatccactcgcccacccgctacaatggtgccgccaacgtccgggacttctacaccacggacggctcctgccgtgcccactccagggtctgcgcctaccggaagcaagaagcctatcggctccgaggcaagcaagaaggcaggaccaaagtcctcccccaggaaaccagtccctctgaggccagggaaggccgcaagagacgtgccactgagcgacctgaccactcggccttcaccgagacagccccaaccatcccagcaaactacacccgctctcgtgctggcaccagcacaatttctgtcctccagccctcggcctacctcttccgggtacagcatatttcatctcgccggttcaactccatttcctttgctgatgggccctccagggcctaagggcgactgcgggctcccgggtcctccaggactccccggtttacccggaataccgggtgcgagggggccacggggaccaccgggtccctatggcaaccccggacttcccggacctcctggggcaaaggggcagaaaggggatccagggttgtctccgggaaaagcacacgacggtgccaagggcgacatgggcctgccagggctgtccgggaaccctggccctcccggtcggaagggccataagggttacccagggccagccggtcacccaggcgaacaggggcagcctgggcctgaaggaagccccggagctaagggctacccaggacgacagggcctgcctggacccgttggggatccagggccaaagggctcccgcggttacattggtctgcccggattgttcggactgcccggatccgacggtgagaggggcctccccggagtccccggaaaacggggaaaaatgggcatgcccggtttcccaggtgtctttggcgaacggggaccccctggcctggacggcaacccaggtgaactgggactccctggcccacctggcgttcctgggcttatcggagacttaggcgtgctagggccaatcggttatccgggaccaaagggcatgaaagggctgatgggcagcgttggagaacctggcctgaaaggcgacaagggagagcaaggcgttcctggagtatcgggagatcctggctttcagggggataaaggcagccagggcttgccaggcttccctggagctaggggaaagccaggtcccctgggcaaggttggggataagggatcaattggattcccaggacctcctggccctgaaggcttccccggagacattggccctccaggagacaacggacctgagggcatgaaaggcaagcctggcgcacggggtctgcctggacctagaggacagttgggtccagagggggacgaaggcccaatgggaccccctggcgctcctggactagaaggacagccaggaaggaagggctttccaggacgtcccggacttgatggcgttaaaggcgagcccggagatcctggcagacccggacccgtcggagagcagggcttcatgggatttatcggattagtgggagagccaggaattgtcggagagaagggtgaccgcggaatgatggggccaccaggagtccctgggccaaaaggaagcatgggacaccccggaatgcctgggggaatgggcacaccaggtgaacctggtccccagggtcctccaggctcccggggacctccgggaatgcgaggcgcaaaaggacgacgcggaccacgaggccctgacggaccggcaggcgagcagggctcccgcggattgaaagggccaccaggacctcagggtagacccggaagaccaggccagcagggcgtggctggtgagaggggccatctaggatcgcgaggctttccaggtatccccggaccctctgggcctcccggaactaaagggctgcccggtgagccgggtccccagggacctcaaggcccaataggaccacccggtgaaatgggcccaaagggacccccaggggcagtgggagagccgggtctgcccggtgaagctggcatgaaaggcgaccttgggccactgggaaccccaggagaacagggcctgatcgggcagaggggtgaacccggtttagagggcgactcagggcctatgggcccagacggactgaaaggcgatagaggcgatcctggcccagatggtgaacacggagagaagggtcaggagggactcatgggcgaggatggcccacccggtcctcctggggttaccggtgtgaggggtcctgaaggcaaatccggaaagcagggagaaaagggaagaactggggcaaagggggcaaaaggttatcaaggacagctcggcgaaatgggggtgcccggagatccgggacctcccggaactcccggtcccaagggtagtaggggatctttaggacccacgggggcaccaggaagaatgggagcgcagggcgagcccggtctcgccggatacgatggacacaagggaattgtgggcccattaggtccccctgggccaaaaggggagaagggagagcaaggcgaagacggtaaggcagagggtccccctgggcctcctggggatagaggccctgtgggcgatcggggagatcggggtgaacctggcgaccccggatatccagggcaagaaggggtgcaggggctgcgcggtaaacctggacaacaaggtcagccgggacaccctggccctcgaggttggccgggtcccaaaggttctaagggcgctgaaggacccaaaggtaagcagggcaaggcaggcgctccaggcagacgcggagtgcaaggactacagggactgccagggccacggggtgtggtgggccgtcagggactggagggtatagcaggtcccgatggactacctggtcgcgatggccaggctgggcagcaaggggagcagggcgatgacggagatcctggccctatgggaccggctggcaagcggggaaaccccggagtcgccggactgccaggggcacagggccctcccggatttaagggtgaatccgggcttcctgggcagctgggccctccagggaagcgaggcaccgaaggacgcaccggactgccaggcaaccagggtgagccagggagtaaggggcagccaggcgattccggagagatgggatttccaggtatggcaggcttgttcggacccaaaggaccgcctggggacattggttttaaaggtatacagggccctcgaggccctcccggtctcatgggaaaagaaggcatcgtcgggccactgggaatcctgggccctagcgggctgccaggcccaaaaggtgacaaggggtcaaggggtgactggggcctacagggccctcgcggtccacctggaccacggggtagacccggacccccagtggaccctggcggtccaaggtacatcccatgcctttttttggcacagcaacaggatgatctcggcgcagcgttccagacatggatggacacaagcggcgctttacggccagagtcatactcatatcctgaccggctggtgctcgaccaaggaggcgagatattcaaaacactgcactatctatcaaatctgatacagtctataaagaccccactgggcactaaagaaaacccagctcgtgtgtgtcgggacttaatggattgcgaacagaaaatggtcgacggaacctactgggtggacccgaatctcggttgctcgtctgacacaatcgaggtgagttgtaatttcacccacgggggtcaaacctgcctgaaaccaatcaccgcatcgaaagtggaattcgccatctcccgagttcagatgaacttcttgcacttgctgagcagtgaagttacccaacatatcaccattcattgtctgaatatgacagtgtggcaggagggtaccgggcaaacgcctgcaaagcaagctgttcgcttcagagcctggaacggtcaaatcttcgaagccggagggcagttcaggccggaggtatcaatggatgggtgtaaagtgcaggacggtagatggcaccaaaccttatttaccttccggactcaagatccccagcagctgcccataatttctgtcgacaacctgccgccagcctcgtctggcaaacaatataggctggaggtcgggccagcgtgttttcttta

SEQ ID NO: 4847 - DNA, 2145 bp, Artificial Sequence
  Description of Artificial Sequence: Synthetic coding sequence
ctgtcatggactaaagcgggaagtcctgcgcctccaggagtgatcccatttcagtctggatttattttcacacagcgggctagactgcaggcaccgactggtactgttattcccgcagccctcggcacagagctcgctctggtgttatccctttgctcccatcgagtgaatcatgccttcctttttgcagtgcggagtcagaagagaaaactgcagcttggactgcaattcttaccaggcaaaaccgtggttcacctaggcagcaggcgcagcgtggcgttcgatttggatatgcatgacggacgttggcatcatctggcccttgagcttagaggtagaacagtcacgttggtcacagcttgtggtcagagacgcgtccccgttctgctgccttttcacagggatcccgcactggatcctggtggtagtttcctgttcgggaagatgaaccctcacgccgttcagttcgaaggcgcactctgtcagttttctatctaccccgttacacaagttgcccacaattattgcacccatttgcggaagcaatgtggccaagctgacacgtaccaatcccctcttggacccctcttttcgcaagacagcggtcgtccatttaccttccaaagcgacctcgcactacttggactggaaaatctgaccacagccactcctgccctggggagtcttcccgctggtagggggcctcgtggaaccgtggccccagcaaccccaactaagccccagcgcacaagccccacaaaccctcatcaacatatggctgttgggggtccagcccaaacaccactgcttcctgccaagctgtccgcctcaaacgcccttgaccccatgttgccagccagcgtgggcggtagtacccgcacccctcgccctgcagcagcccagccttcccaaaaaataaccgccacaaagatccctaagagtctgcccacaaagccctcagccccatcaacctccatcgtgcccatcaagagtcctcaccccactcagaaaactgcaccgagtagtttcacgaaatctgcgctgccaacacagaagcaggtgccacccacctctcggcctgtgcccgctagagtgtccaggcctgcagaaaagccaattcagcggaatccgggaatgccacgtccaccaccgcctagcactagacctcttccacctacaactagcagttctaagaagccgatacctactctggctaggactgaggcaaagattactagtcacgccagtaagcccgcttcagcgcgtacatccactcataaaccacctccgttcactgccctctccagttcccctgctcccaccccaggcagcactcgttcaactaggccccctgccacaatggtgccgccaacaagcggcacctcgacacctcggacagccccagctgtgccaacccccggaagcgcccctacggggagcaagaaacccattggaagtgaagctagcaaaaaggctggtcccaaatcatccccacggaagcccgtccctctgaggccaggaaaggccgcacgggacgtgcctcttagcgatcttacaacaaggcccagcccgaggcagccacagccctcccaacagacaacccccgcattagtgcttgcacccgcacaattcctgtccagctcacccagaccgactagcagcggatatagtatattccacttggcaggatccacaccttttcctctgctgatggggccaccagggccaaagggtgactgcgggctcccagggccaccagggctacccggtctgccaggcatcccaggcgctagagggcctaggggcccaccaggaccctatggtaatcccggactccctggccctcctggggcaaagggggacatgggcctacccggactaagcggaaatcctgggccacccggacgcaagggtttgcccggaccagtgggtgaccccggtcccaagggcagtagaggctatataggcttgcctggcctgttcggtctacctggctccgatggcgaaagagggcttcccggagtgcctggaaagcgcggtaaaatgggtatgccagtcctgctcccccagtcatccgaggcccgtggtggtaacagcatgccttctgaaggtgctcttgccggacggcatggtagccatctctag

SEQ ID NO: 4848 - DNA, 2142 bp, Artificial Sequence
  Description of Artificial Sequence: Synthetic coding sequence
atgtggaatcggtacttcgtcttctacctgctcttgttgtctgcattcactagccagactgtatccggccagagaaaaaagggtccaaaatcaaacctattagccaggaagagcgatgtgcagggttccatctgcttcattgacatcgtcttcatcgtagatagctcggagtctagtaagatagcgctattcgacaagcagaaggactttgtggatagcctgtccgacaagatcttccaactaactcccggaaggagccttgaatacgacatcaagctcgccgctctccagttcagcagctcagtccagatcgatccccctttctcttcgtggaaggacctgcagacattcaagcaaaaggtcaaaagcatgaatttaatcggacagggtacattctcctattacgccatctctaatgccacccgtctactgaagcgtgaagggagaaaggacggagtgaaggttgtgcttctgatgacagacgggatcgatcaccccaagaaccctgatgtccagagtatatccgaggacgcgagaatatcaggcatttctttcatcacgatcgcactgtcgacagtggtgaatgaggcaaagctgaggctcattagtggcgacagcagtagtgaacctaccttgctcctgtctgaccctaccctggtggataaaattcaggataggctcgagatgctcttcgagattcagtgtgagcgcaagatctgcgaatgcgagaaaggagatccgggtgatcccggtccacctgggacccacggcaacccaggcatcaaaggagagcgtgggccaaaaggcaaccctgggaacgcccagaagggagaagcaggcgaaaggggtcctggagggattccgggatacaagggtgacaaaggcgaacgcggagagtgcgggaagcccggtatcaagggcgataaaggttccccgggaccatacggcccaaaggggccacgcggaatacaggggatcactgggcctccaggtgatcctgggcctaaaggctttcagggaaacaagggggaacctggccctcctggcccatacgggagtccaggagcgccaggcatcgggcagcagggcattaagggggagcgtggccaggaaggtagacctggcgctcctgggcctatcggcgtcggtgagcccggtcagcccggaccgaggggcccagaaggcgtgcccggagagcgtggactgccgggagaggggttccccggtcccaaaggagagaaggggtctgagggacctacagggccacagggactgcagggcctgtccatcaaaggtgaaaagggggacattgggcctgttgggcctcaaggcccaatggggattcctggcattgggtcacagggtgagcaaggcattcaaggcccaatcggcccaccagggcctcagggcccagctggacaaggcctgcccggaagtaaaggcgaagtcgggcagatgggccctaccggaccacgcggacccgtgggaattggtgtgcaaggcccaaagggcgaacctggctctatcgggctgcccggacaacccggagtacccggagaggacggtgctgctggtaagaaaggggaagctggccttccaggcgcacggggtcctgagggcccaccaggcaagggacagccagggcctaaaggagacgagggcaaaaaaggaagcaaagggaatcagggccaacggggactcccaggtcctgaggggccaaaaggagagccaggaatcatggggcctttcggcatgccaggcacttccattccaggaccaccaggcccaaaaggggaccggggtggtcccggtatacctggctttaaaggggaacccggtcttagcattagggggccaaagggggtccaaggacccaggggcccagtaggcgctcctggcctaaagggtgacggatacccaggagtccccggtccccgtggattgccgggaccgccaggcccaatggggttgcggggagtcggggatacaggagctaaaactctgaacacatcccatgggcttgaagacccaagctgcccagactgctcgttttgtcatttctctctggccgctgacatccaacctaagtggccagccctattacaacttatcccagctagtgggaccaggcaggacggctag

SEQ ID NO: 4849 - DNA, 3378 bp, Artificial Sequence
  Description of Artificial Sequence: Synthetic coding sequence
atgtggaacagatatttcgttttttacttgctgttactgtccgcatttacttcccagacagttagcgggcagcggaaaaaaggtccgaagtccaaccttctggccagaaaatcggacgtgcaggggagtatctgttttatcgatattgttttcatagtggatagctcagaatctagtaaaatcgcccttttcgataaacaaaaggatttcgtggattccctctcagacaagatcttccagctgactcccggtcgttctctcgaatatgacatcaagttggcagccctgcaattctcctcgtccgtacagatagacccacccttttcctcgtggaaggacttacagaccttcaagcagaaggtaaagagtatgaatctgatcggccagggtaccttttcgtactatgccatttctaatgccaccagactgctgaagagagaagggagaaaggatggggtcaaggtggtgctgctgatgacggatggcattgatcaccctaaaaacccggacgtccagagcatctctgaggacgccagaatctccggaatcagtttcattacaatcgccttatctactgttgtaaacgaagctaagctaagactcattagtggggatagctccagtgagccaaccttgttactcagcgatcccactctggtggacaaaattcaggataggctggacatcctcttcgagaagaagtgcgagagaaaaatttgcgagtgtgagaagggcgatcccggtgatccagggcctcctggaacacacgggaatcccggaattaaaggcgagcgcggtcccaaaggcaaccctggaaacgcacaaaagggagaggcgggtgagcgagggcctggtgggatacctggatataaaggagataagggagagagaggcgagtgtggcaagcctgggatcaaaggagacaagggctctcccggtccctatgggcctaaaggccctcgcggtattcagggcataacaggcccacctggcgaccctggtcctaagggcttccagggtaacaagggggaaccaggtccccctggaccttacggtagccccggagccccaggcatcggacagcaagggatcaagggcgaacgcggtcaggagggacgcccaggcgcacccggacccattggggtgggcgagccaggacaaccaggtcctagaggcccagagggggtcccaggagaacgcggtttgcctggggagggctttcccggacccaaaggggagaaaggctcagagggaccaacagggccacagggcctgcaagggctatctattaaaggagaaaaaggagacattggtccagtggggccacaggggcctatgggcatccccggtatcgggagtcagggcgagcagggaatccagggccctatcggccctccgggaccacagggtccggctggacagggactccccggtagcaaaggtgaagtgggtcaaatgggaccaaccggtccccgtggtcctgttggcatcggcgtccaagggccaaaaggagagccagggtcaattgggcttccaggacagccaggagtccctggagaggacggggcagcaggtaagaagggggaagccggacttcccggagcgagaggtccggaggggccacccggaaagggccagcccggaccgaaaggggacgagggtaagaagggcagcaaggggaatcaggggcagagggggctgcctgggcctgaaggccctaagggggagccgggtattatgggcccttttggaatgccgggaactagtatccctggccctcccggacctaagggtgaccgtggagggccagggattcctggctttaagggggaacccggactatcaatccggggtccaaagggcgtgcagggaccaagaggaccagttggcgctccgggtctgaagggggacggctatccaggagtacccggtccccgtggcctgccagggcctccaggccctatgggactgcggggtgtcggagacactggagcaaaaggggaaccaggcgttaggggccctcccggacctagtggcccacgtggggtagggacccaaggaccaaagggagacaccggccaaaagggccttccaggccctcctggtcccccaggatacgggtcccaggggattaagggggaacaggggccacagggctttccaggcccaaagggcacaatgggtcacggacttcccggtcagaagggcgaacacggggaacgcggagatgtggggaagaagggcgataagggcgaaatcggtgaacctggttctcctggcaagcagggcctccaaggcccaaagggcgatctcggtctcaccaaggaggagattataaagcttatcaccgagatctgtgggtgtggtccaaaatgtaaggagacgcctttagagttggttttcgtcatagactctagcgagagcgttggccctgagaattttcagatcatcaaaaattttgtgaaaacgatggctgatagggttgcactggatcttgctactgccaggatcggcatcataaattacagtcacaaggtcgaaaaggtagctaacctaaagcaattttccagcaaggatgacttcaagctcgcggtggacaatatgcagtacctgggtgagggaacttataccgcgactgccctgcaggctgcaaacgacatgttcgaagatgctaggcccggagtgaaaaaggtggcgctggtgatcaccgatggacagacagattcccgcgacaaggagaaattaactgaagtcgtgaaaaacgcctcagatactaatgtcgagattttcgtcattggcgtcgtaaaaaagaacgaccccaacttcgaaatcttccacaaagagatgaacctcattgcaacagatccagagcatgtctaccagttcgatgacttttttactctgcaagacacgctgaagcagaagctttttcagaagatttgcgaagactttgacagttatcttgtccagatcttcgggtcgtcctctccccagccagggtttggcatgtccggagaggaactctccgagtccactccagagccacagaaggagatcagcgagtctctgagtgttacaagggaccaagacgaagacgacaaggcgcctgagccaacatgggctgacgatttgcccgcaacaactagttctgaggcaactaccacccctcgaccactgctgtccactccggtggacggcgctgaggaccctagatgcctggaagctctcaagccaggaaactgcggtgaatacgtagttaggtggtattacgacaaacaggtaaacagttgcgcccgattttggttttccggttgcaacggtagcggtaatagattcaacagtgaaaaagagtgccaagagacgtgcatccagggatag

SEQ ID NO: 4850 - DNA, 1005 bp, Artificial Sequence
  Description of Artificial Sequence: Synthetic coding sequence
atgtggaataggtactttgtattctatctgctcctactttccgccttcaccagccagacagttagtgggcagcggaagaaggggcctaagagcaacctgctggcacggaaaagtgatgtccaggggtctatttgctttattgatatcgtgttcattgtggattcatcagagagcagcaaaatcgcactgttcgataaacaaaaagattttgtggattcgctttcagacaaaatcttccagctgaccccgggtaggagtcttgaatatgatatcaagctggcagcactccagttttctagtagtgttcagatcgaccctccattttctagttggaaggatctgcagacctttaagcagaaggtgaaatccatgaatctgattggacagggaaccttcagctattacgcaatctcgaacgctactcggttgctcaagcgtgagggccgaaaggacggcgtcaaggtggttctcctaatgaccgacggaatcgatcacccaaaaaacccagatgtgcagagcatatctgaagacgcccgaataagcggcattagtttcatcaccatagctttgagtaccgtggtgaacgaagccaagctgagactaatatctggcgacagcagctctgagcctactcttctgctctctgacccaacattagtggacaagattcaggaccggctcgaaatgctctttgaaatccagtgtgaaaggaagatttgtgagtgcgaaaagggtgatccgggagaccccggacctcctggaactcatggcaatcctggaatcaagggagagcggggtcccaaagggaacccagggaacgcccaaaagggcgaggctggcgagcgcggtcccggagggattccaggctacaagggcgataaacagtacagccgcgaagaccgcgaagtggaacataataacgaaaagtacgtagcctgccttcttccgtcccctgccctcctgcagcagtcctcattaactcaccacgggacatgctctcactag

SEQ ID NO: 4851 - DNA, 243 bp, Artificial Sequence
  Description of Artificial Sequence: Synthetic coding sequence
gccaccacctctagtgaggcgactaccacaccacgcccactcctcagcactccggtggatggagctgaggaccccaggtgcctagaagcgctcaagcccggtaactgcggggagtacgtggtgcggtggtactatgacaaacaagtgaactcatgtgcccgattctggtttagcggatgcaatggttcggggaatcgattcaactctgagaaggagtgtcaggaaacatgtatacagggctag

SEQ ID NO: 4852 - DNA, 1587 bp, Artificial Sequence
  Description of Artificial Sequence: Synthetic coding sequence
atgggcagtagtagggctccttggatgggaagagtagggggtcacgggatgttggctttactcctggcagggctgttgctgccaggcaccctggccaaaagcatcggaacattctccgatccctgtaaagaccctacgcggattaccagccctaatgatccctgcctcaccggaaagggagatagtagcgggttttcttcgtattcagggtcatcctcttctggatcgtcgatctccagcgcccgatcctcagggggtggttcttctgggtcaagctccggtagctccatagcccagggtgggagtgctggatcttttaaacccggtaccgggtatagtcaggtcagctactcaagtggcagtggctcttctctgcagggggcaagcggtagcagccaactaggcagtagctcttcgcacagcgggagctctggttctcacagtggctcttcttcccacagtagctcttctagcagcttccagttttcaagcagtagctttcaggtgggaaacggttccgcgctccccacgaatgataactcgtatcggggaatattgaatcctagccaaccaggtcaaagttcaagcagtagccaaaccttcggagtatcttcaagcggccagagtgtctcgagcaaccagaggccttgtagtagcgatatccctgactccccatgttccgggggaccgatcgtgtcacattctggtccgtacataccgtctagtcattccgtgtcaggtggccaacgcccagttgttgtcgtggtggaccagcatgggtcaggggcacctggcgtggtacagggtccgccttgtagtaacggcggtttacccggaaagccatgtccacccattaccagcgtggacaaatcttacggcggttacgaggtggtcggcggatcaagcgactcgtacttggtaccagggatgacctatagcaaagggaagatttatcctgtggggtactttaccaaagagaacccagtaaaaggatcccccggtgtaccctccttcgctgccggaccacccatctccgagggaaaatacttctcttcgaatccgatcatccccagccagtctgccgcaagtagcgctatcgctttccagcctgtcggcactggtggagtgcagttatgcgggggaggatctaccggcagcaagggaccctgctccccttcatcttcgagggtgccaagctctagcagtatctcctccagcagcgggttgccctaccacccttgtgggagcgcgagccaaagtccttgctctccccctggcaccgggtcattttcgtcttccagctcctctcagtcctctggcaaaattatcttgcagccttgcggcagcaagagcagctcctccggtcatccgtgcatgtcagtctcttcactcactttgaccggaggacccgacggatctccccatcccgacccatctgcaggggctaagccctgcggaagcagctccgccggtaaaataccctgcagatccattcgcgatattctcgcacaggttaaacccttgggaccacagctcgccgatcctgaagtgttcctgccacagggcgagctcctcgattcgccttag

SEQ ID NO: 4853 - DNA, 1590 bp, Artificial Sequence
  Description of Artificial Sequence: Synthetic coding sequence
atgggatcatcaagggcaccttggatgggacgggtcggaggccacggcatgatggctctcctccttgctgggctgctactgcccggtaccctcgccaagtccattggcaccttttctgacccttgtaaggaccccactcggatcacctccccaaatgatccatgtttgactggaaagggcgactcctccggttttagctcctactctggttctagttcaagcggttcgtctattagttcagcccgatcaagcggaggcggttccagtgggtcatctagtgggtcatcaattgcgcagggtggcagcgccggatcctttaagccaggaacaggttattcccaagtatcgtatagcagcggtagcggctcttctctccagggcgctagcggatcttctcagctgggttctagctcctcccacagcgggaatagcggttcccactcaggctctagttcatcccactcatccagctctagcagttttcagttttcttcctcaagcttccaggttggtaacgggtccgctcttccgaccaatgacaacagctaccgcggtattctcaaccctagtcagccgggacagtcctccagcagttcacagacattcggcgtgtcaagctccggacagagcgtgagctctaaccagcgaccatgtagtagcgatatccctgattccccctgttccggcggtcctattgtctcccactccggtccttatattccctcttcccattctgttagcggcggtcagagaccagttgtagtggtggtagatcagcacggttctggcgcacccggagtggtgcaaggcccaccctgcagtaatggaggattgccagggaagccatgcccacccataacttctgtcgacaaaagttatgggggttacgaggtggttgggggttcatcagactcctatctggtacctggcatgacatacagtaaggggaagatctaccccgtgggctactttaccaaggagaatcctgtgaagggatcacccggagtgccctccttcgctgccggaccccctatctcagagggtaagtacttcagctcaaatccgataattccttcccagtctgccgcttcgagcgctattgcctttcaaccagtaggaactggcggtgtccaattgtgtgggggaggctcaacgggctctaagggcccttgctcaccatctagcagtcgagtacccagttcatcaagcatttccagcagttcaggcttgccgtaccacccctgcggatccgccagtcagagcccctgctcgcccccaggtacaggcagcttctccagctctagcagcagccagtcctccgggaagatcatcttgcagccttgtggtagcaagtcaagttcttcaggacacccctgcatgtccgtcagcagtctgacactgaccgggggtccggatggctcccctcaccccgacccctctgctggtgccaagccatgcggcagttcctctgcaggcaaaattccatgtcggagtatccgggacattctagcacaggtgaaaccactaggcccacaactcgcagacccggaggtatttttgcctcagggggaattgctgaattcgccgtag

SEQ ID NO: 4854 - DNA, 1590 bp, Artificial Sequence
  Description of Artificial Sequence: Synthetic coding sequence
atggggagctcccgcgcaccatggatgggccgagtgggagggcatggaatgatggcgttactgctcgccggtctcctcctgccaggcactttagcaaagtctattggcacttttagtgatccatgtaaagatcccacaaggattacttcccctaatgacccatgcctgaccggcaagggggactcctcagggttctcttcttactcaggttcttcatcctctggtagttctatcagcagtgccaggagctccgggggaggaagctcaggcagctcgtcaggatcttctatcgctcaaggtgggagtgcaggttctttcaagcccggaaccggttactctcaagtgtcttactctagtgggtccggatcaagtctgcaaggggcttccggctcatcccaacttggatcctcctcctcacactccgggtcctccggctcacattccgggtcaagctctagccacagttccagcagttcgtcctttcagttttcaagctctagctttcaggtgggcaatggtagtgcgctcccaacaaacgacaactcctacaggggtatcctgaatccgtcccagcccggacaaagcagctcttcgtcccagaccttcggcgtaagttctagcggccagagcgtctcctcaaatcagcgtccttgctctagtgatattcccgacagtccatgctccggaggaccgatcgtgtcccactccggcccatacattcctagcagtcattctgtgagcggcggacaacgaccggtagtggtggtggtcgatcaacacgggagcggcgcacctggcgtggtgcagggaccaccttgtagtaatggcggacttccgggaaagccatgtcccccaattacttcggtggacaaatcctatgggggttacgaggtggtgggagggagcagcgactcctatctagtgccgggtatgacctactcaaaaggcaagatataccccgtcggatatttcacgaaggaaaatccagtgaaaggaagcccaggggtcccaagctttgcggcaggccctcccatctcagaaggcaagtacttctccagtaatcccatcattcccagccagagcgctgcctcaagtgccattgcctttcagcccgtcggcactggaggcgttcagctgtgtggaggcggttccaccggttcaaaaggcccttgctcacccagtagcagcagggtaccaagcagcagtagcatatcgtccagcgcaggatcaccctatcacccctgcgggtcagccagtcagagcccgtgttcccctcctgggactggatcgttttcaagtagctcttcttcacagtcttccgggaagattatcttgcagccttgcgggtctaagtcgtccagctcaggacatccctgtatgagcgtcagcagtctgacgcttacgggaggcccagatggctctccgcacccagacccgagtgccggagcgaagccctgcggatcatctagcgctggcaaaatcccctgccgatcaatccgggacatccttgcccaagtcaaacccctgggcccacagctcgcagacccagaggtctttctccctcaaggcgaactcctggacagcccctag

SEQ ID NO: 4855 - DNA, 1590 bp, Artificial Sequence
  Description of Artificial Sequence: Synthetic coding sequence
atgggaagcagccgggcaccctggatgggcagagtgggaggccatggtatgatggctctgctccttgctggcctcttattgcctggtacactggcaaagagcatcgggacatttagcgacccttgcaaggaccccacccgaatcacctctccgaatgacccctgccttactggaaagggcgattccagtggcttttctagttactccggctcgtcgagttctggctcatctatctcatcagcgagaagttcaggtggaggtagctcaggctctagtagcggctccagcatcgcccagggcggatctgccggatctttcaaaccgggtaccggatattcccaagtctcatatagctctggtagcggcagcagtttgcagggggcatccggcagcagccaactcggtagttcctcatcccacagtggaagctcagggagtcattcagggtcctcctcttctcatagctcctctagcagcagctttcagtttagcagctccagctttcaagtcggtaacgggtccgccctccccacaaacgataactcctaccgcggaatactcaacccctcccaacccggacaatcttctagctcgtctcagacattcggcgtaagcagctctggtcagagtgttagctcaaaccaacggccatgcagttcagatatccctgactctccctgctccggaggtcccatcgtgtctcacagcggcccatatattccttcaagccatagcgttagcggagggcagaggccagttgtggtcgtcgtcgaccaacacggatccggcgctcctggggtggtgcagggtcctccttgcagtaacgggggtctgcctggtaagccctgcccccctattacctccgtggacaaatcgtatggaggatatgaagtagtcggcggtagttcagactcttacctggtgcccggaatgacttatagcaaaggtaaaatttatcctgtaggatactttactaaggagaatcctgtgaaaggctccccaggcgttcccagcttcgctgctggcccacccatctccgaaggaaagtactttagctcgaacccaattatcccgtcacagagcgccgcaagctccgccatcgcgtttcagcctgttggaaccgggggagtgcaactctgtggcggtggaagcaccggttccaaaggcccttgctccccaagtagcagtcgcgtacctagtagctcttctatctcttcttcatctggatccccttatcatccctgtggaagcgccagccagtcgccctgttccccaccgggtacaggatccttcagcagcagctcatctagccagagctctgggaaaatcattctacagccttgtggatccaaaagctcgagcagcgggcatccctgtatgtcagtaagctccctgacgctcacgggcggaccagatggctctccccacccagaccctagtgccggagccaagccctgcggatcctccagtgcagggaaaataccatgcagatctatccgtgatattctggcccaggttaagcccctcgggccacagttagccgatcctgaggtattcttgccacagggtgagctcctcgatagcccctag

SEQ ID NO: 4856 - DNA, 1590 bp, Artificial Sequence
  Description of Artificial Sequence: Synthetic coding sequence
atgggatcttctcgcgcaccttggatgggacgcgtcgggggacacgggatgatggcactcctccttgcaggactcctattacctggtacactagcaaaaagcataggtactttctcagatccttgtaaggatccaacccggattacatcacccaacgacccttgcttgaccggcaaaggagactcctctgggttctctagctactctggcagtagctcatccgggagcagcattagtagtgcacgctccagtgggggtggctcaagtgggtctagttctggctcaagtattgctcaaggagggagtgcaggaagcttcaagcccggtaccggttactcccaggtctcctactcatcaggctccggctcatctctgcagggtgcaagtgggtcttcacaactcggctccagcagttctcattcgggtagcagtggaagccacagcggttctagtagcagccactccagctcttcttccagtttccagttcagttcgtcctcctttcaggtggggaatggctcggcgttgccgactaacgataactcctatcgtgggatactgaatccctctcaacccggtcagagctctagcagcagccagaccagcggcgtatccagcagcggtcagagtgtctcatcaaaccagcggccatgcagctccgacataccagattccccatgctccggaggtccaatcgtgtctcactctggaccttacattccatcttcgcactccgttagtggaggccagagacctgtggttgtggtggtggatcagcacggttcgggcgctcctggcgtcgttcaggggccaccttgttcgaatggaggcctgcccggtaaaccctgtcctccaattactagtgtggataagtcatacggaggctatgaggtggtcggcggaagctctgacagctacctcgtcccaggaatgacttatagtaaaggaaagatctatccagttggatactttaccaaagagaaccccgttaaggggtcaccaggggtgccaagcttcgctgcaggcccacctatctccgagggaaaatacttctcctcaaatccaattatcccaagtcagagcgctgcaagcagcgccatcgcttttcagcctgtcggaactggtggtgtgcaattatgtggaggcggtagcaccggctctaagggcccatgttcgccaagttcgtcacgagtcccttcctcctctagcatcagttcaagctcaggcagcccatatcacccatgtggatctgcgtcacagtctccttgctctcctccgggaactgggagcttctcctcatcgtctagctcacagtcttcaggtaagatcattctgcagccatgtggcagtaaatcttcatctagtggacacccttgcatgtctgtcagctccctgaccttgacaggaggcccagatggatctcctcacccagatccaagtgccggtgctaagccctgcggttcaagtagcgctggtaagattccatgtcgcagtattcgcgacattctcgcccaagttaaaccgctgggcccacagctagccgaccccgaagtgttcctgccccagggggagctgctcgattcaccctag

SEQ ID NO: 4857 - DNA, 1590 bp, Artificial Sequence
  Description of Artificial Sequence: Synthetic coding sequence
atgggatctagtcgagcaccttggatgggtcgcgtcggaggccacggtatgatggctctcctacttgctggcctcctcctgcccggtactctggccaagtccattggcacatttagcgatccgtgcaaagatcctacgcgtattacctccccaaacgatccatgcctgacgggtaagggcgattccagtggcttttctagctactccggctcctcttcatcaggttcctcaatatcgtccgctagaagcagcggtggagggagcagcggctctagcagtggatccagcattgcgcaggggggatcagccggtagttttaaacccggaacaggctattcgcaagtgtcatatagctcgggtagcggcagctcattgcagggggcatctggtagctcacagttgggcagctccagttcacactctgggtcttcaggatctcacagcggctcgagcagctcacacagcagttcgtcctcttcatttcagttcagctcatcttcctttcaagtcggaaatggctcagcgctccctaccaatgacaattcctaccggggaatactgaacccttcccaaccagggcagtcttcttcctcttcccaaacctctggagttagctcctcaggccagtcggtgagcagcaatcagcgtccctgtagcagcgacatcccggactccccctgttcaggcggacccattgtatcccactcgggaccatacataccctctagccatagcgtttcaggaggccagagacccgtggtggttgtggtcgaccagcacggctctggggcacccggagttgtccaggggccaccttgctcgaatggtggtctgcccggaaagccctgtccacccattacaagcgtggataagagctatggcggatatgaggtggtcggtggaagttccgacagctacttagtgccaggcatgacctattccaaaggaaagatttatcccgttggttacttcacaaaagagaatccagtgaagggctcgcccggagtcccatcattcgccgctggcccaccaatttctgagggaaagtacttttccagtaatccgatcatcccaagtcagagtgctgcctcctcggccatcgcgttccagccagtgggaacaggtggcgttcagctttgcggcggaggatcgacaggatcgaagggcccttgctccccaagttcttccagagtcccctccagttctagtattagttcgtcctctgggtcaccctaccatccgtgcgggtccgcctcacagtctccatgtagtcctccgggaacaggatcattctcctcatcctcatcttcccagtcatctggcaagatcattctgcagccctgcgggagcaaatcttcttcgagtggacacccatgcatgagtgtttcttctctgaccttgaccggaggaccagatggatccccccaccccgacccatctgccggtgcaaagccctgtggatcctcttcggctggcaagataccttgcaggagtatcagggacatcttggcacaggtgaaaccattaggcccacagctagccgatcccgaggtattcctgccacagggagagctgctggattcgccttag

SEQ ID NO: 4858 - DNA, 255 bp, Artificial Sequence
  Description of Artificial Sequence: Synthetic coding sequence
gtcctacactcgtttacggatgccattttcgacgagtggatgaaaagatttaatccacctgctgacgcctggccacaagagttggcacccattgggcacaaccggatgtataacatggttccattcttcccgcctgtgaccaatgaggagctgttcctcacaagtgatcaactgggctacagctatgctattgatctgcctgatttccaagctaacttcatctgcagctacctggtgagcgtccaccaggaatag

SEQ ID NO: 4859 - DNA, 1560 bp, Artificial Sequence
  Description of Artificial Sequence: Synthetic coding sequence
atgagcccgctgtggtggggctttttactgtcatgcttgggttgtaagatcttaccaggcgctcaaggccagttccctagagtgtgtatgaccgttgatagtctagtcaataaagaatgttgcccacggctgggtgcagagtctgcaaacgtgtgcggatcgcagcagggcagaggtcagtgcacagaggtcagggcagatactcgaccatggtccggaccctacattttaagaaaccaggatgaccgcgaactgtggcctaggaagttctttcaccgaacctgcaagtgtacgggtaactttgccggatacaattgcggcgactgcaaatttggctggactggccctaactgtgaacgcaagaaaccccctgttatccggcagaacattcacagtctaagcccacaggagcgggagcagtttctgggggcactcgatctggccaaaaaacgggtacaccccgactatgttatcaccacacagcattggctgggcctgttaggtccgaacggaacccagcctcaattcgctaactgttcagtatatgatttttttgtgtggctgcactattacagtgttagagacaccctgctcggcccagggaggccttaccgtgctattgatttttcccatcagggcccagctttcgtcacatggcaccgttaccatctgctctgtttagaacgggacttgcagcgcctgatcggaaacgaatcctttgcactaccttactggaacttcgctactggtcggaacgagtgcgacgtgtgcaccgatcagctttttggcgctgctcggccagacgatccgaccctgatctcgaggaacagccgattttcctcctgggagactgtgtgcgatagcctcgatgactacaaccacctggtaacgctttgcaacggaacgtacgagggccttctgcgcaggaaccagatgggtagaaactcgatgaaattacctactctgaaagatatcagagactgcctgagcttacagaaatttgacaacccccctttcttccaaaactcaacatttagctttcgaaacgccctggagggatttgacaaagccgatggaacattggactcccaagttatgtcactgcacaacctggttcattcatttctgaatggcacgaacgcactaccacactctgccgctaatgacccgatctttgtcgttcttcactcctttaccgatgctatcttcgatgagtggatgaaacggttcaacccaccggctgatgcctggcctcaggaattggccccaatagggcataatcgcatgtacaacatggtgcctttctttccacccgtcaccaacgaagagttgttcttaacctcagaccagctgggatatagctacgctattgacttgcccgtcagcgtggaggaaacccccggatggccaacaactttgcttgtggtcatgggtactctggtggccctcgtaggtctcttcgtcctgctggcctttttgcagtataggcgtctcaggaaaggctatactcccctgatggagacccatctctcttctaaacggtataccgaggaagcgtag

SEQ ID NO: 4860 - DNA, 1659 bp, Artificial Sequence
  Description of Artificial Sequence: Synthetic coding sequence
atgagccccctgtggtggggcttcttgctttcttgcctgggctgcaaaatcctacctggtgcgcagggacagtttcctcgagtgtgcatgaccgtggacagtctggtcaataaggagtgctgtcctcggctcggcgctgagagtgccaacgtctgcggcagtcaacagggtcgcggacagtgcacagaagttcgggctgatacaaggccttggtccggaccttacattttgcgtaatcaagacgatcgggagctttggcctaggaagttcttccatcgtacctgtaagtgtactgggaacttcgcgggttataactgtggcgactgtaagtttggatggacggggccaaactgcgagagaaagaagcctcccgtcattcgccagaacatccactctctctcacctcaggagagagagcaatttttaggggctctggacctcgccaaaaaaagggttcaccccgattacgtaatcacaacccagcactggcttgggttgctggggccaaatggcacccagcctcagtttgccaactgcagtgtatatgattttttcgtttggctgcattattattctgtgagggatacattactcggcccaggcagaccgtaccgagcaatcgattttagtcatcaagggcctgctttcgtgacttggcatcgctatcatctgctgtgtctcgagcgggaccttcagcgcctcatcggcaacgaatccttcgctctcccgtactggaatttcgcaaccgggagaaatgagtgcgacgtttgcacggaccagctttttggagccgctaggcccgacgatccaacgttgattagtcgcaattctcgattctcatcttgggagaccgtttgcgactcgctggatgattacaaccatctagtcaccctctgtaacgggacttatgaaggcctgctgcgcaggaaccagatgggcagaaattccatgaagcttcctactcttaaagatattcgggattgtcttagcctgcagaaatttgataacccgccatttttccagaattccaccttctccttccgcaacgccctagaggggtttgacaaggcagacggcacccttgactcccaggtcatgagcctgcacaatctcgtccatagtttcctcaacggtacaaacgcgctacctcatagtgccgctaacgaccccatttttgttgtgatctctaaccgcctgctctataatgctaccacaaacattctggaacatgtccgtaaagaaaaggcgacaaaggagttgcccagcctccatgtgctggtgctgcactctttcacagacgctatcttcgacgaatggatgaaacgcttcaaccctccagctgatgcttggcctcaggaactagcccctatagggcacaaccggatgtataacatggtgccgttcttccctcctgttaccaacgaggaactgtttttgacaagtgatcagcttggatactcctacgcgatcgatctccccgtgagcgtggaagagacccccggatggcccacaactctgcttgtagtgatgggaactttggttgcactcgtagggctgttcgtgctgctcgcctttctgcagtaccggagattgaggaagggctatacccccttgatggagactcacctgtcctccaagcggtacactgaggaagcatag

SEQ ID NO: 4861 - DNA, 1347 bp, Artificial Sequence
  Description of Artificial Sequence: Synthetic coding sequence
atggcgcacgtgggcgactgtactcagacaccctggttacccgtgctggtcgtatccctaatgtgctcagctagggccgagtacagtaactgcggagagaatgagtactataaccagaccacgggactgtgtcaggaatgccccccatgcggtccgggagaagagccctatctttcatgtggctatggcacaaaagacgaggactacggatgcgtgccttgtccagcggagaagtttagcaaggggggttatcaaatatgtcgtcgccataaggactgcgaaggtttctttcgagccaccgtgctgaccccaggcgacatggagaacgacgccgagtgcggcccttgcttaccaggatattacatgctcgagaaccgacctcggaacatttatgggatggtgtgttattcatgcctgctggcccctccgaacaccaaggagtgtgtgggggcaacaagcggagcttctgccaacttccccggaacatcaggttcatctacactctcccctttccagcacgcccacaaggagctgtccggtcaaggacatcttgccactgctcttattattgcaatgtcgacaatcttcataatggcgattgcaatagtattgatcatcatgttctatatcctgaagacaaagccatctgcccctgcctgctgtacgagccaccccggtaagtcagtcgaagctcaggtgtctaaagacgaggaaaaaaaggaggctccagataatgtcgtaatgtttagtgaaaaggatgagttcgaaaagttgacagcaacccctgctaaacccactaaatctgagaatgacgctagctctgagaacgaacagttgctgtctaggagtgtggatagcgacgaggaacccgcaccagacaagcaggggagccccgagttgtgtctgctatccctggtacacctcgccagggagaagtctgcaacgtcaaacaaaagcgccggaatccagtctcgacgcaagaaaatactggacgtctatgcaaacgtgtgcggtgttgtggaggggctttcacccacagagctgccctttgattgtttggagaagacgtcgagaatgcttagcagtacgtacaattccgaaaaggccgtggtcaagacgtggcgccatttagctgaatcatttggccttaaacgggatgaaattgggggtatgacagatggaatgcagctttttgaccggatatcaacagcaggttatagcatcccagaactgctgactaaactagtgcaaattgaacgtctggatgctgtggaatctttgtgcgctgacattctggagtgggctggcgtggtgcctcccgcatctcagccacatgctgcttcttag

SEQ ID NO: 4862 - DNA, 1443 bp, Artificial Sequence
  Description of Artificial Sequence: Synthetic coding sequence
atggcgcacgtgggagactgcacacagactccttggctcccagtacttgtcgtgtcgctcatgtgttcagcacgggctgaatattctaattgcggagaaaacgaatactacaaccaaacaacagggttatgccaggaatgtcccccatgcgggcctggcgaggaaccctacctgtcctgcgggtatggaacaaaagatgaggactatgggtgcgtgccatgccccgcagaaaagttttcgaaaggcggttatcagatttgccggcgtcataaggactgcgaaggcttttttcgggcaactgttttaactcctggtgacatggagaacgacgcggagtgcgggccatgtttgcccggttactacatgcttgaaaaccggcctcggaatatctatggtatggtttgctactcctgcttgctggcccctcccaacactaaggagtgcgttggggctaccagcggagcctcagccaattttcctggcaccagtggcagtagcactctgtcgccttttcaacacgctcacaaagagttgtcaggacagggtcacctagccaccgcactgatcattgccatgtctacgattttcatcatggccatagcgatcgttctgatcatcatgttctacattctcaagaccaaaccaagtgcacccggagacgggcctcacgccccagtgccctgttttctggactccccctccaccccccctgtgggagaacctggctgttcattgccacctcttagccctgcctgttgcacatcacaccctggaaaatcagtggaagcacaagtctccaaagacgaagaaaaaaaagaggccccagacaacgtcgtgatgttcagcgagaaggatgaatttgaaaagcttacggccactcctgccaagcccacaaagagcgagaacgacgccagttcggagaatgagcaactgttgtcgagatctgtggactccgatgaagaacctgccccagacaagcagggttctcctgagctttgcctgctgtcattagtgcatctcgcacgtgagaagtcagcgacaagcaataagtcggccggtatccaatcacggcgtaaaaagatcttagacgtgtacgctaatgtgtgcggcgtagtggaggggctttcccctaccgagcttccctttgattgtctggagaagacatctcggatgctgtcttcaacttacaacagcgagaaagcggtcgtgaaaacctggagacatcttgccgaatccttcggcctgaagcgcgacgagattggcggaatgaccgacggaatgcagctatttgacaggatctccacggccggatactctattcctgagcttcttactaaattggtgcagatcgaacgcctagatgctgtggaatccctgtgtgccgacatccttgagtgggcaggtgtggtgccgccagcctcccaaccccatgcggcaagctag

SEQ ID NO: 4863 - DNA, 1443 bp, Artificial Sequence
  Description of Artificial Sequence: Synthetic coding sequence
atggcacacgtcggggactgcacacaaaccccttggttacccgtgctggtggtgtcattgatgtgttctgctagagcggaatatagcaattgtggggaaaacgaatattacaaccaaaccaccggcctttgccaggaatgccctccatgtggacctggcgaagaaccttacctgtcatgtggctacgggactaaagacgaggactatggatgtgtgccctgccccgctgagaagttttccaaagggggttatcaaatctgtcgccgtcacaaggattgtgaaggctttttcagggccaccgttctgacgccaggtgatatggaaaacgacgcggaatgcggaccatgtctgccgggatactacatgctggagaatcgtcccaggaacatatatggtatggtgtgttactcttgccttctggctccaccgaacaccaaagagtgcgtgggcgctacgtctggcgcatccgcgaatttccccggaacaagtggatcttcaaccctttccccatttcaacacgcccacaaagagttgtccggtcagggacatctggctactgccttgataattgctatgtctaccatttttatcatggccattgctattgtgctgataatcatgttctacatactcaagaccaaaccaagcgcacccggagacgggcctcacgccccagtaccttgttttctggatagtccctccactcctcctgttggtgagcccggatgtagcctccctcctttgagccccgcatgttgtacgagtcaccctggcaagtctgtggaagcgcaagtgtccaaagacgaagagaagaaagaagcacccgacaatgttgttatgttctccgaaaaggacgagttcgagaagctgactgccactcccgctaaacccactaagtctgagaacgacgcctccagtgagaatgagcagcttctgagtcgctccgtagacagcgacgaagagcctgcccctgataaacaggggtcccctgaactgtgcctgctgtcgttggtacatctggccagagagaaaagcgcaacttccaacaagtccgcgggtatccaaagcaggaggaaaaagatcctggacgtgtatgctaacgtgtgtggtgtcgtagagggcctctcgcctactgaactgcccttcgattgcctggagaagacctcccgtatgttaagctcaacctacaacagtgagaaagctgtcgtaaagacttggagacacctggccgaaagttttggtcttaagcgagacgaaattgggggtatgactgatggaatgcagctgttcgatcgaatttcaaccgccggatactctatccccgaactcctcactaagcttgtacagatcgaacgactggacgctgtggaatccctgtgtgctgacatacttgaatgggccggtgttgtgcccccagcatcgcagcctcatgccgcttcatag

SEQ ID NO: 4864 - DNA, 957 bp, Artificial Sequence
  Description of Artificial Sequence: Synthetic coding sequence
atggactgccaggagaacgaatattgggatcagtggggccgatgcgtgacctgccagagatgcgggccagggcaggagctgagtaaagactgcgggtatggtgagggaggtgatgcctattgcactgcctgtcctcccaggcggtacaaaagttcttggggtcaccaccgctgtcagagttgcatcacttgcgccgtaatcaacagagtgcagaaggtgaactgcactgccacatctaatgcagtctgcggagactgtttaccgagattctacaggaagacccgcattggaggcctgcaggaccaagagtgtatcccatgcaccaaacaaacacccacctcagaagtgcagtgcgccttccagctttccttagtagaggccgacactcccacagttccccctcaggaagccactttagtcgccctcgtgtcgtctttgctggtggttttcacactagccttcttgggactgttctttctctactgcaagcagttttttaatcgccactgccagcgcgagaagttgatcatcttcagtgacccagttcctgcctctctaaacctgattcctgagtttgctggaggcctcctccagttcgaggccgataaaaccgccaaagaggaatcactgttccccgtcccgcctagcaaggaaacttcagcagagagtcaggtgtcggagaatatcttccaaacccagccacttaatcccattctggaggacgactgttcttcaacttccggatttccgacccaggagtcgttcaccatggcttcgtgtacatctgaaagtcactcacactgggttcactcacctattgagtgcacagagctggatctgcagaagttctcatccagtgctagctacactggagctgaaactcttggcggtaacaccgttgaatctacgggagatcggcttgagttaaacgtgccattcgaagtgccctccccctag

SEQ ID NO: 4865 - DNA, 894 bp, Artificial Sequence
  Description of Artificial Sequence: Synthetic coding sequence
atggactgtcaggaaaatgaatactgggaccagtggggtcgatgtgtgacgtgccagagatgtggccctggtcaggaactaagtaaggattgtggatatggcgaaggaggggacgcttactgtactgcctgtccacccagacggtacaaatcctcatggggccaccatcgctgtcagtcttgtattacctgtgccgtgatcaacagagtgcagaaggtaaattgcacagctaccagcaacgccgtctgtggcgattgccttcctcgcttttatcggaaaaccaggattggcggacttcaggatcaagaatgtatcccctgtactaagcagacacccacatccgaggtgcaatgcgctttccagctaagcctcgtcgaagcagacactcccactgttcctccgcaggaggctaccctggtcgccctcgtttcctccctgttagtcgtgtttacactcgccttcctgggcttatttttcctgtattgcaagcaattttttaataggcactgtcagcgtggtggccttctgcagttcgaggctgacaagaccgccaaggaggagagcctgttccctgtccctcccagcaaggaaaccagcgcagagagccaggtgtcagaaaacatctttcagacacagccactcaaccctattcttgaagacgactgcagcagtacctccggcttcccgactcaggagtctttcaccatggcctcttgcacctctgaatcccatagccactgggtgcacagcccaatcgagtgcactgagctggatctccaaaaattctcctctagcgcctcctatactggtgctgagaccttaggcggtaacaccgtagaatccactggagatagattagaattgaatgtcccgttcgaggtgcccagtccatag

SEQ ID NO: 4866 - DNA, 894 bp, Artificial Sequence
  Description of Artificial Sequence: Synthetic coding sequence
atggattgtcaggaaaatgaatactgggaccagtggggcagatgtgtaacatgccagcggtgtgggcctggccaagaactaagcaaagactgcgggtatggagaaggaggggacgcttactgtacagcttgcccccctaggaggtataaaagctcttggggacaccacagatgccagagttgtatcacatgtgctgtcatcaacagggttcagaaggtcaattgcacagccacctcaaatgccgtttgtggcgactgcctgccgagattttacaggaaaacccgcatcggcggactccaggaccaggaatgcatcccttgcaccaagcagacccctacaagcgaagtgcagtgtgcatttcagctttcgctcgtagaggctgacacacccaccgtcccaccacaagaagcaacattggtggcccttgtaagttcactgctggtggtctttacccttgccttcctgggcctcttctttctgtattgtaagcaattcttcaatcgacattgccagcggggagggcttctgcagttcgaggctgataaaaccgccaaagaagagtccctcttccctgtgccaccgagtaaagagacttcggctgaatcacaggttagtgaaaacatctttcagacacaacccctgaaccctatcctggaggatgactgtagcagtacatccggcttccccacacaagagagttttacaatggcttcgtgcaccagcgagagccattcacattgggtccattcaccaatcgaatgtacagaactggaccttcaaaagttttcttcctcagcctcctataccggagctgaaactctcgggggaaacaccgtggaaagcactggcgatagactggaactgaacgttcccttcgaagtgcccagcccatag

SEQ ID NO: 4867 - DNA, 957 bp, Artificial Sequence
  Description of Artificial Sequence: Synthetic coding sequence
atggactgtcaagagaacgaatattgggaccagtggggtcggtgcgtgacttgccagagatgcggtcccggacaagagctgtccaaggactgcggttacggcgaaggaggagatgcatattgtacagcatgccctccaaggcggtacaagagcagctggggacaccatcgctgtcaatcttgcatcacctgtgcagtgattaatcgagtgcagaaggtcaattgtactgcgacctccaatgcggtatgcggggattgccttccccgattctaccgcaaaactcgcatcgggggactccaggatcaggagtgcataccctgcacgaagcaaacgcctacttcggaagttcaatgtgccttccagctctcacttgtcgaggccgatacccctaccgtaccaccccaagaagccaccttagtcgcgctcgtatccagccttctggtggtcttcaccttagcatttctgggcctattcttcctctattgcaagcagttctttaaccgtcactgtcagcgggaaaaactgatcattttctccgacccggtgccagcttctcttaaccttatcccagaattcgccggagggctgcttcaattcgaagccgataaaaccgcaaaggaggagtctctgtttcctgttccgccaagtaaagagacatctgctgaaagccaggtttccgaaaatatctttcaaacgcagcccttaaacccaattttagaagatgattgtagcagcacctctggctttcctactcaggagagttttactatggcaagttgcacaagcgagtcacactctcactgggtacactcgccaattgaatgtacagagctggacctccaaaagttctcatccagcgccagttatacaggagcagagactttaggtggcaacaccgtcgaatctacgggcgatagattagagctgaacgtccctttcgaagtgccatcaccttag

SEQ ID NO: 4868 - DNA, 522 bp, Artificial Sequence
  Description of Artificial Sequence: Synthetic coding sequence
atgtcaaccggcacaaacggggacggcgtttcacccgcaaatggcgttgtgctcgaccgctcgtatccaaggtgcctgccggtggaactatccgggggtcgctacacccacagcgccccttccggaggtcatacatgttgcacgggcggacttctgcaatttgaggccgataaaacagccaaggaggagtcactctttcctgtgcccccatctaaagagacatcagctgagtcccaggtgtccgagaacattttccaaacacagccactgaaccctatcctcgaagatgattgttcatccactagtggctttccaacccaggagtcgttcactatggcctcgtgcaccagcgaatcacatagccactgggttcacagccctatagagtgcaccgaattggacctacagaagttctcttcttctgccagttacactggggcagagaccctgggtggcaacaccgtggagtctacgggtgatcggctggagttgaacgtgccatttgaggtcccgagcccttag

SEQ ID NO: 4869 - DNA, 894 bp, Artificial Sequence
  Description of Artificial Sequence: Synthetic coding sequence
atggattgccaggaaaatgagtattgggaccagtggggccgttgtgtcacatgccagcggtgtggcccagggcaggagttgagcaaagattgtgggtacggggagggtggcgatgcgtactgcaccgcgtgtcccccacggagatacaagagcagctggggtcatcataggtgccagagttgcattacatgcgcggtgattaatcgcgtccagaaagttaattgtaccgccactagtaatgccgtgtgcggggattgtctacccagattttatagaaagaccagaatcggcggactccaggatcaggagtgtatcccttgcaccaaacaaacgccgacctccgaagttcagtgcgccttccaattgtcattggtggaggctgacactcccacagtgcccccacaggaggccacattggtggccctcgtgagttccctgctcgtggtcttcaccctggctttcttggggttgtttttcctgtactgcaagcagtttttcaaccgtcattgtcagaggggcggattgctgcagttcgaggccgacaagaccgccaaggaagagagtcttttccctgtccccccttcaaaagagacctctgcggagtcccaagtctctgaaaacatttttcagacccagcctcttaaccctattctggaagatgattgctcctccacttcgggctttcccacgcaggaaagtttcacgatggcaagctgcactagcgagtctcattcacactgggtccattctccgattgaatgtaccgagttagatttgcaaaagttctcctcaagcgcctcctacaccggcgctgagaccctgggtggcaataccgttgagagcaccggagatagacttgaactgaacgttccttttgaggtcccatccccctag

SEQ ID NO: 4870 - DNA, 648 bp, Artificial Sequence
  Description of Artificial Sequence: Synthetic coding sequence
atgggtctgcggactacaaaacagatggggcgaggtaccaaggctccagggcaccaggaggaccacatggtgaaggaacctgtggaggacactgaccctagcactctgtcatttaacatgagtgataagtacccaatacaggataccgagcttccaaaagccgaggagtgtgataccattacactcaattgtcccagaaattccgatatgaagaatcagggtgaggagaacgggttccctgattccaccggggatcccttgccggagatcagcaaagataattcatgcaaagagaactgtacttgttcttcatgcctactcagagcacctacaatctccgacctgttgaacgatcaagatttgctcgacgttatacgcatcaagctggatccctgccatcccactgtaaaaaattggagaaattttgcctctaagtgggggatgagctacgacgagttatgcttcctcgagcaacgccctcagagtcccacgctggaattcttgctacgtaactctcagaggacagttggccagctgatggagctgtgtcgcctgtaccaccgtgcagacgtggagaaggtactgcggaggtgggtggatgaggaatggcctaagagggagaggggagacccctcacgccacttttag

SEQ ID NO: 4871 - DNA, 618 bp, Artificial Sequence
  Description of Artificial Sequence: Synthetic coding sequence
atggcaagtcccgacgatccccttcgggctgatcatatggttaaggagccagtggaagatacagatcccagcaccctcagcttcaatatgtcagataagtaccctatacaggatacagagttgccaaaagcggaagaatgcgacacaataaccctcaattgtcctcgaaactctgacatgaagaaccagggcgaagagaatgggttccccgattccactggagaccctctccctgaaatctctaaagacaattcctgtaaggagaattgcacctgtagttcatgcctgctcagagcacccacaatctccgatctcctgaacgatcaagatctcctggacgtaatccgtattaagctggatccctgccaccctacggtcaagaattggagaaattttgcttctaagtggggtatgagctatgacgaactgtgttttctcgaacagcgccctcagtcacctacactggagtttctgctgcggaactcccagaggaccgtagggcagctcatggagctgtgcaggctttatcatcgcgctgacgtcgaaaaggtgctaaggcggtgggtcgacgaggagtggcctaagagagaacggggtgatccatcccgccatttttag

SEQ ID NO: 4872 - DNA, 255 bp, Artificial Sequence
  Description of Artificial Sequence: Synthetic coding sequence
atggtgaaggagcccgttgaagataccgatccctcaacactgtccttcaatatgagtgataagtaccccattcaggacaccgagctccctaaagcggaggagtgtgacacaatcaccctcaattgccccagaaatagcgacatgaaaaaccagggcgaggagaatggcttccctgactccacaggggatccactgccagagattagtaaagacaattcctgcaaggagaattgcacttgttcttcctgcctgtag

SEQ ID NO: 4873 - DNA, 2175 bp, Artificial Sequence
  Description of Artificial Sequence: Synthetic coding sequence
atggccggtctgaccgccgctgcaccacgtccgggtgtgctgctcctcctgctgagcattctccatccatcaagacccggaggcgtgcccggagctattccaggcggagtccccggtggtgttttctaccctggggcaggcctgggcgctctcggtggcggagccctggggccaggaggtaagcctttgaaacctgtgccaggtggtctcgcgggagcaggcctcggcgcaggactgggtgcatttccagcggtgacctttcctggtgcactggtgccagggggagtcgctgatgccgctgccgcttacaaagctgccaaggctggagcgggacttggtggcgtgcctggggtgggaggacttggggtatcggccggagctgtcgtgcctcagcctggagccggtgttaagcccggtaaggtccccggagtaggcctccctggtgtgtaccctggaggtgtgttaccaggagccaggtttcctggggtgggcgtgctaccgggagtgccaacaggggctggcgtcaaacccaaggcccctggagtcggtggcgcttttgccggtatcccaggggtcggacccttcggagggcctcagccgggagtgcccctaggatatccaataaaagctccgaagctgcccggtggttatggtcttccctacactactggaaagctaccatacgggtacgggccaggcggagtcgctggcgctgccggtaaggcagggtacccaactggaaccggagtgggaccccaggcagcagccgcagccgcagccaaagctgctgccaagtttggtgccggagcagcgggagttctccccggtgtcgggggagccggagtgcccggagtgccgggtgcaatccctggcatcgggggtatcgcaggcgtgggcacacccgcagcagcagcggctgcagccgctgcggcaaaggccgctaagtacggcgcagccgctgggctggtgccaggaggacccggatttggtccgggagtagtgggggtgcccggtgccggtgtgccgggagtgggagtaccaggcgctggtattcccgtggtccccggagctggaatccctggggctgctgttccaggtgtggtgtccccagaggccgctgccaaggccgctgctaaagcagccaaatacggtgccaggcccggtgtgggagtaggcggaattccaacttacggggtgggagccggtggctttcctgggttcggggtaggtgtgggtggtattcctggcgtcgcaggagtgccaggggtaggcggtgttcccggagtcggcggagttcccggtgttggcatatcccctgaagcgcaggctgccgctgcggctaaggcggctaagtatggggtgggcacccctgcagctgccgctgccaaagccgctgctaaggcagcccagtttgggctcgttcctggggtgggggtcgcacctggagttggagttgccccaggtgtgggtgtggctcccggtgtgggccttgcaccaggggtgggtgtggcaccaggtgtgggtgtggcgccaggcgtcggagtagcgcctggaatcggcccagggggagtcgcggcagccgcaaaatctgcagccaaagtggctgccaaggcccaattgcgcgcagccgcagggctaggagcaggcatcccagggctgggagtgggggtaggagtccctggcttaggcgtaggcgcaggggtccctggtctcggggttggtgctggcgtcccaggttttggagccgttcctggggctctggcagctgctaaggcagccaagtacggtgctgctgtacccggtgtgctggggggtttaggggcactgggcggtgtgggaattcctggaggagtggtcggagccggacccgcagctgcagccgctgcagccaaagcagcagcaaaggcagctcagttcggactcgtcggggcagccggtctaggagggctgggagtgggcggattaggcgtgcctggtgtcgggggactcgggggaattccacccgcagccgctgcaaaggccgcaaagtatggggcagccggactgggaggggttctggggggagccggacagttccctctgggaggggtggccgctagacctggttttggcctgagtccaatattcccgggaggggcttgtctcggaaaagcttgtggcaggaagcgcaaatag

SEQ ID NO: 4874 - DNA, 2274 bp, Artificial Sequence
  Description of Artificial Sequence: Synthetic coding sequence
atggctggtctgaccgccgctgctcctaggcctggagtcctgttgcttcttttgtcaattctgcatccttcacgcccaggaggcgtccctggcgctatccccggaggcgtgcctggtggcgtcttctacccgggagccggactgggtgcactcggaggtggagcccttggacccggtgggaagcctctaaagccagtgccgggaggtctcgctggcgcaggtctcggggctggccttggtgcattcccagctgttaccttccccggtgccctggtgccaggcggagtggccgacgctgccgcagcttacaaagctgctaaagcaggagctgggctgggaggggtgccaggggtgggcggattaggcgtgtctgctggagccgtagtgccgcagcctggggctggggttaaacccggaaaggtcccaggggtggggttacccggagtgtacccaggtggagtgctccccggagcacgttttcctggcgtgggtgtgttgcccggagtgcctaccggcgctggagtgaagcctaaggcccctggggtaggtggtgctttcgccggaataccaggagttggtccctttggcggtccacaacccggagtaccattgggatatccgatcaaggccccaaagttgcctggcggttatggcttgccatatactaccgggaaactcccatatggctacggtcccggtggtgtggccggtgcggctggaaaagctggctacccaaccggtaccggcgtgggccctcaggcggctgccgctgccgcagccaaggcagctgccaaatttggggctggagccgcaggggtattacctggcgtcggaggcgctggcgtacccggagtgccaggagctatccccggtatcgggggaatcgcaggagtggggactccagccgcagccgcagctgctgccgctgctgctaaagcagctaaatacggggctgccgcagggttggtgcctggcggtccaggctttggaccgggagttgttggggtccccggagctggagtgcctggcgtgggcgtgcccggagccggtatacccgtggtaccaggggctggtatccctggtgcagccgtgccaggggtggtgagcccggaagccgctgccaaagcggcagccaaggcagccaagtacggggcacggccaggggtcggcgtgggaggcatccctacctacggagtcggagcgggtggattccctgggttcggggtgggggtgggtggcattccgggagtcgccggagtgcctggtgttggaggtgtcccgggagtcggtggtgtgccaggggtcggtatctctccggaagcccaggctgccgcagcggctaaagcggcaaaatatggagtaggcacacccgcagctgccgcagcaaaagctgcagctaaggccgctcaatttggactcgtgccaggtgttggcgttgcccctggtgtgggcgtcgcccctggcgtgggagttgcaccaggcgtcggacttgcgccaggcgtaggagtggccccaggcgtcggcgtggcccctggggtcggcgtggctccaggtatcggacccggtggtgtcgccgctgcggctaaaagcgcagcaaaagtggcagcgaaggctcagctccgcgctgctgccggactgggcgcaggcattccaggtttgggcgtcggggtcggcgtgcccggactgggagtcggcgcaggagtaccagggcttggagtgggagccggagtgcccggattcggggcaggagctgacgagggggtcaggaggtccctgagcccagagctccgggaaggtgaccccagctcctctcaacatcttccctctacaccctcaagcccccgagttcccggtgccctagccgctgccaaggccgcaaaatacggcgcagctgtgccgggagtactggggggactgggtgccctcggtggggtgggcattccagggggagtggtgggggctggacctgctgcagccgctgcagccgcaaaagcagcagcgaaggccgcacaatttggactggtgggtgctgctggtctgggtgggttgggtgtgggagggctcggcgtgccaggtgtcgggggactggggggtattccacctgccgcagccgcaaaggcagctaagtatggcgctgcaggcctgggcggagtgctgggtggcgcaggtcaattccccctggggggagtggctgccaggccagggtttggcctcagcccaatctttcccggaggagcctgcctggggaaggcatgcggcaggaagcgaaagtag

SEQ ID NO: 4875 - DNA, 2136 bp, Artificial Sequence
  Description of Artificial Sequence: Synthetic coding sequence
atggccggactcactgcggctgcgcctcgaccaggggtcttgttactcttgttatctatcctccacccctctagaccaggtggagtccccggtgctatacccggaggtgtcccgggtggtgttttttatccaggcgctgggctgggtgctttggggggtggggcactaggaccgggtggcaaaccactgaagcccgtccccggagggcttgccggtgccggtttgggcgcaggtctgggcgcattccctgccgtcacgttcccaggtgccctcgtaccagggggagtggccgacgcagcagctgcttacaaggctgctaaagccggagcaggcctgggaggcgtcccaggcgtcggcggactgggcgtttccgccgcaccttctgtccctggcgctgtcgtgccccaacctggtgccggagtgaaacccggtaaggttccgggtgtgggtctccccggtgtatatccaggaggcgttttgcccggtgcaagattccccggagtgggtgttcttcctggagttcccaccggtgcaggtgtgaagcctaaggctcctggtgtgggtggagcgttcgccggtatcccgggagtgggcccttttgggggaccgcagccaggcgtcccgctcggttaccccatcaaggcacctaagctgcctggcggatacggcctcccatacaccactggaaagctgccgtacggatacggtcctggaggcgtcgcgggagccgctggcaaggctgggtaccccaccgggacaggggtgggccctcaggctgccgcagcggcagccgctaaggcagcagccaagttcggcgctggcgctgcaggggtactgccgggtgtgggcggagcgggagtgccaggagtccctggggcaatccccggtattgggggaattgctggcgtcggaacacccgcagccgcagcagctgccgcagctgccgcaaaggctgctaaatatggcgcagccgcaggactggtcccaggcggacctggttttgggcctggcgtggtgggggttcctggggctggtgtgcccggagttggggtgcctggggctggcatcccagtcgtccctggggcaggcataccaggcgctgcagtccctggcgttgtttcccccgaagctgccgcaaaagccgcagccaaggccgctaaatatggtgccagacccggagttggggttggagggatccctacatatggggtaggggcaggaggttttcctgggttcggtgtcggtgttggtgggattccaggtgtggctggcgtgcctggggtgggaggggtgcctggtgtgggcggagttccaggcgtgggcatttcgccagaggcacaagctgccgcagctgccaaggcagctaaatatggcgtcggtacaccagccgcagctgcagccaaagctgcggctaaagctgcccagttcgggctggtgcccggagtgggggtcgcaccaggcgtcggtgtagcgcctggggtaggtgtagcccctggggtggggcttgcccctggcgtcggagtggcccctggagtgggggtggcccctggcgttggggtggcgccaggcatcggaccaggcggagttgccgctgccgctaagagcgccgcaaaagtggctgcaaaggcacagctgcgcgctgctgccggtcttggcgctggtatcccaggcctcggcgtgggtgtcggtgtgcccggacttggcgtgggggcaggggtcccaggcttaggagtcggcgctggcgtcccgggattcggtgctgtgcccggtgccctggcggctgcaaaagccgctaaatatggcgctgccgttccaggagtcctgggaggcttaggtgccctgggcggagtgggcattccaggtggggtcgtaggggcaggtcccgcagctgcggcagctgctgcaaaggcagccgcaaaagctgcccagttcggcttggttggcgcagccggtctgggagggttgggggtcggcggtttgggggtcccgggagtgggagggctgggaggcattcccccagcagccgctgctaaggccgctaagtatggcgtcgccgcacggccagggtttggtctctctccgatcttcccaggcggtgcgtgtctgggaaaggcatgtgggcgaaagaggaaatag

SEQ ID NO: 4876 - DNA, 2379 bp, Artificial Sequence
  Description of Artificial Sequence: Synthetic coding sequence
atggccggactgacggctgcggctccgcgtcctggcgtgttactgctcctgttgtctatcctccatccctccaggccaggcggagtgccaggcgcaatcccagggggtgtgccagggggagtattctatcctggcgctggtctgggggcactgggaggcggagcgctggggcctgggggaaaacctttaaagcctgtgcctgggggtctggcgggagcgggactcggcgctggactgggcgcattccctgctgtgacatttccaggggctctcgtgcccggtggagtggccgatgctgccgcagcttacaaggctgcaaaggccggagcgggactgggaggtgtccctggagtgggtggcctgggggtatctgcgggagctgtggtgccacagccaggtgctggcgttaagccaggaaaagtccccggtgtggggctcccaggagtgtacccgggaggggtcttgcccggagccagattccctggagtgggagtgctgcctggcgtgccaacaggggctggtgtgaagcctaaagcacctggggtgggcggagcattcgccggaatccctggcgtggggccatttggtggtccgcagcctggggtccctctgggctatccaattaaggccccaaaactgccgggaggttacggcctgccatacacaaccggtaagctgccttacggctacggtcctggaggagtcgccggagccgcaggcaaagcgggatacccaaccggaaccggtgttggccctcaggctgccgctgctgcggctgcgaaggcagctgccaagtttggagccggtgccgctggagtgctcccgggagtgggaggcgctggagtccctggagtgcccggagcgatcccaggcatcggaggaatcgcaggcgtgggcacccctgctgcagccgctgctgcggcagctgccgcaaaagctgccaagtacggcgcagcagctgggctggtgccgggtgggcctgggttcggcccaggcgtcgtgggggtgccaggtgctggtgtgccaggagtcggagtgcccggtgctggtattcctgtggtcccgggagctggtatccccggagccgctgtgcccggtgtggtctccccggaggccgcagccaaggccgctgcaaaggccgctaaatacggcgctcggcctggagtgggagtaggcggaattcccacctatggagtcggtgccggtggtttccccggtttcggagttggcgttggaggaattcctggcgtcgccggtgtccctggggtggggggagtgccaggcgtggggggtgtgcccggagtggggatcagccccgaggctcaggcagccgctgccgcaaaagccgcaaagtatggagctgccggagcaggcgtgctggggggactagtaccaggtgctcccggtgcagtgcctggcgttcctggtaccggaggagtccctggcgttggaacacctgctgccgctgccgcaaaggccgctgccaaagcagcgcagttcgcactcttaaacttggccggactcgtgcccggagtgggagtagccccaggggtgggagtcgctcccggtgtaggggttgcccctggggtggggctcgctccaggcgtaggcgtggcccctggcgtgggagtggcacccggagtgggggtcgcccctggcataggtccaggcggagttgcagccgctgctaagtccgcagcgaaagtggcagccaaagcccaattgagagctgctgccggtctgggcgcaggtatcccgggtctgggagtcggggtcggagtgcccggactgggcgtcggtgcaggggtgccaggtctgggagtcggagcaggagttccaggattcggagcaggggctgacgagggcgttaggcgttccctatctcccgaactgcgcgaaggagacccgtcaagcagccagcacctgccctccactccatcatcccccagggtgccaggcgctttggctgccgcaaaggccgctaagtacggtgctgcagttcccggtgtgttgggcggactgggcgctctgggaggtgtgggcataccaggcggagtcgtaggcgcagggccagctgctgccgcagccgctgctaaagccgctgccaaggcagcacaattcggtttagtcggcgcagccggactcggcggtctaggcgtgggagggttgggagtgcccggagtggggggactggggggaatccccccagctgccgctgccaaggccgcaaagtacggcgctgcaggattaggcggagtgctgggcggagcgggtcagttccccctcggaggggtggccgcacgaccaggattcggactctcacccatcttcccaggcggtgcttgcctggggaaggcatgcggcagaaagagaaagtag

SEQ ID NO: 4877 - DNA, 2034 bp, Artificial Sequence
  Description of Artificial Sequence: Synthetic coding sequence
atggctggcctcacagccgctgcgccaaggcccggagtcctcctgctgttgctttcgatacttcatccctctcgcccagggggtgtgccaggcgcaatccctggcggtgtccccggaggagtcttttaccctgccctgggcccaggaggaaaacctttgaaacctgtgcccggaggcctggctggggcaggactgggagctggcctcggagcgttcccagctgtgacctttcccggtgccctggtgcccggaggggtcgctgatgctgccgctgcctataaggccgcaaaagcaggcgcaggcttgggtggagtccctggagtaggtggactgggcgtttcagccggtgctgtcgttccccaacctggcgctggcgtgaagccaggcaaagtgccaggggtcggcctgccaggcgtctaccccggaggggtcttgcccggagcacgctttccaggcgtaggtgtgctgcccggtgttccgactggggcaggggttaaaccaaaagcccctggtgttggaggcgcatttgctgggatccccggagtggggccatttgggggacctcagcctggcgtacctctggggtaccccattaaagcaccaaagttgcctggcggatacgggttgccatacacgaccggtaaactaccttatggatatggacccggaggcgtcgctggagccgctggaaaagccggatatccgacaggcacaggggtgggtccccaggccgctgcggcagctgctgctaaggctgccgctaaattcggcgcaggagctgccggtgtgctgcctggcgtgggaggagccggtgtgccaggcgtccccggtgcaatcccaggaattggcggtatagcaggagtggggacgcctgctgccgctgcagctgcagctgcagccgcaaaagccgcaaagtatggagctgcagccggtttggtgccgggaggcccaggcttcggcccaggtgtagtaggcgtgcccggtgctggcgtgccaggcgtgggcgtgccgggagcaggcatccccgttgtgcctggagcgggaattccgggagccgcagttcctggggtcgtgagcccagaagcagcagccaaggccgcagcgaaagcggcaaaatacggggctagacctggcgttggagtgggcggaatacccacctacggagtgggggcaggcggtttcccaggctttggggtcggggtgggagggattccgggagtggccggagttcccggagtaggtggtgtgcccggagtcgggggtgtgcccggagtggggatttcgccagaagcccaagctgcagctgcagcaaaggctgcaaaatacgggctcgttcccggtgtcggcgttgcgcctggggttggcgtggcgcctggggtgggggtcgcaccaggggtcgggctagcccctggcgtgggtgtggcacctggggtcggtgttgctccaggggtcggtgttgcccctgggatcggcccaggcggtgtggcggcagccgcaaaaagtgctgcaaaggttgctgccaaggcccagctccgtgctgctgcaggtttgggagcaggtataccaggactcggagtgggcgtgggtgtgccgggactcggcgtgggcgctggcgtacctggcctgggcgtcggagctggggtgccaggatttggggctgtgcccggtgccttggcagccgcaaaggccgcaaagtatggcgcagccgttcccggagttcttgggggtctaggggcactgggtggggtcggaattccaggcggtgtagtcggcgcaggccctgcagcagcagctgctgccgcaaaggcagccgcaaaggccgctcagtttggcctggtgggtgctgccggactggggggtctaggagtcgggggtctcggagtgccgggtgtgggtgggttgggcggaattcctcctgcagcggctgcgaaagccgcaaagtacggcgtcgcggctaggcccggttttggcctgtcccccatcttcccaggcggtgcttgcctaggcaaggcttgcggtaggaaacgaaaatag

SEQ ID NO: 4878 - DNA, 2118 bp, Artificial Sequence
  Description of Artificial Sequence: Synthetic coding sequence
atggccggactgacggccgctgcacccagacccggagttctcctactccttcttagtatcctgcatcccagcaggccgggaggggttcctggcgcaatccccggaggcgtccctgggggagtcttctacccgggtgccggtctcggtgcccttggcggaggagcccttggtccaggtggtaagcctttgaaacccgttcctggcggtctggccggagccggactgggtgctgggcttggggcattccctgctgtcaccttcccaggcgctctggtgccagggggagtggccgatgcagctgccgcttataaggcagcaaaggccggagcgggactcgggggagtgcctggagtcggaggtttgggtgtctccgccggagctgttgtgccccaacccggagcgggagtaaaaccagggaaggtgcccggagtggggctccctggcgtataccctggaggcgtgctgcctggagctcgcttcccgggagtgggcgttttgccaggagtccctaccggggcaggtgtgaaacctaaggcaccaggcgtgggcggagccttcgccggtattcccggagtgggcccattcggcggaccccagcctggagtgcccctcggttaccccatcaaggccccaaagttaccaggaggctatggcctcccctataccactgggaagttgccttacgggtacgggcctggaggagtcgccggagcagctggaaaagccggttacccgacagggaccggcgtgggccctcaggccgctgcagcggcagccgctaaggctgctgcaaaattcggggctggggcagccggagtgcttccaggcgttgggggtgcaggcgtcccgggagttcccggtgctatcccaggcattggcggaatcgctggcgtgggcactcccgctgctgccgctgctgctgcggctgcagccaaggccgctaaatatggggcagctgctggtttggtacctggcggaccaggctttgggcctggagtggtgggcgtgcctggcgctggagtgccaggagtcggtgtgcccggagcaggcatacccgtcgtgcccggtgccggtatcccaggggcagctgtgccgggagtggttagtcctgaagccgctgctaaggcggctgccaaagccgcaaaatacggggctcgccctggggttggagtaggtggcattcccacttatggcgtgggtgcaggcggattcccaggattcggagtaggtgttggaggaatacctggtgttgctggcgtcccgggagtggggggtgtcccaggtgtcggcggtgtgcctggcgtaggaatcagccccgaagcacaggcggctgctgccgctaaggccgctaaatatgggctggtaccaggtgtgggggttgctccaggggttggggtcgcccctggcgtgggggtcgcccctggcgtcggtctggcgcctggagtgggtgttgctcctggggtcggagtggcccctggagttggtgttgcacctggtatcgggcctggcggtgtagcagctgccgcaaagagcgccgctaaggtagccgctaaggcccagctgcgagccgctgcaggtttgggagcaggtataccgggactgggagtcggtgtgggggtgcccggattgggagtcggggcaggggtaccaggcctgggcgtgggagccggagtaccgggatttggagcagtacccggagctctcgctgctgcaaaggccgctaaatacggcgctgccgttcccggagttctgggaggtctcggcgctctgggcggtgtaggtatcccgggaggcgtggtgggggctgggcctgctgcggcagccgctgcagcaaaggcagcagccaaggcagcgcagttcgggttggtgggagccgcaggactgggagggcttggggtaggtggcttgggggtcccaggggttggaggcttaggtgggataccccctgccgctgcagcaaaagctgcgaagtatggagctgctggccttggaggtgtcctagggggagctggccaattccctctgggcggagtggcggcaaggcctggcttcggcctcagtcccattttccccggaggtgcctgcttgggtaaagcttgcggcaggaaacgaaaatag

SEQ ID NO: 4879 - DNA, 645 bp, Artificial Sequence
  Description of Artificial Sequence: Synthetic coding sequence
atggcgggattgacagccgctgctccaagaccaggagtacttctgctgctattaagcattcttcatccttcccgtcccggaggagtgcccggagctatacccggaggggtcccaggtggcgttttctaccccggtgcgggactgggggctcttggcggaggcgcactaggacctggcggaaaaccacttaagcctgtgcctggtggattggccggagcaggtttgggtgccggtcttggagccttccccgctgtcacgtttcccggagccctggtgccgggaggggtcgcggacgccgctgcggcttataaggccgctaaagctggtgccggactcggcggagtccccggtgtaggaggtttgggtgtctccgccggtgcagtcgtgccgcagccaggcgcaggggtgaagcctggcaaagtcccaggggttggcttgcctggtgtttatcctggcggtgtactccccggtgtgggacctttcggcggacctcaacccggtgtgcccctgggatatccgatcaaggcaccaaaactgcctgggggttacggattaccctacaccaccggaaaactaccgtacggttacgggcctggaggagtcgccggtgcagcgggaaaagctggctaccccactggcacatag

SEQ ID NO: 4880 - DNA, 504 bp, Artificial Sequence
  Description of Artificial Sequence: Synthetic coding sequence
atggcgggtctgacagccgctgccccacgacctggggtcctacttcttctgctgtcaatactgcatccatcacgtcctgggggtgtccctggcgcaatccctggaggtgtgcccggtggcgtattctatcccggagctggcttgggggcactgggcggaggagcccttggacctggcggaaagcccctgaaacctgtcccaggcggattggcgggagccggactgggggcaggacttggggcttttcccgctgtcacttttcccggagccttagtgccaggcggagttgcagacgccgcagccgcatataaggcagcaaaggccggagtgggacccttcggcggaccacagccgggtgtccccctgggttatcccattaaggcaccgaaactgccaggcggatacggcctgccatataccactggtaaactgccctacggctatggcccaggcggtgtagctggcgcagccggaaaagctggctaccccaccggcactggctag

SEQ ID NO: 4881 - DNA, 2079 bp, Artificial Sequence
  Description of Artificial Sequence: Synthetic coding sequence
atggctggcctcactgcggcagcccctaggcccggagttctcctgctcttattgagcatcttacacccctcccgccctgggggtgtgccaggagccattcccggaggggtccccggtggcgttttctatcctggcgcaggactcggagcactgggaggaggcgctcttggaccgggtggtaaaccactaaagccggtgcctggcggactcgctggcgctgggttgggcgcaggactgggcgctttcccagccgttacgttccctggagcacttgtgcccggtggcgtggccgatgcagctgcagcttataaggcagcaaaagcgggtgctggtcttggcggagtgcctggagtgggaggactaggagtttccgcagccccttcggtgccaggtgccgttgtgcctcagcccggagcaggagtaaaacctgggaaagtgcccggagtggggctgcctggagtgtatcctggaggagttttaccgggtgcaagatttcctggcgtgggagtcttgcctggagtgccaacaggtgcaggagtcaagcccaaagctcccggagtaggtggagcatttgcaggcattcctggagtgggtcccttcgggggacctcaacccggtgtccctctggggtatccaatcaaggctccaaagttgccaggaggctatggactgccttacacaactgggaaactgccctacgggtacggtcctggaggtgtggccggagccgctggcaaggcaggataccccacaggaacaggcgtcgggccacaggccgctgcagcagcagctgctaaagcagctgcaaaatttggagctggtgcagccggagtactcccaggcgttggcggagctggcgtgcctggtgtgcccggtgctattcccggtatagggggaatcgcaggtgtggggacccctgctgcggctgctgctgcagccgcagccgctaaagccgctaaatatggtgccgcagccggactcgtgcctggtgggcctggctttggaccgggagtggtgggggtacctggcgctggagtgcccggagtgggcgtacctggggctggcataccagtcgtgccaggtgctggaattccaggggcagccgtgccaggcgtcgtatctcccgaggccgctgctaaagcagccgctaaggccgcaaagtacggcgcacgacccggtgtcggcgtgggcggaatccctacctatggggttggcgcaggaggttttccagggttcggcgtaggggtgggaggtatccctggggtggcaggagtgcctggcgttggcggtgtgcctggggtgggtggcgtgccaggagtgggtatttccccagaagctcaagcagccgcagccgctaaagccgctaaatatggcttagtgcctggagtcggagtggcaccaggagtcggagtagctccaggggtgggagtcgcccctggcgtagggttagcacctggcgtgggagttgctcccggtgtcggcgttgctcccggagtcggagtcgcccctggtatcggccctggcggagtggctgccgcagcaaaatcagccgcaaaggtagcggctaaagcccagctaagagctgcagctggattaggcgcaggaatcccaggattgggcgtgggagtcggagttcctggcctcggtgtaggagccggagtgcccggtttgggggtcggagccggagtccccggattcggggctgtgcccggtgccctggccgctgctaaggccgctaagtatggggctgccgtacctggggttcttggtggcctcggggcactgggcggagtggggatccccggaggtgttgtcggcgcagggccagcagctgcagccgcagcagctaaagccgcagccaaagctgcccagtttgggctggttggcgctgcaggcctgggaggactcggcgtcggaggactcggagtgcccggagtcggcggtttagggggaatcccacccgctgctgccgcaaaggcagccaaatatggggtggccgcaagacccggtttcgggctgtctcccatcttccccggaggagcctgtctaggcaaggcttgcggcagaaagcgcaaatag

SEQ ID NO: 4882 - DNA, 507 bp, Artificial Sequence
  Description of Artificial Sequence: Synthetic coding sequence
atggccggtctcaccgctgccgcacctcggccaggcgtactgctcctactgctatccattctgcacccgtcacggcctggaggggtgcctggtgccatccctggcggtgtcccaggtggagtgttctaccccggtgccggactgggggctctcggcggaggcgctcttggtccaggagggaagcctctaaagccaggggtcggcccatttggcggtccccagccgggagtgcctctcggctatcctataaaagccccaaaactcccagggtatggacccggtggggtggctggagccgctgggaaggcaggttatccaaccggtacgggagtcggccctcaagctgccgctgcggctgccgcaaaggctgccgcaaagtttggggctggcgctgccggtgtgctgcccggagtgggaggggctggagttcctggggtgccgggagcaattcccggaatcgggggtattgctggcgtggggacaccagccgctgccgcagctgcctag

SEQ ID NO: 4883 - DNA, 885 bp, Artificial Sequence
  Description of Artificial Sequence: Synthetic coding sequence
atggctggcctgacagcagctgctccccgtcctggcgtgttattgctgctgctttccattctgcatccatcaagacccggaggagtgcctggtgccattcctgggggagttcctgggggagtcttctaccctggggctgggttgggagcgttgggtggcggagctctcgggcctggaggaaagccattgaagccaggtctcggggcattccccgcagtcaccttccccggagcactcgtgcccggtggggtagctgacgcagctgccgcttacaaggctgccaaggcaggcgctggtctggggggtgtgccaggtgtggggggtctcggtgtcagcgctggcgcagttgtccctcagcctggggcaggtgtcaagcctggcaaggtgccaggcgtcggcctgcccggagtgtatcccggaggcgtgctccctggcgctaggttccctggtgtgggggtgttgcccggagtgccaaccggtgccggagtcaaacccaaggcccctggtgtgggccctttcgggggaccacagcctggcgttcctctggggtatccaatcaaggcacccaaacttcctggcggatatggcctgccctataccactgggaagctcccatacggttacgggcctggcggtgtggccggagccgcaggcaaggccggataccctacgggcaccggcgtgggcccacaagcggctgcggcagctgccgctaaggcagccgctaaatttggggctggagcggcaggtgtactgcccggagtgggtggggctggggtgcctggcgtacctggcgctattcccggaatcgggggtatcgcgggtgtgggcactcctgcagccgctgccgctgctgcagcagccgcaaaggccgcaaagtattag

SEQ ID NO: 4884 - DNA, 531 bp, Artificial Sequence
  Description of Artificial Sequence: Synthetic coding sequence
atggctggtttgaccgctgcagctccaaggccaggtgtgctcctgttgctacttagcatcctccatcctagcaggccgggtggagttcccggagccattccaggaggggtgcctggcggtgtattttaccccggtgcagggctcggcgcactgggcggtggggcattgggcccaggagggaaacctttgaagcccgtccctggaggactcgccggagcgggtctgggtgctggattgggcgcatttcccgcagtgacctttcctggcgctcttgtacctggaggcgtggctgatgcggcagcggcatacaaagctgcgaaggcgggagccggtctggggggagttccaggggttggtggccttggggtaagcgccggtgccgtcgtgccccaaccgggtgctggcgtgaagcccggaaaagtgcctggagtcgggggagccttcgctggaataccaggtgtgggacctttcgggggaccacagcccggagtgcccctgggctaccctattaaggctcctaagcttccatag

SEQ ID NO: 4885 - DNA, 1992 bp, Artificial Sequence
  Description of Artificial Sequence: Synthetic coding sequence
atggccggactgaccgccgctgcaccgaggccaggtgtgttgctgctgctgcttagcattctgcatcctagcagacctggtggagtgcctggagccattcctggtggggtgcctggaggggttttctatccaggcgctggactcggagccctgggaggcggtgcgctcggaccaggaggcaagccattgaaacccgtgcccggagggctggccggtgccggactaggcgcaggcgctggtctcggcggagttcccggtgttgggggtctgggtgttagtgctggtgctgtggtccctcagccgggtgcaggcgtcaagcccggaaaagtgcccggagtgggacttcctggtgtgtacccgggaggagtgttacctggagccaggttccctggcgttggagtgcttcccggagtgcccaccggagcaggtgtaaagcctaaagcccctggcgtgggaggcgctttcgccggaatccctggcgttgggcctttcggcggtcctcagcccggagtgcccctgggatatcccataaaggctccaaaactgcccggaggttatggcctaccttacaccaccggaaaactcccatacggatacgggccaggaggcgtcgcgggagcagcgggtaaggctggctatccaactggcaccggcgtcggaccccaggccgcagctgccgcagcagccaaagctgctgccaaattcggggcaggtgctgctggcgtgctgcctggtgtaggcggtgcaggagtgccgggagtcccaggcgctatccccggaataggtggcatcgctggagtggggacacccgctgccgctgcagctgcagccgcagccgctaaagccgcaaaatacggcgctgccgctggtttagtgccaggcggaccaggttttggacctggtgtggtgggggtcccgggagcaggagtgcctggagtcggggttcctggtgctggaatccctgtggtcccgggagcaggaatccccggagctgcggtgcctggggtggttagcccggaagctgcggctaaagctgctgcaaaagccgcaaagtatggtgctagaccgggagtcggagtggggggtatacctacttatggggtgggtgccggaggattccccggttttggcgtcggagtggggggaattcccggtgttgcgggagtgccgggagtgggaggggttccgggtgtcgggggagttcccggtgtggggatctcccccgaggcgcaggccgcagcagctgcgaaggcggcaaagtacggtgtggggacccccgctgctgctgctgcgaaagcagctgccaaagcggctcagtttggcctagttccgggagtgggcgtagcgcctggggtaggagtggcccctgggattgggccaggaggcgtggctgctgcagctaagtccgcggcaaaagttgccgcaaaggcccagctcagagcagccgcaggtctcggcgcaggcattcctgggctcggtgtaggggtgggggtaccaggcctgggcgtaggcgcaggcgtgcccggactaggagtgggcgctggagtccccggtttcggtgccgtacccggtgccctcgccgctgcaaaggcagccaaatacggcgctgcagtacccggtgtcctggggggtctgggcgcactaggtggagtcggtatccccggtggcgttgtcggtgccggacccgctgctgcagctgcagcagccaaagctgccgctaaggctgctcagttcgggttggtgggagcagccggtctgggtgggctgggagtcggaggactgggcgtgcctggggtcggcggacttggtgggattccccctgcagccgcagccaaggctgccaagtacggagctgccggtctgggaggcgtcctgggcggtgctggtcaatttccactggggggagtagcagccaggccaggcttcggtctgtccccaatttttccaggaggagcttgcctgggtaaagcctgcggaagaaagaggaagtag

SEQ ID NO: 4886 - DNA, 2121 bp, Artificial Sequence
  Description of Artificial Sequence: Synthetic coding sequence
atggccggattaaccgcagcagccccaaggcctggtgtgctgctcctgttattgagcatccttcatccgtcacggccaggcggagtgcccggagctatacctggcggtgttcccggaggagtcttctaccctggggcaggcctgggggcactgggagggggagcgctaggcccaggaggcaagcccctgaagcccgtgcctggcggactagcaggcgcaggtctgggtgctggccttggggcttttcccgctgtaactttcccaggagctctggtgcctggaggcgttgctgacgccgctgcggcttataaagctgctaaggcaggagcagggctcggaggggtgcctggggtaggcggtcttggggtttcagccggagctgtggtgccgcagccaggcgctggggtaaagccgggaaaggtgcctggggttggcctgcccggagtataccctgggggtgtcttgccgggagctcggtttcccggtgtgggagtgttgcctggagtacctaccggggcaggggtaaaacctaaggccccaggtgttgggggtgcctttgccggaatcccaggagtggggccttttggcggaccacagcccggtgtgccactgggttatcccattaaagctcctaagctgccaggaggctacgggctgccctacacaactggaaagttaccatacggctacggtcccggaggtgtagctggcgcagctggaaaggcaggatacccgacaggcacaggagtggggccacaggccgcagccgcagccgcagccaaagccgctgctaagtttggtgccggtgccgctggggtactgcctggcgttggcggtgccggagtaccgggtgttcccggagccattcctgggatcgggggtattgccggagtgggtacccccgcagctgccgcagcggcagctgcagccgcaaaagccgctaagtacggagccgctgcaggcctggttccagggggaccaggttttggtcccggagtcgtgggcgttccgggagcaggcgtgcccggtgttggtgtgccaggcgcaggaataccagtggtgcccggtgcaggcatccctggcgctgctgtcccaggcgttgtgtcacctgaggccgctgcaaaagccgctgctaaggcagctaagtatggggctcgtcctggagtgggtgtagggggtataccaacatacggcgtaggcgcaggcggttttccaggatttggagtgggtgtggggggaatccctggtgttgcaggtgtgccaggcgtgggtggtgtgcccggagtcggaggagtccccggagtgggtatcagccccgaagctcaggccgctgccgctgccaaggcagccaagtacggggtagggaccccagctgcagccgctgcaaaggctgccgcaaaagcagctcagtttggtttagtaccaggagttggagtggctccaggagttggtgttgcgcctggggtgggtgtggcaccaggagtggggcttgctcccggagtcggagtggcccctggcgtgggtgttgcccctggagttggcgtcgctcccggaatagggcctgggggtgtcgctgcagctgctaagtctgctgccaaggttgccgctaaggctcaacttagagccgctgccggattgggggctggcatcccagggctcggcgtcggagtgggtgtaccgggtttaggtgtgggtgccggagtacctggcctgggtgttggcgctggcgtcccgggatttggagccgttcctggcgctctagcagctgcgaaggccgcaaagtatggcgctgcagttccgggagttctggggggactgggtgcgctgggaggcgtgggcattccagggggagttgtgggcgcaggcccagccgcagcagccgctgctgctaaagcggcagcgaaagccgctcaatttggcctcgttggggctgctgggctgggcggtttgggagtgggaggactgggggtgccaggcgtagggggactggggggaataccccctgcagccgcagccaaggcagccaagtatggcgtggccgctcgcccaggattcggactgagccctattttcccaggcggtgcctgtcttggaaaagcttgcggtagaaaaagaaagtag

SEQ ID NO: 4887 - DNA, 2145 bp, Artificial Sequence
  Description of Artificial Sequence: Synthetic coding sequence
atggcaggactgacagcagccgctcccaggccaggagttttgctgcttttactttctatcctgcaccccagtcgacctgggggagtgcctggcgctatacctggaggcgtacccggtggagtcttctatccagccctggggccaggcggtaaacccttgaaaccagtgccaggcggactggcaggggctgggctgggggcaggtctgggcgcatttcctgcggtgacgttcccgggagctttggttccgggtggcgtcgcagatgctgccgctgcatataaagccgcaaaggccggagccggactcggcggtgtgccaggcgtggggggactgggagtgtccgccggtgcagttgtccctcaacctggggcaggagtcaaaccaggaaaagtgccaggggtcggactccccggagtctaccctggtggcgtactccctggggctaggttccctggagtgggagttcttccgggagtgcctactggcgcaggggttaagccaaaagcacccggagtggggggtgcttttgctggaatcccaggtgtggggccattcggcggaccgcagccaggggtgccgttgggttatcctattaaagccccaaagttaccagggggttacggtctcccctacaccaccgggaaattgccatacggttatggaccgggaggggtggccggtgccgcagggaaggcaggctaccctaccgggactggggtcggaccacaggccgctgctgccgcagccgcaaaggcagctgccaagttcggggctggtgccgctggagttctccccggagtaggcggtgctggcgtgcctggagttcccggtgctattcctgggattgggggtatcgcgggagtcggaacgccggcagctgccgctgccgcagctgctgctgccaaagccgctaagtatggcgcagctgccggattggtccccggaggcccaggtttcggaccaggtgtcgtcggtgtgcctggcgctggcgtgcccggtgtgggtgtccctggcgctgggattccagttgttccaggggctggcattcctggggctgcagtcccaggtgtcgtgtctcccgaagccgctgcaaaggcagccgctaaagctgcgaaatacggtgctcgccctggcgtgggtgtaggtgggatacccacatatggtgtaggcgctggaggtttccccggatttggcgtcggagtcggagggatccccggagttgctggcgtccccggagtggggggagtcccaggcgtgggtggcgtccccggtgtggggatttctccagaagcacaggcggctgcagccgcaaaagccgctaagtatggcgtgggaaccccagctgctgccgcagctaaagctgcagcaaaggccgcacagtttggactcgtaccgggtgttggcgtggcacccggagtcggggtggcgccaggggtcggtgtggcccctggtgtgggcctcgctccaggtgtgggggttgctccaggagtaggagtcgcccctggtgtaggcgtggcccctggaattggccctggcggagtggccgcagctgccaagagcgcggctaaggtcgctgctaaggcccagcttcgcgctgccgctggactcggagcaggaattccgggtctcggtgtgggggttggagtacctggtctcggcgtgggggctggcgtacctggactgggcgtaggcgctggcgtacccggattcggcgctgtgcctggggcattggctgccgcaaaagccgctaagtatggtgccgcagtgccgggagtgctcggcggattaggagctctggggggagtgggcatccctggcggagtagtcggagctggcccagcggcagcagctgctgccgcaaaagctgccgctaaagccgctcagtttgggctcgtcggcgctgctgggctaggtggactgggggtcggtgggctgggggtcccaggggtgggcggtctggggggaatcccccctgccgcagcagccaaggcagccaagtacggtgctgcgggattgggaggcgtcctgggcggtgccggtcaatttcccctgggtggagtggctgctcgacccggtttcggtctatcaccaattttccctggaggggcatgtctaggcaaagcttgtgggaggaaacggaaatag

SEQ ID NO: 4888 - DNA, 678 bp, Artificial Sequence
  Description of Artificial Sequence: Synthetic coding sequence
atggctgcactcgcctcaagccttatccggcagaaacgtgaggtgcgggaaccaggcggatctaggcctgtctcggctcagcgccgtgtatgtcccaggggaactaagtctttgtgccaaaagcagctactgatcctgctatctaaggtgaggctgtgcgggggtcggccagccagaccagaccgcggtcctgaaccacagctcaaaggcattgtaacaaagctcttctgtaggcagggcttctacctgcaggctaatcccgacggctccatccaaggcacgcctgaggacaccagtagcttcacacatttcaatctaattccagtgggtctcagagttgtcacgattcagagtgccaagctgggccactatatggccatgaacgcagagggcctcttatatagtagtccccattttacagctgagtgccgcttcaaggagtgcgtcttcgagaattattatgtgctctacgcaagcgctctgtaccggcagaggaggagcgggcgtgcatggtatctggggttggataaggaaggccaggttatgaagggcaatcgagtgaaaaaaactaaggctgccgcacactttctgcccaagctgttggaggtggccatgtatcaggagccttcgttgcactccgttcccgaggcctccccttcaagcccaccagcgccttag

SEQ ID NO: 4889 - DNA, 546 bp, Artificial Sequence
  Description of Artificial Sequence: Synthetic coding sequence
atggagtctaaggagccccagcttaaaggaattgtgacgcgcctctttagtcagcaggggtattttctacaaatgcaccccgacggaacaatcgacggcactaaggacgagaatagcgattatactctgttcaaccttattcccgttggcctcagggtggtggcgattcagggtgttaaagctagtctttatgtggccatgaacggcgaggggtatttatattcatctgacgtcttcacccccgagtgtaaattcaaggagagcgtcttcgaaaattactatgtcatttatagctcaactctctatagacagcaggagagcgggagagcgtggttcctgggcttaaataaggaagggcagatcatgaagggcaatagagttaaaaagacaaaaccttcctctcactttgtgcccaagccaattgaggtctgcatgtatcgggaaccatcacttcacgagattggcgagaagcagggccgtagccgtaagagctccggcacacccactatgaacggaggcaaggtggtaaatcaggattcaacctag

SEQ ID NO: 4890 - DNA, 546 bp, Artificial Sequence
  Description of Artificial Sequence: Synthetic coding sequence
atggagaagactgaaccacagctaaagggcatcgtcactagactcttttctcagcaaggttactttctccagatgcaccctgatggcactatcgatggcaccaaagatgagaattcggactacaccctgttcaatctgatcccggtcggcctgagggtggttgctatacaaggggttaaagccagtctgtatgtggccatgaacggagaaggttatctatattcctcggacgtgtttacaccggagtgcaaatttaaggagagcgtatttgagaattactatgtaatctactcttccacattataccgccagcaggagagcggtagagcgtggtttctgggcctaaataaagaaggtcagatcatgaaaggaaaccgggtcaaaaaaactaagccctcctcccatttcgttcctaagcctattgaggtctgcatgtatcgcgagcccagcctgcatgagattggagaaaagcaggggagatctcgtaagagctctggaactcccaccatgaatggagggaaggtagtgaaccaagatagcacgtag

SEQ ID NO: 4891 - DNA, 324 bp, Artificial Sequence
  Description of Artificial Sequence: Synthetic coding sequence
atggaaagcaaggaacctcagctgaagggaattgtcactcgtttgttttcacagcagggctacttccttcagatgcaccccgacggcactatcgacggaaccaaggatgagaattctgactatactctgttcaaccttatccccgtggggctgcgggtcgttgccatacaaggcgtgaaagcgtccctgtatgtggccatgaacggggagggctatttgtactcatccgacgtgttcacacctgaatgcaaatttaaagagtccgtattcgagaactactatgtgatttactcctccacactttatcgacaacaggagtcatag

SEQ ID NO: 4892 - DNA, 546 bp, Artificial Sequence
  Description of Artificial Sequence: Synthetic coding sequence
atggagtccaaggagccacagctgaagggtatcgtgactcggctgttttcacagcaagggtacttcctgcagatgcaccccgacggaacaatcgatggcacaaaagacgaaaacagtgattataccctgtttaacctgatccccgtgggacttcgggtggttgcaatacagggagtgaaggcttccttgtacgtcgccatgaacggcgagggatacttgtacagctctgatgtttttactcctgagtgcaaatttaaggagtccgttttcgagaactactacgtcatttacagctccacgctctacaggcaacaggaatcgggcagggcatggttcctggggctcaataaagaggggcagatcatgaaggggaacagagtcaaaaaaacaaagccttccagtcacttcgtccctaagcccattgaggtgtgtatgtaccgggaaccatctctgcacgagatcggggaaaaacagggccgaagtcgcaaaagtagcggaactcctactatgaacgggggaaaagtggttaatcaggactccacctag

SEQ ID NO: 4893 - DNA, 546 bp, Artificial Sequence
  Description of Artificial Sequence: Synthetic coding sequence
atggagtcgaaagaaccacaactcaaaggtatcgtgactcgcttgttctcacagcagggttacttcctgcagatgcaccctgatggcaccattgatggtaccaaggatgaaaattcggattataccctgttcaacctgatccctgtaggtttgcgggtagtggcgattcagggtgttaaagcaagcctctatgtggctatgaacggggaggggtatctttattcttccgatgtgttcactcctgaatgcaaatttaaggaatctgtcttcgaaaattactacgttatatactccagcacactgtaccggcagcaggagagcgggcgtgcatggtttctggggctcaataaagagggacagattatgaaaggaaatagagtgaaaaaaactaaaccaagttctcattttgtccctaaaccaattgaagtgtgtatgtaccgggagccctccctgcatgagataggcgagaagcagggcaggagccggaaaagcagtggaacacccaccatgaacggaggaaaagtcgtgaatcaggacagtacttag

SEQ ID NO: 4894 - DNA, 732 bp, Artificial Sequence
  Description of Artificial Sequence: Synthetic coding sequence
atggcagcagcgattgcctcctcgcttataaggcagaaaaggcaggcacgcgaatcaaactctgacagggtttccgctagcaagagacggagctctccatccaaggacggcagaagtctgtgcgaaaggcacgtgttgggtgtgtttagcaaagtgagattctgttctggtcgcaagagacccgtcagaagaaggcctgagcctcagctgaaaggcatcgtgactcgtctgttctctcagcagggttacttccttcagatgcatcccgatggcacaatcgacgggacaaaagatgagaactcggactacaccctgtttaatctcattccagtgggcttgagagttgtcgctatccagggagttaaagcctctctgtacgtggccatgaacggcgagggctatctgtactctagcgatgtgtttacaccggagtgtaaattcaaagaaagcgtcttcgagaattattatgtaatatactcttccactttgtaccgacagcaagaaagcgggcgtgcctggttcttagggctgaataaggagggtcagattatgaaaggcaacagagtcaagaaaactaagcccagctctcactttgtgccgaaacccattgaggtctgtatgtatcgggaacctagcctacatgagattggcgagaaacagggacgctcacgcaagagtagcgggacacccacaatgaacggcggtaaggtcgtgaaccaggattccacctag

SEQ ID NO: 4895 - DNA, 579 bp, Artificial Sequence
  Description of Artificial Sequence: Synthetic coding sequence
atggcactgcttagaaagtcttatagtgaaccgcagttaaagggtatcgtgacaaaactctactcaagacaaggctatcatctccagctccaggcagatggaacaatcgatgggacgaaagacgaggactcgacctatacgctgtttaacctaattccagttggcctcagggtggttgccattcagggggtgcagaccaagctgtacttagccatgaattccgaaggatacttgtatacgtcggaattgttcactccggaatgtaaattcaaagagagtgtgttcgagaactactacgtgacgtattcatcaatgatataccggcaacagcagtccggccgtggatggtatttgggtttaaacaaagaaggagagatcatgaaagggaaccacgtgaaaaaaaataaacccgctgcacatttcctcccaaagcccttaaaagtagcaatgtacaaagaaccgagtttacatgatctaactgagttttcaagatcgggctcggggactcccacaaaaagtcggagcgttagcggcgtgctgaacggtggaaagagtatgagccacaacgaatcgacctag

SEQ ID NO: 4896 - DNA, 738 bp, Artificial Sequence
  Description of Artificial Sequence: Synthetic coding sequence
atggcagctgccatcgcctcctctttgatcaggcagaagcggcaggccagggaacgggaaaagtcgaacgcatgcaaatgtgtgagtagtccttccaaggggaagacctcctgcgataaaaataagctgaacgtcttcagccgcgtcaagcttttcggcagtaagaagaggcgcaggcggcgaccagagccccagctgaaaggcatcgtgacgaaactgtattctcgccagggatatcatttgcagttgcaggccgatgggactattgatggcaccaaggacgaggatagcacatacacgctatttaacctcatccctgtcgggctgagagtcgtggccatccagggcgtgcagaccaaactgtacctggcaatgaactccgagggttatctgtacacaagtgaactgtttaccccagagtgcaaatttaaagaatcagtgtttgagaattattacgtaacttactcttcaatgatttaccgacaacaacagtcagggagaggatggtatctaggtcttaacaaagaaggagaaattatgaaggggaatcacgtgaagaagaataaaccagccgcacacttcctgccaaaaccattgaaggtcgccatgtacaaagaacctagtctccacgacctgactgagtttagcagaagcggtagcgggacacccacgaagagccgctccgtatccggggtcctgaacggcggtaagagtatgagccacaatgaaagtacatag

SEQ ID NO: 4897 - DNA, 768 bp, Artificial Sequence
  Description of Artificial Sequence: Synthetic coding sequence
atgtccggaaaagtgacaaaacccaaggaagaaaaagacgcatccaaggtgttagacgacgccccaccgggtacacaggagtatattatgctccgtcaggatagcatccagagcgctgagctgaaaaagaaggagtcgccctttcgcgcaaaatgtcacgagattttttgttgccccctgaagcaagtccaccataaggaaaacacagaaccagaagaacctcagctgaagggaatagtgacaaagctttactcgcgtcagggttatcatctccagctccaggccgatggcacaattgacgggaccaaggacgaagatagcacttacaccctttttaacctgatccctgtggggctgagagtggtggcaatacagggggtacaaacaaagctctacctagctatgaattcggagggatacctatacacctctgagctttttacccctgaatgtaagttcaaagaatccgtttttgagaactattacgtgacatatagttcaatgatctatcgccagcagcaatctggacggggttggtacctggggctgaacaaagaaggggagattatgaaaggtaatcacgtcaagaagaataagccagccgcacatttccttcctaaacccctgaaggtggccatgtataaggagcctagtctgcacgatttgactgagttctccagaagcggaagcggcaccccaaccaagagccgctccgtgtccggtgtgctgaacgggggaaaatctatgtcccataatgagtccacttag

SEQ ID NO: 4898 - DNA, 132 bp, Artificial Sequence
  Description of Artificial Sequence: Synthetic coding sequence
atgctgaggcaggattctatccagagtgctgaactgaaaaagaaagagagccccttcagagccaaatgccatgagatcttctgctgccctctcaagcaggtccaccacaaagaaaataccgagcctgaatag

SEQ ID NO: 4899 - DNA, 666 bp, Artificial Sequence
  Description of Artificial Sequence: Synthetic coding sequence
atgagtggtaaggtgacaaaacctaaggaggagaaagatgctagtaaagtgctcgatgacgcccctcctggaacgcaggaatatatcatgttgcgccaggacagcattcaaagtgccgagctgaagaagaaggagtcacccttcagagcaaaatgccacgaaatattctgctgccctcttaagcaagtacaccacaaggaaaataccgaacccgaagagccccagttaaagggcatagttacaaaattgtacagtcgccagggatatcatctgcagttgcaggctgacgggacaatcgatgggaccaaagacgaagattcaacgtacaccctcttcaacctaatccccgtgggtttgagggtggttgctattcagggtgtacagactaagctgtacttggcaatgaacagtgagggctacctgtacacatccgagcttttcactccagagtgcaaattcaaggagtcggtgtttgagaactactatgtgacgtatagctccatgatctatcgccagcagcagtcaggccgtggatggtatttgggcttgaataaggagggagagatcatgaaggggaaccacgtgaagaagaataaaccggctgcccacttcctgcctaaacccttgaaagttgctatgtataaagaaccctcccttcatgattag

SEQ ID NO: 4900 - DNA, 681 bp, Artificial Sequence
  Description of Artificial Sequence: Synthetic coding sequence
atgctgcggcaggactccatccagtcagccgaactgaaaaagaaggagtctcccttccgggctaagtgccatgaaatcttttgttgtccactgaaacaggtccaccacaaggagaacactgagcccgaagagccacagctaaagggcatcgtgactaagctctatagtaggcagggctatcacctccagctgcaggccgatggtacaatcgacgggaccaaagatgaggattctacctatacgctcttcaatctgatccccgttggcttgcgcgtcgtcgcaatacagggagtgcagaccaagttgtatctagcaatgaactctgagggctacctatatacctccgaactgttcactccagagtgtaagtttaaggagtctgtctttgagaactactacgtgacatacagctcgatgatctataggcagcagcagagcggtcggggatggtatctgggtcttaataaagagggggagatcatgaaagggaaccatgtgaagaagaataagcccgcagcccatttcctgcccaagcctctcaaagtggctatgtacaaggaaccaagtctgcatgatctcacagagttcagtaggtcaggttcagggactcctacaaaatcaagaagtgtttctggcgtactgaacggaggcaaatccatgtcacataacgaaagtacttag

SEQ ID NO: 4901 - DNA, 297 bp, Artificial Sequence
  Description of Artificial Sequence: Synthetic coding sequence
atgagtggaaaggttaccaaaccaaaagaagaaaaggacgcgagcaaagtgctggacgatgcccctcccggaacccaggaatacattatgctgcggcaggattccatccaaagtgctgagttgaagaagaaggagagcccattccgcgcaaaatgccatgaaattttttgctgcccacttaagcaggttcaccacaaagagaacaccgagcctgaggaaccccagctcaagggcattgtgaccaagctgtacagccgccaggggtaccacctgcagctgcaggccgacggcacctag

SEQ ID NO: 4902 - DNA, 624 bp, Artificial Sequence
  Description of Artificial Sequence: Synthetic coding sequence
atgagaacgtccatgaagaaagtcggcatgcatcatttgagctccagtgggggatcctattacctgatcctcgacgatgccccacctggcacccaggagtatatcatgctgcggcaggattctatccagagtgctgaactcaagaagaaagagagtccatttcgggctaagtgtcatgagattttctgttgccctctgaaacaagtgcaccacaaagaaaacacagagccagaagagccccagctaaaaggtatagtgacgaagctgtacagccggcagggatatcacttgcaacttcaggctgatggcaccatagacggaacaaaggacgaagactctacctataccttgtttaatcttattcccgttggcctccgcgtggtggcaattcagggggtgcagactaagctgtacctcgccatgaactccgaagggtatctgtacacgagcgagctgtttactcccgagtgtaaatttaaggagagcgtttttgagaactactatgtcacatactcctccatgatctaccgacagcagcagagtgggagggggtggtacctgggtctgaacaaggaaggcgaaatcatgaagggcaatcatgttaaaaaaaataagcccgcatag

SEQ ID NO: 4903 - DNA, 600 bp, Artificial Sequence
  Description of Artificial Sequence: Synthetic coding sequence
atgtcaggcaaggtcaccaagccaaaggaggaaaaggatgcgtctaaggaaccacaattgaaggggatcgtgactaaactctattcaaggcagggttaccatttgcagctgcaagccgatggcactatcgatgggactaaagacgaggatagcacttacacactgtttaatctcatcccagtgggacttcgcgtggttgcgatccagggggtacaaacaaaactgtatttagctatgaattcagagggatacctttatacatccgagctttttacgcccgaatgcaaatttaaagagagtgtgtttgaaaactattatgtcacgtactcgtccatgatttacaggcagcaacagtctggacggggttggtacttgggcctcaacaaagagggtgaaatcatgaaaggcaaccatgtgaaaaagaacaaacccgctgcccactttctccccaaacctttaaaggttgccatgtataaagagccaagcctccatgacctcaccgaatttagccgttcagggtccggcacaccaacgaaaagccggtcggtgagcggagtcctcaatggtggcaagagcatgagtcacaacgagagcacatag

SEQ ID NO: 4904 - DNA, 759 bp, Artificial Sequence
  Description of Artificial Sequence: Synthetic coding sequence
atggtcaaacctgtgcccctgtttcggagaactgattttaagcttctgctttgtaaccacaaggacctgttcttcctcagagtgtccaaattactggactgctttagccctaaatccatgtggtttctgtggaacattttctccaagggcacacatatgctgcagtgcctgtgtggcaaaagcctgaaaaagaacaaaaatcccacggacccccagctcaaaggaatcgtaacccgcctctattgtaggcagggctactacctacagatgcacccagatggggctctggacggaaccaaagatgactcaacaaattcgacactttttaatcttattccggttgggctgagggttgtggccatacagggagtgaaaactggactgtacatcgcaatgaacggagagggttacctttaccccagcgaactgttcaccccagagtgcaagttcaaggagtccgtgtttgagaattattacgtgatatattcatctatgctttatcgccagcaagaaagtggccgtgcatggtttttaggcctgaacaaagaagggcaggctatgaaaggcaacagagtaaaaaaaactaaacctgcggctcactttcttcccaagcccttagaggtcgctatgtacagagagccaagtctgcacgacgttggggaaactgtccccaaaccaggagtgacccccagtaaatctaccagcgcatcagccataatgaatggaggaaaacccgtgaacaagagtaagacaacctag

SEQ ID NO: 4905 - DNA, 744 bp, Artificial Sequence
  Description of Artificial Sequence: Synthetic coding sequence
atggccgctgccatcgccagtgggcttattcgccagaagagacaagcccgagaacaacactgggaccgcccttcagccagcagacggaggtcgtcaccatccaaaaatagaggcctatgcaacggtaatttagtcgacatcttctctaaagttagaatcttcgggcttaaaaagcgtcgactcagaaggcaagaccctcagctcaaggggatcgtgacccgactgtattgtcgccagggctattatctgcaaatgcacccagatggggctctcgacggcaccaaggatgattctaccaattctacactattcaatctgatacctgtcggccttcgcgtggtggccattcagggagtgaagacaggcctgtacatcgcgatgaatggcgaagggtacttgtatccgtctgagctcttcaccccagagtgcaagttcaaggagtcggtattcgaaaattattacgttatttacagcagtatgttgtacaggcagcaggaaagtggcagggcctggttcctgggattaaacaaagagggacaggccatgaaggggaatagagtgaaaaagaccaaacccgctgctcactttttgcctaaacccctcgaggtagcaatgtaccgagagccctcactgcatgacgtgggcgagactgttcccaagccaggtgtgactccgtccaagagtactagtgcctccgccattatgaacggtgggaagcctgtcaataagagcaaaactacatag

SEQ ID NO: 4906 - DNA, 351 bp, Artificial Sequence
  Description of Artificial Sequence: Synthetic coding sequence
tgaatattggagttcatatcacttgcagtaggcctgatttccatacgcggagtggactctggactgtatctggggatgaacgagcgcggtgagctttacggatccaagaagctgaccagggagtgcgtattccgcgagcagttcgaagagaactggtacaacacttacgccagcaccctctataaacacagcgattcggaacggcagtattacgtggctctgaacaaagacggatccccaagagaaggttatcggacaaaaagacaccagaaattcacccattttcttccaagacccgtcgaccctagcaaactacccagcatgagtagagatttgtttcattacagatag

SEQ ID NO: 4907 - DNA, 651 bp, Artificial Sequence
  Description of Artificial Sequence: Synthetic coding sequence
atgggggcagctcgcctgctgccgaacttgacattgtgtctgcagctcttgattctgtgctgccaaacccaaggggagaaccacccgtccccaaactttaatcagtacgttagggatcagggcgctatgactgaccagctgagtcgacgacagattcgggagtatcaactgtattcccgaacctcgggcaagcacgttcaggttacaggtcggaggatcagtgctactgcggaagacggtaacaagtttgctaagctaattgtggagaccgacaccttcggttctagggtacgcattaagggagcagagtctgaaaagtacatctgtatgaataagagagggaagcttatcgggaaaccatccggaaagtcaaaggactgcgttttcaccgaaatagttctggaaaacaactatactgccttccagaatgccaggcatgaaggctggttcatggccttcacccgccagggcagaccaagacaggcgtctcgctccaggcagaatcaacgcgaagctcattttattaaacgtctttaccagggacagcttccgttccccaaccatgcagagaagcagaaacagtttgaattcgttggtagcgccccaacacgccgtacaaagcgtactagacgacctcagcctctcacatag

SEQ ID NO: 4908 - DNA, 618 bp, Artificial Sequence
  Description of Artificial Sequence: Synthetic coding sequence
atgggagcagccagactgctgccaaacctgacattatgcctccagctcctgatcctctgttgccagacccagtatgtgcgcgatcagggcgcaatgaccgatcagctgagccgaaggcagatccgagagtaccaactctacagccgcacgtcaggaaagcatgttcaggtcaccggcagacgcatatcggcaacagctgaggacggcaataagttcgcgaagctgatcgtggaaactgatactttcggctccagagttcgcattaaaggcgctgagagcgagaagtacatttgtatgaacaagcgtggcaagctaattggtaagcctagtggaaagtccaaagattgtgtattcacagaaatcgtgttggagaacaactataccgccttccaaaatgctaggcatgaaggctggtttatggcttttacacggcagggacgaccacgccaggcctcccggtcaaggcagaatcaaagggaggcccatttcatcaagcgcctgtaccaggggcagcttcccttcccgaaccatgctgaaaagcagaaacagttcgaatttgtgggtagcgcccctactcggcgaacaaagcgtaccaggaggccccagcccctgacgtag

SEQ ID NO: 4909 - DNA, 624 bp, Artificial Sequence
  Description of Artificial Sequence: Synthetic coding sequence
atgtattccgcccctagtgcctgcacttgcttgtgtctgcactttctcttgctgtgtttccaagtccaggtgttggtggctgaggagaatgtcgattttcggatccacgtggaaaatcagactcgggctcgcgacgatgtgagccggaagcagcttaggctgtaccagctatacagtcgtaccagtggaaagcatatacaggtcctgggcagaagaatctccgcgaggggagaagatggcgataagtatgctcagcttctcgtcgagactgatacgttcggctctcaggttagaatcaaggggaaggagaccgagttctacctctgtatgaatcggaagggtaaactggtgggcaaaccagatggtactagtaaggagtgcgtcttcatcgagaaggtcttggagaataactatacagccctcatgagcgccaagtactctgggtggtatgtgggttttacgaagaaaggtaggccaaggaagggccctaaaacccgggagaaccagcaggatgtccactttatgaaacgatacccaaagggacagcccgagcttcaaaaaccttttaaatacaccaccgtgactaagagatcaagacggatcaggcccactcatcccgcttag

SEQ ID NO: 4910 - DNA, 651 bp, Artificial Sequence
  Description of Artificial Sequence: Synthetic coding sequence
atgcgcagcgggtgcgtcgtcgtacatgtatggatactggccggattatggctcgccgtggctgggagaccgctggccttttctgacgccggacctcatgtccactacggatggggggatcctattagactgcgtcacctctacacaagcgggcctcacggactcagtagttgcttcctcagaatccgcgctgacggcgttgtcgattgcgccagaggtcagagtgcacattctcttctggagatcaaagcagtggccctgcggaccgtagccatcaagggcgtgcacagcgtccgctacctgtgcatgggggctgatgggaagatgcagggtctgctgcagtactctgaggaagattgcgcttttgaggaagagatccggcctgatgggtacaatgtgtatcgatctgagaagcaccgactacccgtgtcattgtcttcggcaaaacagcgtcagctatacaagaacagagggtttttgcccctcagccacttcctgcctatgctgccaatggtccccgaggagcctgaggacctgcgtggccacctcgagtccgatatgttttcaagtcctctggaaacagactcaatggatccatttggtctggtcaccgggctggaggctgtgcgatctccgagttttgaaaaatag

SEQ ID NO: 4911 - DNA, 636 bp, Artificial Sequence
  Description of Artificial Sequence: Synthetic coding sequence
atggcccctctggcagaggtgggtgggttcttggggggtcttgaggggttaggccagcaggttggttcccactttctgttgcccccagccggagagcggccaccgctactgggcgagaggcggagcgctgccgagagatccgctcgaggagggccaggcgcagcccagctggcacacctgcacggaatcctccgcagaaggcagctgtactgcaggacaggctttcacctacagatactcccagacggaagtgtgcaagggacaagacaggatcattctttgttcgggattcttgagtttatctctgttgctgtgggtctcgtgagcataaggggcgtcgacagtgggctgtacctgggaatgaacgataaaggcgagctgtatggctctgagaagcttacctctgaatgtattttcagagagcagttcgaggaaaactggtacaacacctacagctctaacatttacaagcatggggacacagggagacgctactttgtggcactcaacaaggacggcactcctcgggatggtgccaggtccaagcgccaccaaaaattcacccacttcctcccacgccctgtggacccggagcgcgtgccagagctttataaggacttactcatgtacacatag

SEQ ID NO: 4912 - DNA, 237 bp, Artificial Sequence
  Description of Artificial Sequence: Synthetic coding sequence
atggctcccctggcggaggtgggcggatttctgggtgggctcgaagggctgggccagcaggtggggagtcatttcctgttaccccctgcaggcgagcgcccacctgccgctcttttgccccatcggttaccaccggcagatcccgctcgcaggcagcgggcagggcacccagcaggccctcagccgcttagatacctcggcatacatcaatgcggctccggtacaggccagtattag

SEQ ID NO: 4913 - DNA, 390 bp, Artificial Sequence
  Description of Artificial Sequence: Synthetic coding sequence
atgggcgatccagtcgtaactgagacccctacccttttaggtctgcctgagcaacggcgtgcagcagtacggcatgtaaataaaggcgctggcatcctagagattaggtctgtgcacgtgggcgtcgtcgtgatcaaggccgtgtcaagcggtttttacgtagcgatgaatcgccgaggccgtctttatgggtctaggctgtataccgtggattgccggtttcgggagagaattgaggagaacggacacaatacttacgccagtcagcgctggcgccgtagaggacagcctatgtttttagccctggaccgcagaggtggacctcgtccgggtggacgaactcgacggtaccatctgagcgcccatttcttgcccgtgctggtatcatag

SEQ ID NO: 4914 - DNA, 579 bp, Artificial Sequence
  Description of Artificial Sequence: Synthetic coding sequence
atgggcacgtggatcctgtttgcatgtctcgtgggcgcagcttttgcgatgcccctccccccacatccgggtcaccctggttatatcaacttttcatacgaagttctgactccactgaagtggtaccaatcgatgattcgacccccatattcctcttacgggtacgagccaatgggcggatggctgcaccaccagatcattccagtcgtatctcagcagcaccctctgacacacactctgcagagccaccatcatatccctgtggtcccagctcaacagccgagagtacgccaacaggcactgatgcctgtccccggtcaacagagtatgacccccacacagcaccaccaaccaaatttgcccctcccagcgcagcaacctttccaaccacagccagtgcagcctcagccacaccaacctatgcagccccagcctcctgttcagcccatgcagccactgttgcctcagcctccacttcctcctatgttcccactgagacccctcccgcctattctccccgacctgcacctagaagcctggcctgccacagacaaaacaaagcaggaggaggttgattag

SEQ ID NO: 4915 - DNA, 756 bp, Artificial Sequence
  Description of Artificial Sequence: Synthetic coding sequence
atgttaggcgctcggctccgcctgtgggtgtgtgccctgtgctccgtgtgctctatgtctgtcctaagagcctatccgaacgcaagtcccctgcttggatcctcttgggggggattgattcacctgtataccgccaccgccagaaactcctatcacctgcaaattcataaaaacggccacgtggacggagcaccgcaccaaaccatctattccgccctgatgattagatccgaggatgcgggattcgtggttataactggtgtgatgtcgagacggtatctatgtatggatttccgcggaaatatcttcggctctcactatttcgaccctgagaattgccgctttcagcaccagacactggaaaatggttatgatgtataccactctcctcagtaccactttctcgtgtcgctcggaagagccaaaagagcctttctgcccggtatgaatccaccaccatattcacagttcctgagtcgtagaaatgaaattcctcttattcactttaatacccctatcccgaggcggcacactcgctctgcggaagacgatagcgagcgagaccccctgaacgttttaaagcctcgggctcggatgactcccgctccagcaagttgcagccaggagctccctagcgcagaggataactctcccatggcatccgacccccttggggtcgtgcgtggaggcagggtcaatacgcacgcaggaggtactgggcctgagggatgcagaccctttgccaaattcatctag

SEQ ID NO: 4916 - DNA, 720 bp, Artificial Sequence
  Description of Artificial Sequence: Synthetic coding sequence
atgggactgatatggctgttgctgctcagtctgcttgagccaggctggccagctgcaggacccggagctagattacgacgagatgcaggcggacgaggcggagtctatgagcacctgggcggagccccaagacggaggaaactgtattgtgcaacgaaatatcacttgcagttgcacccatctggtcgggtcaacggttctttagaaaattcagcttacagcatcctggagattaccgcagtggaggtagggatcgtggctatacgcggactgtttagtggtaggtatctcgccatgaataaacggggtagactttacgcctcagagcactatagcgccgaatgcgaattcgtcgaaaggatccatgagctggggtataatacttacgcttccagattgtacagaacagtctcttcaacacctggggctcgacggcagccttccgcagaaaggctgtggtacgtgtcagttaacggcaaggggagaccacgacgagggttcaagacccgcaggactcagaaatcctcactcttcctacctagagtgctggatcaccgggatcatgagatggtgcggcaattacaatccggcctgcctcggccacccggaaagggcgtgcagcctcgcaggagacgtcagaaacaatcaccagataatctggaacccagccacgtgcaggcttcacgcctgggctcacagttggaggcttctgcgcattag

SEQ ID NO: 4917 - DNA, 621 bp, Artificial Sequence
  Description of Artificial Sequence: Synthetic coding sequence
atgtccggtcctggcacagctgcagtagcactgttaccggctgtactgcttgccctgcttgccccttgggctggtagggggggtgctgccgctcccaccgcaccaaacgggacactcgaggcagagctcgaacgcagatgggaaagcctagtggctctgtctcttgcccgtttacccgtggcggcacagcccaaagaggccgctgtgcagtcaggggctggggactatttactgggcatcaaacgtctacggcgactgtattgcaacgttggaatcgggttccatctgcaggctcttccagatggcagaataggtggagcccacgctgacacacgggacagcttgctggaactgagcccggtcgagcgaggagtggtgtctatctttggggtggctagccggtttttcgtcgctatgtccagcaaaggcaagctatatggaagccctttttttacagacgaatgcacttttaaagaaatccttctgccgaacaattataatgcatacgagtcgtataagtatccaggaatgtttatcgctctctcaaagaacggcaaaaccaagaagggcaaccgcgtttccccaaccatgaaagtcactcactttttgcctaggctctag

SEQ ID NO: 4918 - DNA, 807 bp, Artificial Sequence
  Description of Artificial Sequence: Synthetic coding sequence
atgtctttgtcttttttgctgttgctcttcttttctcatctaattttatcagcctgggcccacggagagaagaggcttgccccaaaggggcaaccagggcctgccgctacagaccgaaacccaaggggaagttccagccgccagtccagttcctccgcgatgtcatcaagcagcgcttcgtctagtcccgctgcgagcctggggtcacagggcagcggactggagcagtcctctttccagtggagcccttcaggacgtaggacaggcagcctgtattgcagagtcggtatagggttccatctacagatctatcccgacggcaaggtcaacggaagccacgaagcaaacatgctgagcgtgctggagatttttgccgtgtcgcaaggtatagtgggaatccgcggagtattctctaacaagttcctagccatgtctaaaaaaggtaagctgcacgctagcgccaaattcaccgatgactgtaaattcagagagaggtttcaggagaattcatataacacctacgccagcgctatccatagaacagagaagaccggtcgcgagtggtatgtggcgctgaataaaagaggcaaggctaaaagaggctgctcaccgagagtaaagccccagcatatctctacacacttcctgccaagatttaaacaaagcgaacaacccgaactctcatttacagtgactgtgcctgagaaaaagaagcctccctctcccatcaaacccaagattccattgtctgctccacgtaagaatacaaacagcgtgaagtaccggttgaaattcagattcgggtag

SEQ ID NO: 4919 - DNA, 372 bp, Artificial Sequence
  Description of Artificial Sequence: Synthetic coding sequence
atgagcctgtcctttttgctgctgctgttcttttctcacctgatactgtctgcttgggcacatggcgaaaagagactggccccaaagggccagccaggtcctgctgctacggatcgcaacccacggggtagtagctccaggcagtccagctccagcgctatgagttcctccagtgcttcctcttctccggctgcttctcttggttcacagggctctggactcgaacagtctagcttccagtggtctccatcggggagacgaactggctctttatattgccgggttggcatagggttccatcttcagatttatcccgacggtaaagttaacggatcgcacgaggcaaatatgttgagtcaggtccatcgctag

SEQ ID NO: 4920 - DNA, 855 bp, Artificial Sequence
  Description of Artificial Sequence: Synthetic coding sequence
atgccaaggtacgcccagctggtgatggggcctgcgggaagtggtaagtcaacctactgtgctacaatggtgcagcactgcgaggcactcaatcggtctgttcaggtggttaacctggaccccgcagccgagcatttcaactacagcgtgatggcagatatccgagagctcattgaggtagatgacgttatggaggacgattcgttgcgattcggacctaacggcggactagtattttgcatggagtacttcgccaacaacttcgattggctggaaaattgcttgggtcatgttgaggacgattacatcctgtttgactgcccaggccaaatcgagctttacacgcacctgccagtcatgaaacagctggtacagcagctggagcagtgggagtttagagtttgcggggttttcttggtggactcccagttcatggtggaatccttcaagtttatttcaggcatcctcgccgctctgagtgccatgatttccctggagattccccaagtgaatattatgacaaagatggatctgttatcgaagaaagctaaaaaagaaatcgagaagttcctggatcccgatatgtacagtctccttgaggacagtacatctgacctgcgatccaagaaatttaagaagttaaccaaagccatatgcgggctcatcgatgattatagcatggttagattcctgccatacgatcagtcagacgaagagtccatgaatattgtgttgcagcacatagactttgctatacaatacggcgaggacctggaattcaaggaaccaaaggaacgagaagatgaatctagcagcatgtttgatgaatacttccaagagtgtcaagacgagtag

SEQ ID NO: 4921 - DNA, 735 bp, Artificial Sequence
  Description of Artificial Sequence: Synthetic coding sequence
atgggctctccacgttcagccctgagctgcttgctcctccatctcctggtgctgtgcctacaggcccaggaaggacccggacgcggaccagctctgggccgagaactggcatccctgtttagggctgggagggaaccccagggtgttagccagcaggtgacagttcagtcctccccgaatttcacacagcatgtgcgggagcagtcgttggtaaccgatcagctgtcccgcaggcttataagaacttaccagctctatagccgtacttccgggaagcacgtgcaggtgcttgcaaataagcggattaatgctatggcagaagacggggacccctttgccaagcttatagtcgaaacagatacgtttggttcaagagtgagggttcggggagcagagaccggcttgtatatttgcatgaataagaagggtaagctaattgctaaaagtaacggcaagggcaaggattgtgtgttcaccgagatcgtgttagagaacaactataccgccctgcagaatgcaaagtacgaaggctggtatatggcattcacaagaaaagggaggccacggaaagggtcaaagaccaggcagcaccagagagaagttcattttatgaaaaggctccctcgcggtcaccacactactgaacaatctctacgcttcgaattcctcaattacccgccttttacccgcagcctgaggggctcacagaggacatgggcccctgagcctaggtag

SEQ ID NO: 4922 - DNA, 702 bp, Artificial Sequence
  Description of Artificial Sequence: Synthetic coding sequence
atgggaagccctcgctctgccctttcctgcctcttgttacatctattggtactgtgtttacaggcgcaggaggggcctgggagaggacctgctctgggtagggagcttgcgtctttattcagagccggacgggaacctcagggagtctctcagcaacacgtacgggagcagtcgctcgttactgaccagctctcacggaggcttatccgcacatatcagttgtatagcagaacctctggaaagcatgtgcaagtgttagcaaataagcgcattaatgccatggcggaggatggagatcccttcgcaaaattgatcgtggaaacagatacatttggatcccgtgtccgggtgaggggggctgagaccggtctatacatttgcatgaataaaaaggggaaacttatagcgaaaagtaacgggaagggaaaggactgtgtgttcacggagatagtgctcgaaaataactacaccgccctgcagaacgcaaagtacgagggctggtacatggccttcacaagaaagggcagaccacgcaagggctcaaaaactcgacagcaccagcgcgaagtgcacttcatgaaaagattgcccaggggccaccacaccaccgaacaatcgttacgcttcgagttcctgaactatcccccttttacgcgaagtcttcgtgggtcgcagcggacatgggcacctgaacctcgatag

SEQ ID NO: 4923 - DNA, 615 bp, Artificial Sequence
  Description of Artificial Sequence: Synthetic coding sequence
atggggtcaccacggtcagccttgtcttgtctgttgctgcatctgctggtgctgtgccttcaggctcaacacgtccgggagcagagtctggtcacagatcagttgtcaaggcgtctgattagaacctatcaactgtattccaggacatcaggaaagcacgtgcaggtgctcgcgaacaaaagaataaatgccatggcagaagatggggatcctttcgccaagctgattgtagaaactgataccttcggctccagggtccgggtgaggggggcagagacaggcctttacatatgtatgaacaagaaggggaagttaatagcaaagtctaacgggaaagggaaagactgcgttttcacagaaatagtcctggaaaacaactacactgcccttcaaaacgcgaagtacgaaggatggtatatggctttcacccgaaaaggcaggcccaggaagggcagcaaaactagacaacaccagagagaagtccatttcatgaaacgcctgccaagggggcaccacacaactgaacagagcctccggttcgaatttctgaattacccacctttcactcgctccctaagaggatctcaacgcacttgggccccagagccacggtag

SEQ ID NO: 4924 - DNA, 648 bp, Artificial Sequence
  Description of Artificial Sequence: Synthetic coding sequence
atggggtcacccaggagtgccttaagctgcctgctcttgcacctactggttctttgcctccaggcccaggttacagtacagtcttcccccaattttactcagcacgtacgcgaacagtctctcgtgactgatcaactgtcgcgccgtctgattcgcacctaccaactttatagccggacaagcggaaaacatgtgcaggtcttggccaacaagagaatcaatgcaatggctgaggacggcgatccattcgcgaaactcatcgtggaaactgataccttcggatccagagtgcgagtgcgcggtgccgaaacaggattatatatctgcatgaacaaaaagggaaagttgattgccaagagcaatgggaagggaaaggattgtgtctttaccgagatcgtgctggagaacaactatactgctcttcaaaatgctaaatacgagggctggtacatggcattcactagaaaaggaagaccgcgaaagggctccaaaacccgacagcaccagcgagaggtacacttcatgaagagattgcccagagggcaccatacaacagagcaaagtttacggtttgagttcctgaattacccacctttcactcggagcttgcggggtagccagcgtacctgggcgccagagccaagatag

SEQ ID NO: 4925 - DNA, 627 bp, Artificial Sequence
  Description of Artificial Sequence: Synthetic coding sequence
atggcgcctctgggcgaagtgggaaattacttcggagtacaggacgccgtcccatttggtaacgttcctgtgctgcccgtcgattctcccgtgctcctgagtgatcatttgggtcagtcagaggctggaggcctacctaggggcccagccgtgacagatctggatcacttgaagggcatcctgcgcagacgccaactgtattgtcgcacaggctttcacctagagatctttcctaacggcacaatccagggaacccgaaaggaccactcacggtttggcatcctcgaattcattagtattgccgtaggactggtgtcaatccgaggcgtggattccggcctgtatttgggcatgaatgaaaagggcgagctgtatggttcggagaaattaacacaggaatgcgttttccgagagcagttcgaggaaaactggtataacacatacagttctaatctgtacaagcacgtggacaccggcagacgctattacgtcgccctgaacaaagacgggacgccgcgtgagggtacccgaacaaagcgccaccagaaatttacgcattttctcccaaggcctgtcgaccctgataaggtccctgagctttacaaagatatcctttctcagagctag

SEQ ID NO: 4926 - DNA, 7175 bp, Artificial Sequence
  Description of Artificial Sequence: Synthetic coding sequence
atgactgacctcctccgctctgtggtcaccgtgatcgacgtattctacaaatataccaagcaggatggtgagtgtggtacgctgagcaaaggggaactgaaagaactgctggagaaagaattacatcctgtcctcaagaacccagacgatcctgacactgttgatgtgattatgcacatgcttgatagagaccacgatcggcgtctggattttaccgaattcctcttgatgattttcaagttaactatggcctgcaataaggtgctgagcaaagaatattgcaaggcatccggctcgaagaagcaccgacggggacaccggcatcaggaagaagaaagcgagacggaggaagacgaggaagataccccaggccataagtccggttaccgtcacagctcttggtccgagggggaagaacatggttactcgtctggacactctcgagggacagtgaagtgccggcacggctcaaattccaggcgcttaggaagacagggtaacctctcatcatctgggaatcaggaggggagccagaaacgttaccaccgatcttcgtgtgggcacagctggtctggtggtaaagaccgccacggctcctcttcagtagagttgcgagaacgaattaataaaagccatataagtccctcacgggaatctggggaggagtacgagagcggctctgggagtaactcttgggagaggaaagggcatggagggcttagctgcggactggaaacatcgggacacgagagcaacagcacacagtctaggatacgggagcagaaactcggctcatcatgttcgggatcgggagacagcggacgaagaagccacgcttgtggctactccaattccagcggctgtggaaggccgcaaaacgcttctagctcctgccagtctcacaggttcggtggccagggcaatcagttctcttacatccagagcggctgtcagagcggaattaagggcggacagggccatggctgcgtgtcaggagggcagccctccggatgcgggcagccggaatccaatccatgttctcagtcatattcccagcgcggttacggcgctcgagaaaacgggcaacctcagaactgcggcggacaatggcggactggcagttcccagagctcatgttgcggtcagtatgggtctggagggtcacagagctgcagtaacggacaacacgagtatggctcctgcgggagatttagcaactcatcttcctctaacgaattctccaaatgtgatcagtatggctctggcagttctcagtccactagtttcgaacagcacgggaccggtctcagccagtcctcaggattcgagcagcatgtttgtggctcgggccagacctgtggacagcacgagtccacgagctctcagagcctcgggtatgatcagcacggtagcagctccgggaaaacatctggcttcgggcagcatggcagcggttcaggacagagcagtgggttcggtcaatgcgggagcggcagtgggcagagctctggtttcggccagcacgggtcagtgtccgggcaatcaagcggcttcggacagcacgggagcgtttcgggccagtcaagcgggtttgggcagcatgagagcaggtctagacagtccagttacggtcaacacgggagcggcagctcccaatcatccggctatggacagtatggtagccgagagacttctggcttcggccagcacggcctcggctctgggcaatcaacaggttttggtcagtatggatcaggctcaggccagagctccggattcggccaacatggctctggcagcgggcagtcctcaggtttcgggcaacatgaaagtagaagcggacaatcatcatacgggcaacactcatcaggttcatctcagtcttccggctacggtcagcatggaagtaggcagaccagtggttttggacaacacggttcgggatcgagtcagagcacagggttcggtcagtacggcagtggctccgggcagtcttctggatttggccagcacgtgtccggtagcggccaatctagtgggttcggccagcacgaatccagatccggccattcctcctatgggcagcatggctttggctctagccaatcttcaggatacggacaacatgggtcttcaagtggtcagacctccggctttggccaacacgaactgagttccggacagtcttcttccttcggccagcatggatcaggctctggccaatcttccggtttcgggcaacatgggtcgggaagtggtcagtcttcaggattcggtcaacacgagagtcggtccggccaatcctcttatggacaacattcaagtggaagcagtcaatccagtggctacgggcagcatgggagcaggcagacgtcaggattcggccagcacggctcaggaagctcgcagtctaccggattcgggcaatacggatcggggtctgggcagtccgctggcttcggacagcatggctcggggagtggtcagtcatccggatttgggcagcatgaatctagaagccaccagtcctcctatgggcagcatggttccggatcatctcagagcagtgggtatgggcagcacggcagcagcagtggacagacctccggattcggtcagcacaggtcttcatctgggcagtactcaggttttggtcagcatggctccggatctggccagagctccgggtttggccagcatggaaccggttccgggcagtactcaggattcggccagcacgagtcgcgctcacaccagtcaagctacgggcaacacggctccgggagtagccagtcttctggatacggtcaacacgggtcgagctccgggcagacttttgggttcgggcagcatcgcagtggatccgggcaatcatccggattcggccaacacggtagcggctcagggcagtccagcggctttggtcagcatgagtcaggatccggtaagagttctgggtttggtcagcacgaatcaaggtcaagtcaatctaactacggacagcacggctctggcagttcccagagctccggatacggacagcatggaagcagctcggggcagacaaccggcttcgggcagcacagatcaagcagcggccagtacagtgggtttggtcagcacggctcaggatcagaccaaagtagtgggtttgggcagcacggcactggttccgggcagagcagtgggtttggtcagtacgaatctaggtctcgacagtcgtcttacggacagcatggcagcggatccagccaaagttctggctacggacaacacggctcaaactcagggcaaacttccggcttcggacagcatagacccggaagcggtcaatcatccggctttggacagtatggatccggtagtgggcagagttcagggtttggtcagcacgggtctggaaccggaaagtcttccggttttgcccagcatgaatatcggtcaggacagtcgtcctatgggcagcacgggactggttcatcccagagttctggatgcggtcagcacgagagcggcagcggcccaacaacatcattcggccagcatgtctccgggagcgacaacttctctagctccggacagcacatcagcgactcgggtcagagcaccggcttcgggcagtacggctccggcagcggccaatctaccggcctgggacaaggcgagagccagcaggtcgaatctgggagtaccgtgcatggacggcaggagaccacccacggccagaccattaataccaccagacatagccagtcaggacaggggcaatcgacccagacaggatcacgcgtcactcgtcggagaaggagtagtcaatctgaaaattccgactccgaagtgcatagtaaagttagccaccggcacagtgagcacatccacacccaagcgggatcccattacccaaagtcgggatccacagtgaggcggcgacaaggtactacacatggccagagaggcgacaccaccaggcatggacactccggacacgggcagtccactcaaacaggctcccgtaccagcggtcggcagcgctttagtcactcagatgccactgattcagaggtgcattctggggtatcacataggccacacagccaggaacagacacacagtcaagccggatcgcaacacggtgagagtgaatcaacggtccatgagagacacgagaccacttatggccagactggtgaggcaaccggacacggacatagcggacatgggcaaagcacgcagcggggtagtaggaccaccgggaggagaggtagcgggcattcggagtccagtgattcagaggttcatagcggtggctctcatcgcccacagtctcaggagcaaacacatggacaggctggatcccaacatggggagtccggctcgacggtgcatgggcgtcatggcacaacccacggccagacgggtgacactacgaggcacgcccattatcatcacggtaagtctacccagcggggttctagtaccacgggacggagaggtagcggccatagcgaatcttccgacagtgaggtgcattccggaggatcacatacgcattcagggcatactcacgggcagtctggctcccaacacggagaatcagagtcaattatccacgaccgtcaccggatcacccatggccaaactggtgacacaacaaggcactcatacagcggccatgagcaaactactcagaccgggtcgagaacaactggacggcagagaacatcacactccgagtctactgattctgaggtgcactcaggcggatcccataggccccactcacgcgaacacacctatggacaagccggaagtcaacacgaggaacccgaattcactgttcatgaacgccacgggaccactcacggacaaatcggcgacaccactggccattcacactctggacatggacagtccacccagagagggtcacgaacgactgggaggcaaagaagcagtcattccgagtcatctgattctgaggttcactccggcgtttctcatacccatacaggacatacccatggacaggccggtagtcagcacggccagtctgaaagtatcgtccctgagaggcatggcactacacacggtcaaacgggagataccactcggcatgctcactaccatcatggtctgacaacgcagaccggctctcgtaccactgggcgtcgcggatctggccatagtgagtattctgattcagaagggtatagcggggtgtcacacacacactccggccatactcacgggcaggcccgatcgcagcacggggaaagtgagagtatcgttcatgaaagacatgggaccattcacggccaaactggggatacgactcggcacgctcatagtggacatggacaatccacccagaccgggagccgaacaactggccgacgaagcagtggacatagcgaatactcggacagcgaggggcacagcgggttcagtcagcggcctcactcacgcggtcatacacatggacaggctgggtcccagcacggcgagagtgagagcattgtcgatgagcggcacggtaccacccatggccaaaccggggacaccagtggacactctcagagcggccacggacaatccacccaatctggtagctcaacgacagggagacggcgttccggccattccgagtcatctgattctgaggtgcatagcggcggttcacacacccatagcggccatacccacagccaagccaggtctcagcacggtgagtctgaatcaaccgtgcacaagcggcaccagacaacacatgggcagacaggcgacacaaccgaacatggccatcccagtcacgggcaaacaattcagacaggctcccgaacgacaggccgaaggggttccggtcattctgagtatagcgacagcgaaggtccttctggagtgagtcatacccactccggtcatacacacggccaggctggatctcattacccagagagcggctcatccgtgcacgagcgtcatggaaccacacacgggcagacagcagataccaccaggcacggacattcagggcacgggcagtccacccagagagggtcccgaaccactggtagaagggcatcggggcacagcgaatatagtgatagtgagggccattctggggtttcacacactcactccgggcacgcgcacggacaggcaggtagccagcatggcgagagcggctctagtgtccatgagcggcatggaacaactcacggtcagactggtgataccaccaggcacgcccacagcgggcatgggcagagcacgcagcggggtagcaggactgccggtcgtcgcggttctgggcacagcgagagcagtgactccgaggtgcattccggagtgagccatacccattccggtcacacatacggtcaggcgcgaagccaacacggagagagcggtagtgctattcatgggaggcagggtaccattcatggccagaccggagacaccacaagacacgggcagtctggacatgggcagagcacacagaccggtagtagaacaacaggcagacaaagatccagccattctgaatcttcagactccgaggttcactccgaggcatccccaactcattccggccacacacactcacaggcaggctcccgccatggtcaaagtggttcatccgggcacggcagacagggcaccacacacgggcagaccggagacaccaccaggcacgcccactatggctatggccaatctactcagagggggtccagaactacaggcaggcgtggatcaggacattctgaaagttcagattctgaggtgcactcctggggtagtcacacccactctggccacatccaaggacaggcgggtagccaacagcggcagcccggttcaactgtgcacgggaggctcgagacaacacacggccaaacaggggacacaactaggcatgggcatagcggttacggtcaatctacccagacgggatcgcggagcagcagggcctcccactttcagtctcatagcagtgagcgccaaagacatggctccagtcaggtttggaagcacggatcgtacggtccggctgagtacgactacgggcatactgggtatggcccatccgggggatctcgtaagtcaattagcaattcccaccttagctggagcaccgattccactgctaacaagcagctatcccgccacta

SEQ ID NO: 4927 - DNA, 2856 bp, Artificial Sequence
  Description of Artificial Sequence: Synthetic coding sequence
atggctaccggtaccggcaagcacaaactcctctctacgggccctaccgagccttggtctatcagagagaagttgtgcctagcgagctcagtgatgagatccggcgaccagaattgggtgagcgtctcacgggcaatcaagccattcgcggagcctgggcgtcccccagactggtttagtcaaaaacactgcgcctcccagtatagtgagttgctggaaaccacggagacaccaaagagaaaacggggagagaagggcgaggtcgtcgaaaccgtagaagatgtgattgtacggaaactgaccgccgaacgcgtggaagaactcaaaaaggtgattaaggagactcaggaacgctacagacgcctcaaacgagatgcagagctgatacaggctggacacatggactcacgcttggatgaactgtgtaatgatatcgcaaccaagaagaaacttgaggaggaagaggccgaggtgaagcgcaaggccaccgacgcagcttaccaggcccgacaggccgtcaaaactccaccaagaagattgcctaccgttatggtgcgttcacccatcgattccgcttccccaggcggagattacccactcggggaccttacacccacaacgatggaagaagcaactagcggcgtaactccaggcaccctgcccagcaccccagtcacttccttccccggtattccagacactttgccaccgggtagcgctcctctggaggcccctatgacaccagtaaccgacgattccccgcaaaaaaagatgttgggccagaaagcgactccaccaccatcaccccttttgtctgagctgcttaagaagggctccttgcttcccacaagtcccaggttagtgaacgagagtgaaatggccgttgcttcagggcacctgaattccactggggttctgttagaggtaggcggtgttttacctatgatccacggcggagaaatccagcagacgccaaacactgtggctgcctccccagccgcatcaggcgctcctaccctgtcacggctcctggaggcgggacctacgcagtttacaacccccttagcctcttttacgacagtggcctccgaaccccctgttaaactggtgcccccaccagtcgaatccgttagtcaagcaacaatcgtgatgatgcccgcactgcctgccccttcatccgctcccgctgtgtctactaccgaaagtgtggcccctgttagccagcctgataactgtgtgcccatggaagccgttggggatccgcatacagtgacggtgagtatggactcctctgaaatttccatgatcattaatagcatcaaagaggagtgctttcgcagcggcgttgccgaggctccagtagggagcaaggcgccatcaatcgacgggaaggaagagctcgacctcgccgagaagatggacatcgctgtgtcatacacgggagaggaactggacttcgagaccgtgggggacatcattgctattatagaagacaaagtggatgatcaccccgaagtccttgatgtcgcagctgtggaggctgctttgagcttttgcgaggagaatgacgatccacaaagcttgcccggaccatgggaacacccaattcagcaggagcgcgataagcctgtgccgttaccggctccagagatgacagtgaagcaggagcgcttggatttcgaagaaactgagaataagggcatacacgagttggtggatatcagagagccgagcgctgagattaaggtcgagcctgcagagcccgaacccgtgatcagtggcgctgaaattgtcgcgggagtcgttccagctacgtccatggaaccaccagagctgcggtctcaggacctggatgaagaactgggcagtaccgcagctggcgagatcgtggaggcagatgttgcaattggaaagggggatgagactcctctgaccaatgtgaagacagaggccagcccagagagtatgcttagccctagtcacgggtcaaacccaatagaggacccgctggaagctgaaactcagcacaagtttgaaatgagtgactcccttaaggaagagtctggaaccatattcggcagccagatcaaggacgcaccaggcgaagacgaggaagaagatggcgtgtccgaggccgcttccctcgaagagccaaaagaagaagaccaaggggagggctatctttcggagatggataatgagccgcctgtgtccgagagcgacgacggcttctcaatccacaatgcaacccttcagagccatacactggcagacagtatccccagttcccccgcaagctcacaattctctgtctgcagcgaagaccaagaagctatacaggcccagaagatctggaaaaaagccataatgctcgtgtggcgggctgccgcaaaccaccggtatgctaacgtatttctgcagcctgtgacagacgatatagcccctggataccatagtattgttcagagaccgatggacctgagcaccattaaaaagaatattgagaatggtctgatacggtctacagcagaatttcagcgagacatcatgctgatgtttcagaacgcggtgatgtacaacagcagcgaccacgacgtgtatcatatggcggtcgagatgcagagagacgtgctggagcaaattcaacagtttctcgccacacagcttattatgcagactagtgaatccggaatctcagctaagtcactgagaggtcgggactccacacggaaacaagacgcttcagaaaaggattcagtacctatgggcagtcccgctttcctgctcagccttttcgatggaggaacaaggggcagaagatgtgccatcgaagctgatatgaaaatgaaaaagtag

SEQ ID NO: 4928 - DNA, 627 bp, Artificial Sequence
  Description of Artificial Sequence: Synthetic coding sequence
atgaagttattgcctagcgtcgtgctgaagctgttcctcgctgctgtgctttcggccttggttacgggcgagagcctggagcgcctcaggaggggactcgcggctggaacaagcaacccagacccgcctactgtctcaaccgatcaattgctgcccttagggggaggcagagacaggaaggtacgggatctgcaggaggccgatctcgatctgttgcgcgtcactttgagttccaagccccaggcgctggctaccccaaataaggaggagcatggaaaacgcaaaaagaagggaaaggggctgggaaagaaaagagacccatgcctcagaaagtacaaggacttttgtatccatggggagtgtaagtatgtcaaggagctcagagccccatcctgcatctgtcaccccggatatcacggtgagcgttgccacggactgtcccttcctgtggagaacaggctgtatacctacgaccacaccacgattttggctgtggttgcagtagtattgtcctccgtttgtctgctggtgatcgttggattgctgatgttcagataccaccggagggggggatatgacgtcgagaatgaggaaaaagttaaattaggtatgacaaattcccattag

SEQ ID NO: 4929 - DNA, 1128 bp, Artificial Sequence
  Description of Artificial Sequence: Synthetic coding sequence
atggctgtgaccgaagcctctcttctgcgccaatgcccacttctgttgccccaaaatagaagcaagactgtatatgagggttttatctccgcacagggcagggattttcatttgcgtattgttctgcctgaagacttgcaactgaaaaatgccaggctactgtgtagctggcaactgagaaccatcctgtctggctaccataggattgtgcaacaaagaatgcagcattctcccgacctgatgtcattcatgatggagctcaaaatgctcctggaagtggcactcaaaaaccgtcaggaactgtatgcgctgcctcccccacctcagttctacagtagcctcattgaggaaattgggacccttggctgggataaattggtctatgccgatacctgttttagcactataaaattgaaggctgaggacgcgtccggtcgggagcacctgataactctgaagttgaaagctaagtaccccgcagagtcacccgattattttgtggacttccccgtaccattttgtgcgagctggaccccgcaatcaagtctcatctccatctactcccagtttctagccgctattgagagtctgaaggccttttgggacgtgatggacgaaatcgatgaaaagacctgggtgctagaacctgaaaaaccacccaggagtgctacggcgaggagaattgcgctggggaacaatgtcagcatcaatattgaagttgacccgagacaccctactatgctccctgaatgcttttttctgggggctgatcatgtggtgaaacccttggggatcaagctctccaggaatattcatctatgggaccccgagaattccgtcctgcagaacttgaaagatgtgctggagatagatttccctgcacgggctatcttggagaagtcagatttcacaatggattgtgggatctgttacgcatatcagttggatggaacgatccccgatcaagtatgcgacaactctcagtgtggacagccctttcaccaaatctgcttatatgagtggttacgtggactactcacctcccgccagtctttcaacataatcttcggcgaatgtccctactgctccaagcccatcaccctgaagatgagcgggcgaaagcactag

SEQ ID NO: 4930 - DNA, 723 bp, Artificial Sequence
  Description of Artificial Sequence: Synthetic coding sequence
atgacaccacatcgcttgcttcctcccctgttgctcctgctcgctttgctccttgccgcaagcccaggcggagcattggcccgatgtccaggttgcggacagggagtgcaggctggttgtccaggtggttgtgttgaggaagaggacgggggatctcccgcagaagggtgtgccgaagctgaaggctgtttacgtcgcgaaggccaagagtgcggcgtgtacacacctaattgcgcaccaggtctacagtgtcatcccccaaaggacgacgaggcccctctccgagcactgctgctgggaagagggaggtgccttccagctcgagccccagccgttgcagaagagaatcctaaggaatccaagcctcaggctggcactgccagacctcaagatgttaatcggagagaccagcaacgaaatcccggaactagtaccactccgagccagccaaatagtgccggagtgcaagatacggaaatggggccatgccggcgacatctggactccgtcttgcagcagctgcagacagaggtgtatcggggtgctcagactctgtatgtccccaattgcgaccaccggggattctatcgcaaacggcagtgtaggagctctcaggggcagcggagaggcccatgctggtgcgttgatagaatgggcaagtctctgcctgggtcacccgatggaaacggcagctcttcctgccccaccggctctagcggttag

SEQ ID NO: 4931 - DNA, 411 bp, Artificial Sequence
  Description of Artificial Sequence: Synthetic coding sequence
atgactccccataggctgctgccacctctgctgctcttactcgccctactgttggcagcttcccccggtggggcattagcccgttgccccggttgcggtcagggggtgcaggccggttgtccagggggttgtgtcgaagaagaggacgggggaagccccgcagaaggatgtgctgaggccgaaggatgtctgcgacgcgagggccaggagtgtggggtttacacccctaattgcgcacctgggctgcagtgccacccgccaaaagatgatgaagcccctttaagggccctgctcttggggaggggacgttgtttacccgcaagggctcctgccgtgctttcctcccctcggaccctacgcaaactttccccggaacccggtgcaacgtgttcatgcagaggcgaatcgtag

SEQ ID NO: 4932 - DNA, 717 bp, Artificial Sequence
  Description of Artificial Sequence: Synthetic coding sequence
atgactccccatcgactgcttcctcccctgctcctcctccttgcactcctattggccgctagtcctgggggtgcactggctcggtgcccaggatgtggacagggcgtgcaggccggatgcccagggggttgtgtcgaggaggaagacggcggttcgccagcagaagggtgtgctgaggcagaaggatgccttcgcagagagggacaagagtgtggagtgtacacgcctaactgtgcccctggcttacagtgccacccgccaaaagacgatgaggcccctttgcgcgcactgctgctaggcaggggcagatgcctgcctgctcgcgctcctgcggaggaaaacccaaaggaaagtaagcctcaggccggaacagcaagaccgcaggatgtaaatcgacgcgaccaacagcggaaccccggaactagcaccaccccaagccagccgaacagtgctggggtccaggacacagagatggggccatgccggcgtcaccttgatagtgtcttacagcagctccagactgaggtatacaggggcgctcagacgctgtatgtgcctaactgtgaccatcgcggtttttatcgaaaacgccagtgtcgaagcagtcagggacaaaggagagggccatgctggtgcgtggaccggatgggcaagagcctgccaggttcccctgacggaaacgggtccagttcctgtcctacagggtccagtggatag

SEQ ID NO: 4933 - DNA, 837 bp, Artificial Sequence
  Description of Artificial Sequence: Synthetic coding sequence
atgcctaggctgtctctcctgcttccactgctgctgctgctgctgctccctctgctgcccccactgtccccatcgctcgggattagggacgtcgggggtcggaggcccaaatgcggaccctgccggccagaggggtgtcctgctccggcaccttgtcccgcacctgggataagcgcacttgatgagtgcggttgctgtgcacgttgtttgggtgcggagggtgcttcctgcggcggaagagctggagggagatgcgggcctgggttagtctgtgcgtcccaggcagctggtgcggctcctgagggtactggcctatgtgtctgtgcccagagagggacagtgtgtggttctgatggtaggagctacccaagcgtctgtgctctgcgcctgcgggcacggcatactccacgcgctcacccaggacaccttcacaaagcacgagacggcccatgcgaattcgctcctgtggtagtcgtcccaccacgatccgtacacaacgtaacaggggcacaggtaggcctaagctgtgaagttagggccgtgcccactcctgtgattacctggcgcaaggttaccaaaagcccagaaggtacccaggccttggaagagctgccaggcgatcacgtaaatatcgctgtacaggtgaggggcggaccatctgatcacgaggccactgcatggatcctaatcaatccgctgcggaaagaagacgaaggagtgtatcagtgccacgccgctaatatggtgggcgaggccgagtcgcatagcaccgttaccgtgctggacctgagcaagtaccgctccttccacttccccgcacctgacgataggatgtag

SEQ ID NO: 4934 - DNA, 459 bp, Artificial Sequence
  Description of Artificial Sequence: Synthetic coding sequence
atgtgctctctgcccatggccagatactatataagtttcctgcccgaacctttgccagctaaatctctgcagcacggcgtgcctttgtccctggacagcagtctatcttcccttttggagaaaatctgtatcctgcccaaccgaggcttggctcgcaccaaagtcccaatttttctaggtattcagggtggtagccgttgtcttgcgtgcgtggaaactgaagaggggccatcgttacagttagaagatgtgaacatcgaagagctctacaaaggaggcgaggaagccacccgattcactttctttcagtccagctcggggtcagcctttagacttgaagcagccgcttggcccggttggttcctttgtggacccgcagagccacagcagccagtacagttaaccaaggagagcgagccatccgccagaacaaaattctatttcgagcagagttggtag

SEQ ID NO: 4935 - DNA, 459 bp, Artificial Sequence
  Description of Artificial Sequence: Synthetic coding sequence
atgtgtagcctgcctatggcccgatactatatcatcaagtatgctgaccagaaggcgctttacacccgcgatggccagcttctcgtgggcgatccagttgccgataactgttgtgcagaaaagatctgcatactgcccaacagggggttagctcgcactaaggttccaatcttcctgggtatccagggcggttcacggtgtctggcctgcgtggagacagaagaaggaccgtcgttacagttggaggacgtgaacattgaggaattgtataaaggcggtgaagaggccacccggttcacatttttccagtcaagctccggcagcgctttcaggctggaggccgcagcgtggcccggatggttcctctgtggcccagcagagcctcagcagcctgtgcagctgaccaaagagagtgagccgtcagcacgcaccaagttttactttgaacaatcttggtag

SEQ ID NO: 4936 - DNA, 459 bp, Artificial Sequence
  Description of Artificial Sequence: Synthetic coding sequence
atgtgcagtcttcccatggccagatactatatcatcaagtacgcagatcagaaagctctgtatacccgagatggccagcttctggtgggcgatcccgtcgctgataactgttgcgcagaaaagatttgtattctgcccaataggggactcgcgagaaccaaggtccctattttcctgggtattcaggggggaagtagatgcttagcttgtgtggagactgaggagggccctagcctccaactggaggacgttaatatcgaggagctgtataaagggggagaggaggcgacccgtttcactttttttcagtcttccagtgggtctgccttccggctggaagctgctgcatggccaggttggttcctgtgtgggccagccgagccacagcagccggtgcagctgaccaaagagtccgagccttcagccaggacaaagttctattttgaacagagctggtag

SEQ ID NO: 4937 - DNA, 816 bp, Artificial Sequence
  Description of Artificial Sequence: Synthetic coding sequence
atggccaaggtacccgacatgtttgaagatctcaaaaattgctattctgaaaacgaggaagattcatcctctattgatcacttgtctctgaatcagaaaagcttctatcacgttagctacgggcctctacatgaagggtgtatggaccaatcagtgagtctgtctatttctgagacttcaaaaaccagcaagctcaccttcaaggagagcatggtcgttgtggccaccaatggaaaagtcctcaagaagaggcgtctgagcttgtctcagtcgataactgacgacgacctcgaggcaattgctaacgactcggaagaagagattatcaagcctagaagcgctcccttcagctttctcagcaacgtcaagtataactttatgcggattatcaagtacgaattcatactgaatgacgctctgaaccagtcaatcattagggccaacgaccagtatctgacggcagccgcacttcacaacctggacgaagccgtcaaattcgacatgggggcatacaagagtagtaaagacgacgctaagatcacagtgatcctgcgaatttcaaagacccagctgtatgtgacagctcaggacgaagatcagcccgtcctacttaaggagatgccagagattcctaaaactatcaccggtagtgaaactaacctcctcttcttctgggagacgcacggaacgaagaactacttcacaagcgttgcacatccaaacctcttcatagctaccaaacaggactactgggtttgcttggctggcggtccgccttcaatcacagatttccagatactcgaaaatcaagcctag

SEQ ID NO: 4938 - DNA, 600 bp, Artificial Sequence
  Description of Artificial Sequence: Synthetic coding sequence
atgaattgtgtctgccgcctggtgctagtagtgctgtcgctctggccagacaccgccgtggctccgggtcccccacccggacccccaagggtgagtccggatcctcgagcagaattggattccactgtgttactcacgcggtctcttttagcggacacaaggcagctagcagctcagctcagggataagttccctgcggacggagaccacaatctagattccctgcccactctggcaatgtctgccggagctttgggcgctctgcaactgccgggtgttctcactaggctgcgggcagacctgctgtcgtacctgagacatgtccagtggctcagaagggccggtggaagctcgctgaaaacgttagaacccgaactgggaaccctgcaggctagactggataggctcctgcggaggctccagcttctaatgtcgagattagctctcccacagcctcctcccgaccccccagctcccccactcgcccctccctccagcgcgtggggaggaattcgggcagcacacgctatcttaggcggtttgcatttaacattggactgggccgtccgtggactgctgctcctgaaaacacgcctgtag

SEQ ID NO: 4939 - DNA, 897 bp, Artificial Sequence
  Description of Artificial Sequence: Synthetic coding sequence
atgtggggcgcatgcaaagtgaaggtgcacgattcactggctaccataagcataacactgcgtcgttacctgcggttgggcgctaccatggcgaagagtaagttcgagtacgtgagagatttcgaagccgatgatacctgtctagctcattgttgggtagtggtgcggctggatggtagaaattttcatcggtttgccgagaaacacaacttcgccaagccgaacgacagtcgagcgctgcagctcatgacgaaatgtgcacaaaccgtgatggaagaactcgaggatatagtcatcgcctacggacagtccgatgagtatagctttgtgttcaagcggaagactaactggtttaaaagaagggcatcaaaatttatgacgcatgtggctagccagtttgcctcatcttacgtgttctattggcgggattattttgaggatcaacccctactttatccgcctggatttgacggaagagtagttgtctacccctctaaccagactctgaaagactatctgtcatggagacaggccgattgccatatcaacaatctgtataacaccgtgttctgggccttgatccagcagtcgggccttacccctgtacaagcccaggggagattacagggcaccctcgccgcagacaagaacgaaattctgtttagtgagttcaatatcaattacaacaatgaacttccaatgtaccgcaagggaacagtcttgatttggcagaaagtcgatgaagtaatgacaaaggaaatcaagttacctacggaaatggagggaaagaaaatggctgtaaccagaacacggaccaagcccgtcccattgcactgtgacattattggagatgctttctggaaggagcacccggagattttggacgaagactcatag

SEQ ID NO: 4940 - DNA, 441 bp, Artificial Sequence
  Description of Artificial Sequence: Synthetic coding sequence
atgcaccccctgcttaatcctttgctgttagcccttgggcttatggccctgctgctcacaaccgttatcgccctcacgtgcctgggagggttcgccagcccaggaccggtgccaccttcaacagctctacgcgagctgatagaggagttagtaaacatcacccaaaatcaaaaagcccctctttgtaatggatccatggtgtggtcaataaaccttacagcagggatgtattgtgccgctttagaatctcttatcaatgtttccggatgctcagcaatcgaaaagacccagaggatgctgagtggcttctgtccccacaaggtttcagccggacagttcagtagtttgcatgtacgggatactaagatagaagtcgcccagttcgtgaaggacctgctgctgcacttgaaaaagttatttagggaagggcagtttaattag

SEQ ID NO: 4941 - DNA, 3999 bp, Artificial Sequence
  Description of Artificial Sequence: Synthetic coding sequence
atggagagtcattctagggcgggaaaatctcggaagtctgccaaatttagatcaatatcgcgatcgttgatgctttgcaatgccaaaacaagcgatgacggttcctcccctgacgagaagtacccggatcccttcgagatttctttagcacagggaaaagaaggcatcttccactcttcagtacagctggccgacacaagcgaggctggcccatcctctgtgcctgatttggcgctggccagcgaggcagcccagctccaggcagctgggaatgaccgagggaagacatgccgacggattttttttatgaaagagtcctcaacagccagctctagggagaaacccggaaaactcgaagcccagtcgagcaactttctttttcccaaagcctgccaccaacgggctcgctccaacagcacatctgtcaatccctactgtacccgggagatagatttccccatgacgaagaagtctgccgcaccgacagaccgacagccctatagcttatgtagtaatagaaagtctctgagccagcagctggattgcccagcaggtaaggctgccggaacgagtcggcctacaaggtcactgtccaccgctcagttagtgcaaccgagcggtgggctccaggcatccgtcatcagcaatattgttctcatgaaaggccaggccaagggcttaggcttttctattgtgggagggaaggactcaatttacggacctattggcatatatgtaaaaacaatttttgccggaggagccgctgcagccgacggacggctgcaggaaggcgacgagattctcgaactaaacggggaatccatggctgggctaactcatcaagacgctctgcagaagttcaagcaagccaaaaagggcctcttgaccctgaccgtgcggaccaggctgaccgccccaccttccctgtgtagtcaccttagcccccctctctgtaggtcactttccagctcaacgtgtatcactaaggattctagtagctttgcactcgaatcccctagtgccccaataagcacagctaaaccaaactaccgcattatggtagaggtttcacttcagaaggaagccggagttggtctcgggattggactgtgttcagtgccatacttccagtgtatctcaggcatcttcgttcacaccctgtcccccggtagcgtagcacacctcgacggcagactacggtgcggggacgagatcgtggaaattagtgattccccagtgcactgcttgacactgaacgaggtatatacgatacttagccactgtgacccaggtccggtgcccatcattgtaagtagacatcctgatccgcaggtgtccgaacagcagctgaaggaagcggtcgctcaggccgtcgaaaacacaaagttcggcaaagaacgacaccagtggagcttagagggagtgaaaagactcgagtcctcttggcatggcaggcctactctggagaaagaaagagagaagaacagtgctccaccacatcgtcgggctcagaaggtgatgatccgttcaagctcggacagttcttacatgagtggttctcccggaggatctcccggaagcgggtctgcagagaagcctagctccgatgtcgacatttctacacatagtcctagcttgcccctcgccagagagccagttgtactgtccattgcctcaagccgcctcccccaagaaagcccaccactgccagagtcgagggatagccacccccctcttaggctgaaaaagagcttcgagatcttggtacggaagcccatgtctagcaaacccaaacctcccccacgcaaatatttcaagtcagattccgatcctcagaagagcctcgaggaacgggaaaatagctcatgcagttctgggcatacgccaccgacatgtggacaggaagcccgagagctgttgccactgcttttgccccaggaggatacggctggacgtagtccttcagcctcagccggttgccccggacctgggattgggcctcaaaccaagtcttcaaccgagggcgagcctggctggaggcgggcatctccagtgactcagacatcaccaattaagcacccccttctcaagcgacaagcccgaatggactactcctttgatactaccgcggaggacccttgggtacgtatctctgactgcatcaaaaacctcttctctccgattatgagcgagaaccacgggcacatgccactgcagccgaatgcttccctgaacgaagaggaggggacacagggccatccggacggtacaccgccaaaattggatacggccaacggcactccgaaggtgtacaagagcgccgacagctccactgtcaaaaagggtcctccagttgcgccaaaaccagcttggtttaggcagagcttaaaaggcctccggaatagggcatccgaccctcggggtctgcccgaccctgccctttccacgcagcccgcaccggctagtcgtgaacatctcggctctcacatccgcgcaagttcaagttcttcctcaatcagacagcggatctcaagctttgaaacgttcggatccagtcaactgcctgacaaaggagctcagcgactcagcctccagccttccagtggagaagccgctaagccactgggaaaacacgaagaaggacgattctccggactgttgggtcgcggagcggctccaaccctcgttccacaacagccagaacaagttctcagttctggttccccagccgcttctgaagctagggaccccggagttagcgagagcccacccccaggtcggcaacctaatcagaaaactctgccgcctggaccagatccccttctcaggctgcttagcactcaagccgaagaaagtcagggacccgtccttaagatgccctcgcagcgggcacgctcctttccattgacaagaagtcagtcctgcgagacaaaacttttagacgagaagacatcaaagctgtatagcatctcgtcgcaggtttcttccgccgtcatgaaaagcctgctttgcttgccttcctcaatctcatgcgcccaaaccccgtgcatccccaaggaaggtgctagccccacttcaagctcgaacgaagactctgccgctaatgggtccgcagagacttctgccctggacaccggcttctcactgaatctcagcgaacttagagagtataccgaagggttaacagaagccaaggaagatgacgacggcgaccatagctcactgcagtcagggcagtctgtgatctctctgctgtctagcgaagagttgaaaaagctgatagaggaagtgaaggtgcttgatgaggccaccctaaaacagctagacgggatccatgttaccattctgcacaaggaggagggtgcaggtttggggttttctctggcaggaggcgctgacctggagaataaggtgattacagtacaccgtgtttttccaaacggtcttgccagccaggaagggacaatccagaagggtaacgaggtgctgtcaatcaatgggaagtccctgaagggtacaactcatcatgatgctctggcgattttaaggcaagcaagggaaccaagacaggccgtgatagttaccaggaagcttaccccagaggcaatgcccgacctaaacagcagcacagacagcgccgcatctgcttccgccgcatccgacgtcagcgtggagtccaccgccgaggccacagtctgtacagtcacacttgagaaaatgtcagcaggtttaggctttagtctggaaggtggcaagggcagtctccacggagataaacctctcacgatcaacaggattttcaagggagctgcttccgagcaatccgaaaccgtgcagcccggtgatgagatccttcagctcgggggaaccgcaatgcaggggctaacaagattcgaggcttggaatattataaaggcgctccctgatgggccagttaccatcgtgattcggagaaaatctcttcagagcaaagagacgaccgccgctggggattcctag

SEQ ID NO: 4942 - DNA, 2163 bp, Artificial Sequence
  Description of Artificial Sequence: Synthetic coding sequence
atgtgtagcgttctccctgtggctgtgacgggagtgaaacggctggaatctagttggcatgggcgtcccacattggagaaagagagggaaaaaaacagtgctcctccacaccgacgggctcagaaagttatgattagaagctctagcgattcctcttatatgtctggctcccccggagggtcaccgggatccgggtcagctgagaaaccctctagcgacgtcgatatctcaacccactctccttcgctgcctttagcgagggagcctgttgtgctgagcatagccagttcgcgacttcctcaggaatccccccctctgcctgagagccgagattcacatcctcccctccggttgaagaaaagttttgaaatcttggtgcggaagcctatgtcctctaagcctaagccaccaccaaggaagtacttcaagtctgattcagacccccagaaatcccttgaggaacgagagaacagctcttgcagcagcgggcacacccctcccacttgcggacaggaagctagagaactgctgcctctgttgctgcctcaggaggataccgccggaaggtcccctagcgcctccgcgggatgtcctgggcctggtatcggaccacagactaaatcaagcaccgaaggggaaccgggttggcgccgagcctctcctgtgacacaaacatcgccaatcaagcacccactcttgaaacggcaggctaggatggactattcctttgatactacagcagaggatccatgggtccggatatcggattgcattaagaatctgttctctcctatcatgtcggaaaatcacgggcacatgccactgcagcccaatgcatctctgaatgaggaagaaggtacccagggccatccagacgggacgcctcctaaacttgatacagctaacgggaccccgaaggtgtataagtctgctgatagctctaccgtaaaaaagggccctcctgtcgctcctaaacccgcatggttccggcagagcctgaaggggctgaggaatagggctagcgatccccgagggctcccagaccctgcactgtcgacccaaccagcacctgcgtctcgcgaacacctgggttcccacatacgcgcttctagtagcagttcgtctatacgccagcgcatttctagcttcgagacgttcgggtcttcacagctgcctgacaagggtgcgcagcggctgagcctgcagccatcgagtggtgaggcagcaaagccgcttggaaaacatgaggaggggaggttcagtggtctcttgggcagaggcgcagctcccacgctggtcccccagcagcctgagcaggttctctcctcaggctccccggctgcatccgaggcgagagacccaggagtgtcagaatcgcccccacctggcaggcaaccaaaccagaaaacattacctcccggtccggatccccttctgcgacttctatcaacacaggctgaggagtcacagggccctgtattgaagatgcccagtcagcgagcccgatccttcccactcaccagaagccagtcctgtgaaacaaaactccttgatgagaaaaccagcaaactctattccattagctcccaggtgagctctgctgtgatgaagtccctgctttgcctgccctctagcatctcatgcgcgcagacaccctgtattcccaaggagggggcaagtcccaccagctcctccaatgaagactctgccgctaacggaagcgccgagacctctgccctggacactgggtttagcttgaacttaagcgaactgagagagtacacagaaggactgactgaggcaaaggaggatgatgatggagaccacagtagcctgcagtccggtcagtctgtgatcagcctgctctcctctgaggagttgaagaagcttatcgaggaggtgaaggttctagacgaagccaccttgaagcagctggacggcatccatgtgacaattttgcacaaggaggagggcgctggccttggcttcagtctagcagggggagcggacctcgagaacaaagtgatcactgtccatcgggtcttccctaatgggctcgcttcacaggagggcacaatccagaaaggcaacgaagttttatccattaacggtaaaagtcttaaaggaacaacacatcatgctcggccacagctgctgcactag

SEQ ID NO: 4943 - DNA, 3492 bp, Artificial Sequence
  Description of Artificial Sequence: Synthetic coding sequence
atggagcggggagcccgtgaaatggccgctccaggcgactgcccggctggcaaggcagctggcacatctcgtcccacacggagcctgtctaccgcacagctggttcagccatccgggggacttcaagcaagcgtgatttcgaatatagtactcatgaaggggcaggcgaagggccttgggttcagcatcgtgggagggaaggattctatttatgggccaattggaatctacgtcaaaaccatttttgcaggaggagccgcagcagccgatggacggctgcaggaaggcgacgagattctcgagctgaacggggagagcatggccggactgacccaccaggatgccctgcagaagtttaagcaggcaaaaaaaggtctcttaacgctcacagtgcgtactcgcttgaccgccccacctagcttgtgctcacacctcagtcctcccctgtgtcgaagcttgtctagttccacatgcattaccaaagactcgtcgtccttcgctctcgaaagcccaagtgcacccatatctaccgccaagccaaattataggattatggttgaagtgtcactgcagaaggaggctggtgttggcctcggcattggcttgtgctcggtgccttatttccagtgcatcagtggaatttttgtgcacaccctgtccccaggaagtgtcgcccacctggatggtcggttgcgctgtggtgatgagattgtggagattagcgacagtcccgtgcactgcctcaccctaaatgaggtttacacaatcctgtctcactgcgacccaggtccggtaccaattatcgtttcccgacatccagatccacaggtctctgagcagcagctcaaagaggcagtggcacaggccgtagaaaacacgaaattcggtaaggagagacatcagtggtctctggagggggttaaacgtcttgagtcgtcgtggcatggaagacccaccctggaaaaagaacgggagaaaaactccgcccctccccatagacgggctcagaaggttatgatcaggagttctagcgattcctcctatatgagcggctccccaggtgggtcacctgggtcagggagcgccgaaaaaccctctagcgatgtcgatattagcactcactctccaagcctgccgctcgccagggagcctgtcgtcctgagtatcgcctcttccagactgcctcaggagtcgccccctctgcctgagtctcgcgatagccatcctccattgaggctgaaaaaaagtttcgagattttagtgcgcaaacccatgtctagtaagcccaagcccccaccaaggaagtactttaaaagtgacagcgacccacaaaagtctctggaagaacgggaaaacagctcttgtagctccggtcacacaccacccacatgcggtcaggaggcccgagagcttctgcccctccttctgccgcaggaagatacagctggccgatcaccatctgcgagcgcaggttgcccgggacctgggattggaccacagaccaagtcatcaaccgaaggcgagcctggctggcggagagccagccctgtcactcagacctcgcccatcaaacacccactcctcaagcggcaggccagaatggactacagcttcgacaccacagctgaggatccctgggttagaatctctgactgtattaagaatctattctcccctatcatgtcagagaaccacggtcatatgcccctgcagcctaacgctagccttaatgaagaagaaggcactcaaggccatcctgacggcacaccgccaaaactggacactgctaacggcactccaaaagtgtataagagcgccgactctagtaccgtgaagaaaggcccaccagttgctcctaagccagcctggttcagacagtcattgaagggcctcagaaatagggctagtgatcccaggggactgcccgatccagctctgagcacccaacccgcacctgcttctcgagagcacctgggttcacatattcgggcttcctctagtagctctagtatcagacaaagaatttcatccttcgaaacttttggaagctcccagttgcccgataagggagcacagcgtctttccttgcaaccgtccagcggcgaggcagcaaagcctcttggtaaacacgaagagggtcgattttccggtctgcttggcagaggcgcagcgcctactctcgtgcctcagcagcccgagcaagtgctaagctctgggtctcccgcagcatctgaggccagagacccaggagtatcagaatcacctccacctggcaggcaaccaaaccagaagacactgcccccaggcccagacccgctgctgaggctcctgagtactcaggccgaggagagccaggggcctgtgctgaagatgccaagccagcgcgcacgctcctttcccctgactcgtagccagagttgcgagacaaaacttctggacgagaagaccagtaaactgtactctatcagcagtcaggtcagcagtgctgttatgaaatcactgctttgtctgccctcttcgatctcatgcgcacagacgccatgcataccgaaagagggcgcatccccaacatcctcctcgaacgaagattctgctgccaatggatccgcagagacctccgccctcgacacaggcttttctttgaatctgtcggagctaagggaatacaccgaaggcctcactgaggccaaggaggacgatgatggggaccacagttctctccaatccggccagtccgtgatctccctgctcagcagcgaggagctcaaaaagctgattgaagaggtgaaagtgctggatgaggccactctgaaacagctggacggcattcacgtgacaatactccataaggaggagggggcagggctgggcttttccctggcagggggagcagacctagagaataaggtcatcacggtgcaccgggtcttccctaacggtctggcctctcaagagggaactatacagaagggcaatgaggttttgtcaattaacggaaagagcttgaagggaacgacgcatcatgacgctctcgccatactaaggcaagcacgcgaaccgaggcaagccgtgatcgtgactagaaaactgactcccgaggcaatgccagatctcaattcctcgacagactcagcagcgtctgccagtgcagcgtcagatgtgtccgtggagtccacagaagctaccgtctgtactgtcacccttgagaagatgagcgcagggctgggttttagcctggaggggggaaagggcagtttgcacggcgacaagcccctgaccatcaatcgtattttcaaaggagcagcttccgagcagtccgagaccgttcagccaggagacgagatactgcagctcggcggtactgctatgcaggggttaaccaggttcgaagcttggaatataatcaaggccctgccggatggcccagtcactattgttattaggagaaagagcttacaaagcaaagagacgactgcggctggtgattcctag

SEQ ID NO: 4944 - DNA, 1896 bp, Artificial Sequence
  Description of Artificial Sequence: Synthetic coding sequence
atggactatagctttgatactactgctgaagacccgtgggtgcgcatcagtgactgcatcaagaatctcttcagtcccattatgagcgagaaccatggacacatgccattgcagcctaacgcgtcgctcaatgaggaagagggcacgcaagggcatcctgatggcacccccccaaaactggataccgcaaacggcactccaaaagtttataaaagtgcagattcttcaaccgtcaaaaagggacctcctgtggccccaaaaccggcatggttcagacagagtctgaaggggttgaggaatagagccagcgatcctagagggctgcctgatcccgctctcagtacacagcccgctccagccagtcgagaacacctcggcagtcatatccgggctagttcctcttcgtccagcattcgccaaagaatatcttccttcgagacctttggctcttcacagctcccggacaaaggtgctcagcgcctgagcctacagccctcctctggagaagccgcaaagcccctcggcaagcacgaagaagggcgattcagtgggctgctcggtagaggggctgctcctaccctcgtaccgcagcaaccagagcaagtgctctcctcgggaagccccgctgcaagcgaggcccgtgacccaggcgtaagcgagagtccacctccgggaagacagcctaatcaaaagacgctgccccctggccctgacccattactgagacttctgagcacccaggcggaagaatcacaaggacccgtgctgaagatgccttctcagagagctcggtccttccctctcacaagatcacaatcttgcgagactaagctgcttgatgaaaagacgtccaaattgtacagcatttccagccaggttagttccgccgtgatgaagtccctgctgtgcctgccctcatcgattagctgtgctcagaccccatgcattccaaaagagggtgcctctcctactagttccagcaatgaggacagcgccgcaaatgggtccgcggaaacctcggccctcgatacgggattcagcctaaacctatccgagctccgggaatacaccgagggactgaccgaggccaaagaagatgatgacggggaccactcgtcactgcagtctggccagtccgtgatcagcctcctcagcagcgaggagctgaagaaactgattgaagaggtgaaagtgctcgacgaggcaacactgaagcagctggatggaatacatgtgacgatactgcacaaggaagagggagccggtttgggtttcagccttgccggaggtgcagacctggaaaacaaggtgataaccgtccacagggttttccctaacgggcttgcctcccaagaaggcaccatccaaaagggaaacgaggtgttgagtatcaatgggaaaagcctgaaggggaccacgcatcacgacgcgctggctatattaaggcaagccagggagcctcgacaggcggttatcgtcaccaggaagctcacgcccgaggctatgccagacctgaatagttccaccgactccgctgcttccgcaagtgctgcgagcgacgtcagcgtggaaagtactgcagaagctaccgtgtgtacagtaactctagaaaaaatgagcgctgggctgggattctctctggaagggggaaaaggatctctccacggcgacaagccccttaccattaaccgcatttttaagggagcggcatctgaacagtctgaaacggttcagccaggagatgaaattctgcaattgggtgggacagccatgcagggcctgacaagattcgaggcttggaatatcattaaggccctaccagacggacctgtgactatcgtcatacgtaggaagtcattgcagtccaaagaaacaactgcggcaggggactcatag

SEQ ID NO: 4945 - DNA, 1974 bp, Artificial Sequence
  Description of Artificial Sequence: Synthetic coding sequence
atgtggttacctgtgaaggaacttaccatccacgagtgccaacagatgagtacctatagagcgcctaaccaggaggcccgagagcttttgccactcctccttccgcaggaggatacagctggacggtctccaagcgcttcggctggatgccccggacccggaatcggacctcagaccaagtcttccaccgagggcgagcccggttggcgccgagccagcccagtcacccagacaagcccaatcaaacacccacttttgaagcgacaggctcgcatggactattcgttcgacacaaccgcagaagacccttgggtgaggataagcgattgtattaagaacctcttttcacccatcatgagcgaaaatcacgggcatatgcccctgcagcccaatgcctccctaaacgaggaggaaggcacccagggacatcctgatggcacaccacctaaactggacaccgctaatgggacacccaaagtttacaagagcgccgacagctccaccgtgaagaaaggacctccagttgctccaaagccagcgtggttccgccagtcattaaagggacttagaaatcgcgcaagtgaccccaggggtctgcctgacccagctctgtcgacacaaccagctccagcctctagagagcacctgggatcccacatcagggcttcaagtagcagtagctctattaggcagcgaatcagcagcttcgaaactttcggctcctcccagctgcccgacaagggagctcaacggctttcactccagcctagctccggcgaggctgccaaaccgctgggcaaacatgaggaggggaggttttcaggactgcttgggaggggggcagctcctacacttgtgccgcagcagcccgaacaggttcttagcagcggaagcccagccgcttccgaagccagagatccgggagtgagcgagtctccccctcctggacgtcagccaaatcagaagactttgcccccaggcccagaccctctattgagattgctgtctactcaagccgaggagagccaagggcctgtcctgaagatgccatcacagagggctcgcagcttcccgctgacgcgctcccaaagctgtgaaacaaagctgctggacgagaagacttcgaagttgtattctataagctctcaggtgtcctcagccgtgatgaaaagcctgctgtgcctgccatcgtctatctcttgcgctcaaacaccatgcattcctaaagagggggctagtccaacaagttcctcaaatgaagacagtgctgcaaacgggtcagcggaaacaagcgccctcgacaccgggttttcactgaatctgtccgagctgagagagtacacagaaggcctgacagaggcgaaggaggacgacgacggggaccactcatcgttacagagtggtcagagcgtgatctctctcctgagcagtgaagaactgaaaaagctgattgaagaagttaaagttctagacgaagccacacttaagcagctggacgggattcatgttacaatcctgcacaaagaagagggtgccggactcggcttctcactggctggtggcgcagacctggaaaacaaagtaatcactgtgcaccgcgtgtttccaaatggtctggcgtctcaagaaggcaccatacagaaaggcaatgaagtgctgagtatcaatggaaagagcctcaagggcaccacccaccatgacgctctggcgatccttagacaggcaagagagcctaggcaggcagtgatcgtgacgaggaagctgacccccgaggccatgccggatttgaactcctcaaccgattcagctgcaagcgcctcagccgcatccgacgtgtcagtggagtccaccgaggctactgtttgcacagtgaccctcgaaaaaatgagcgccggtctcgggttctccttggaaggcggaaaaggcagccttcatggggataaacccttgactataaatcgcatatttaaatag

SEQ ID NO: 4946 - DNA, 1365 bp, Artificial Sequence
  Description of Artificial Sequence: Synthetic coding sequence
atggaatcccattcaagggcgggaaagtctcggaagtcagccaaattccgtagtatttctcgaagcctcatgctttgcaacgccaagacatctgacgatggttccagtccagatgagaaatacccagacccctttgaaatctccctggcccaaggcaaggagggtatattccactccagtgtacaacttgccgatacaagtgaggcaggccctagctcagtgcctgaccttgcactcgcatctgaggccgctcagcttcaggcagctggtaacgacaggggaaagacttgcagaaggatattcttcatgaaggaaagttccacagccagctctagggagaagcccggaaagctggaagctcagagcagcaacttcctgttccctaaagcttgtcaccagcgagcgaggagtaactctacgtccgttaacccgtactgcactagagagatagactttccgatgaccaagaaaagtgctgctcctactgaccgccagccctattcattgtgcagcaataggaaaagcctttcacagcagctggattgtcctgccggaaaggctgcaggcaccagcagaccaactcgatcactcagcacagcgcagttggtgcaaccttccggtggtttacaggcctcggtgatctcaaacattgttctcatgaagggtcaggccaaagggctcggtttttctattgtggggggaaaagatagtatatatggcccaatcgggatatacgtcaagacaatattcgccggtggagcagctgccgctgatggcaggctccaggagggggacgagatacttgaactaaatggcgagtcgatggccggtcttacacatcaagacgctctgcagaagtttaagcaggcaaagaaaggactcctcactcttactgtccgcacgaggctgactgctccaccttccctctgctcacatttgtcacctccactatgcagatctctctcttcctctacctgcattactaaagactcgagtagtttcgcactcgaaagcccgagtgcacccatcagcaccgctaagcctaactatagaatcatggtggaggtgagtctacaaaaggaggctggagtaggtcttggaatcggtctgtgtagtgtcccatatttccaatgcatctctggcatctttgtacacactttatccccgggaagtgtggcacatttagacgggcgtctcagatgcggagacgagatagttgagatctccgatagtccagtgcattgtctcacgctgaatgaggtctacaccattctaagtcactgtgacccaggtcctgtgcctatcattgtcagccgtcatccagacccccaaaaagaagaaatggaggcccaggaggtcaagtag

SEQ ID NO: 4947 - DNA, 1683 bp, Artificial Sequence
  Description of Artificial Sequence: Synthetic coding sequence
atggattactcattcgacaccaccgcggaggacccgtgggtccgcatcagcgactgcataaaaaatctgttcagccctatcatgtccgaaaatcacggccacatgcctctgcagcctaatgcctcactgaatgaagaagagggtactcaaggccatcctgacggcacccccccaaaactggacactgctaacggcactcctaaagtatataagtccgctgattcttcaacagtgaagaaaggaccaccagttgcgcctaagcctgcctggttccggcagtccctgaagggactgcgcaatagggccagtgaccccaggggacttccagatccagccctctccactcagccggcacctgcgtcccgtgaacatcttggaagtcacattagagcctctagctcttcttcatcaatccgccagagaatctccagcttcgaaacatttggctcgagccagctgccagataagggggcacaacgtctcagcctgcaaccaagtagtggtgaggccgctaagcctttgggcaagcatgaagagggaagatttagcggactgctgggcagaggagccgctccaacccttgtgccccagcaaccagagcaggttctgagttctggaagccccgcagctagcgaagctcgggaccccggtgtgagtgagtccccccctcctggccgtcagccaaaccagaaaactttaccccctgggcctgaccctcttctgcggctattgtctacccaggccgaggaatctcaggggcctgtccttaaaatgccttctcagagggccagaagcttccccttgactcgcagtcagtcctgtgagaccaagttactggatgaaaagaccagcaaactctattcaatttcttcgcaagtgtcttccgccgttatgaagtctcttctgtgtcttccatcaagtatcagttgtgctcagacaccatgtatcccaaaagaaggagcttctccaaccagctcgtccaatgaagatagtgcagctaatggtagcgccgagaccagtgcgttagatacaggctttagtcttaacctctctgagctgcgggagtacaccgagggtctcaccgaggccaaagaggatgatgatggcgatcactcttctctgcagagcggccagagcgtcatatctctcctgagctccgaggaactcaagaagctgatagaagaagtcaaagtgctagacgaggccaccttaaagcagctggacgggattcatgtcactattctgcataaagaggaaggcgctggcctgggattttctttggccggaggagccgatctggaaaataaggtcataactgtccaccgcgttttccccaacgggctggcttcacaggagggtacaatacaaaaggggaacgaagtgttgtctataaatggtaaatccctgaaaggtacaacccaccatgatgccttggccattctgcgtcaggctcgggagccaaggcaggccgttattgttaccagaaaactgaccccggaagctatgcctgatctgaattcaagcacagacagcgcagcaagcgcctctgctgcttctgacgtgtccgttgaaagcacagaagcaactgtgtgtacagtaactctcgaagacgtcgggagagccggactgcagcccggtaggcgagagggccttcccacgcgtcggcaggcctcccatcactag

SEQ ID NO: 4948 - DNA, 3996 bp, Artificial Sequence
  Description of Artificial Sequence: Synthetic coding sequence
atggaatcccacagccgcgcagggaagagcagaaagtctgccaaatttagatccataagccgctctctcatgctgtgtaacgccaaaacctcagacgacggtagttcacccgatgaaaaatatccggatccatttgagatttccctcgcgcaagggaaagagggcatttttcatagctccgtgcagctcgctgatacatccgaagccggaccgtcatcagtgccagatctagctctggcttccgaagcggcacaactccaggctgctggcaatgataggggaaaaacctgccgcagaatattctttatgaaagaaagctctaccgcctcttctcgagaaaagcccggaaagcttgaggcgcagagtagcaattttctgtttccaaaggcatgccatcagcgggcaagaagtaactctacttctgtaaacccttattgcacccgggaaattgacttccctatgaccaagaagtccgcagcaccaacagacaggcaaccttacagcttatgttccaacagaaagtctttgtctcagcagttggattgccccgctgggaaggccgctggaaccagccgacctacccgcagcctgtctactgctcaattggtgcagcctagtggcggtctgcaggcctccgtcatctctaatattgtgcttatgaagggacaggctaagggtctcggattcagcatcgtgggcggtaaagactccatctacgggcctatcgggatatacgtcaagaccattttcgccggaggtgccgctgccgcagatggcaggctccaggagggagatgaaatcctcgagctcaacggcgaatccatggctggcttgacgcaccaagatgctctccaaaagtttaaacaggcaaagaaggggttgttgactttaacggtgcggaccaggctcactgcgcctccatccttgtgttcgcacttgtccccccctctctgtcgcagcttgtccagctcaacatgtatcacgaaggacagctcttctttcgctctcgaatcaccttccgctccaattagcacggcaaagcccaactatcggatcatggtagaggtaagtttgcagaaggaagcaggggtgggcctgggcatcggcctgtgtagcgtcccatattttcaatgtatctctgggatattcgtgcacacactgtctcccggaagcgtggcccatcttgacgggaggctgcgctgcggggacgagatcgtggaaatatccgatagccctgtgcactgtcttactctgaatgaggtgtacactatcctcagtcattgcgacccaggtccagttcctattatagtcagccgacatcccgatccgcaggtgtcagagcaacaactgaaggaagccgtcgcccaggccgtcgaaaacacaaaattcggaaaggagcgacaccagtggtcactagaaggcgtgaagagattggagtcgagttggcacgggaggcccacgctggagaaggaaagggaaaagaacagtgctccccctcaccgaagagcccaaaaagtgatgattcggtcgagcagtgactccagctacatgagtggctcccccggaggtagtccagggtctggcagcgcagaaaagccttcttccgacgtcgacatttctactcattcacctagtctgccgctagcccgtgagcccgtggtgcttagcatcgcctcttcccgattgccccaggagtcgccccctttgccagaatcaagagatagccacccccctttacgtctgaagaaatcttttgaaatactggtccggaaaccaatgtcatccaagcccaaacctcccccacgaaaatattttaaatccgactccgacccacaaaagagcctggaggagcgagagaacagtagctgctcctctggtcatactccccctacctgtggccaggaagcacgcgagttgctaccattacttctcccccaggaggataccgccggacgctcccctagtgcttctgctggttgccccggacccggtataggcccacaaaccaagtccagcaccgagggcgaacccggatggagacgcgctagtcccgtaacacagacttctcctattaagcaccccctgctcaagcgccaagcaagaatggattattcctttgatactactgccgaggacccgtgggtgcgcatctctgattgtatcaaaaatcttttttctcccatcatgagtgaaaaccacggccacatgcccctgcaacctaacgcttctttgaacgaagaggagggaactcaaggccaccctgacggcacaccccctaagttggatacagcaaatggaacgcccaaggtgtataaaagcgccgactcatcaaccgttaaaaaaggtccccctgtggcacccaagcccgcttggtttcgacagagtctcaaaggattgcgcaatcgtgcctccgatcccaggggattaccagaccccgcactgagtacacagccagcccctgccagcagggagcacctcggctcccatatccgggctagttcatcttcctcctcaattcgccagcggattagtagcttcgagacattcggaagctcgcaactgcccgacaagggcgcacaacggttgtccttgcagcccagttcgggcgaggctgctaagcccctgggcaaacacgaggaagggagattctctgggctcttgggtcgaggcgctgctcccacattggtacctcagcagccggagcaggtcctaagctcagggagtcctgctgccagtgaggcaagggacccgggagtttctgagtcccctcctcctggacgtcagcctaaccagaaaacactgcctcccggtccagatcctctcctgcgtctcttgtccactcaggcagaggagtcccagggccctgtgctgaaaatgccctcccagcgcgctcgctccttcccactaaccaggtcccagtcctgcgagacgaagcttctcgacgagaaaacatccaagctgtactctatctccagtcaagtgtcgagcgccgtgatgaagtctctcttgtgtctaccctccagcatctcctgcgcgcagaccccttgtattcctaaagaaggggcatcacctaccagtagcagtaacgaagacagcgctgctaatgggtctgctgaaacatctgcgcttgacactggtttctccttgaacctatctgaactaagggagtacactgagggcctgacagaggcaaaggaagacgatgatggcgaccattctagtctccaaagcgggcagtctgttatttcgttactgagttcagaggaactcaagaagctcatcgaggaagttaaggtactcgacgaagctactctcaagcagctcgatggcatccacgtgaccatcctgcataaagaggaaggagctggtctgggtttctctctggccggtggagccgatctggaaaataaggtgatcacagtccaccgagttttcccgaacggtctagcgagccaggagggaaccatccagaagggtaatgaggtgctgtcaattaacgggaagagcttgaaaggcacaacacaccatgatgcactggccatcctcagacaagcacgtgagcctagacaggcagtgatcgtaactagaaaacttacaccggaggcaatgccagacctcaacagctccaccgacagcgcggcaagcgcttcagccgcttccgacgtgtctgtggagtccaccgaggccaccgtttgcactgtgacactggaaaagatgagcgcagggctggggttctctttggaaggcggaaaggggagcctgcatggcgataagcccctgactatcaatcgcatttttaagggtgcggcttcagaacagtccgaaacagttcagccgggtgatgagattctgcagcttggagggacagcgatgcaggggctgacaaggtttgaggcctggaatatcataaaggctctgcccgacggacccgtgaccatcgtgatccggaggaaatccctgcagtccaaggagaccaccgccgcaggagactcctag

SEQ ID NO: 4949 - DNA, 1785 bp, Artificial Sequence
  Description of Artificial Sequence: Synthetic coding sequence
atggagtcacatagccgagctggcaaatcccggaaaagtgccaagttccggagcataagtcggagcctgatgctgtgcaatgccaagacttcagatgatggatcctcccccgacgagaaataccccgaccctttcgagataagcttggcccaaggaaaggaaggcatattccacagctcagtgcagctggcggatacgtcagaggccggaccctccagcgtgcctgatttagcactggcaagcgaagccgctcagttacaggccgctgggaatgatagaggtaagacttgtcgcagaattttttttatgaaagagtctagcaccgccagctcgcgggaaaaacctggaaaactggaggctcagtctagtaatttcctctttcctaaggcctgccatcaacgagcgagatccaatagtacctcagtgaatccttactgtacgagagagattgattttcctatgaccaaaaagtcggccgcacctaccgatcggcagccgtactcgctatgctccaacagaaaatcactctcacagcaactcgactgccccgcagggaaagctgcagggacttcccgtcccaccaggtcattgtcaacagctcaactcgtgcaacccagcggcggtctccaggcctccgtcatctctaatatcgtcttaatgaagggccaggctaaaggccttggattctccatagtcggtggcaaggatagtatctacgggcctatcggaatctacgtgaagactatctttgcagggggagcggctgcagccgacgggcgactgcaggagggcgatgagattctagaactgaacggcgagagcatggctggtctcacacaccaagacgcactgcagaaattcaagcaggcaaagaaggggctgttgaccctgactgtgcgtactagactgactgcgcctcctagcttatgcagtcatctttctcccccactgtgcagatcgttgtccagcagcacatgcatcaccaaggactcctcaagctttgcactcgaatctccttctgcccctatctctacagccaaacctaattatcgcattatggttgaggtcagtctgcagaaggaggcgggagtaggcctcggtatcggcctttgttcagtgccatatttccagtgcatctccgggatctttgtccacactctttcacccggaagcgtggcccatttggacggaagactgagatgcggtgacgaaatcgttgaaatcagcgacagccctgtgcactgtttaactctaaatgaagtgtacaccatcctctctcactgcgaccctggacctgtgccgattatcgtcagcagacaccccgatccacaggtgagcgagcagcagcttaaggaggcggtggctcaggccgtagaaaatacgaagttcggcaaagaaaggcaccagtggagtcttgagggagttaaaaggcttgaatcctcttggcacggcagacccacccttgagaaggagcgggagaagaattcagccccaccccaccggagagctcagaaggtgatgatccggtcgagtagcgatagcagctacatgtcaggcagtcccggagggagtcctggtagcggaagcgctgagaagccatccagcgacgttgatatatccacccacagccctagcctgccccttgccagagagccggtagtactgagtatcgcttcctctaggcttccgcaggagtccccccctctccccgaatcccgggacagtcacccacctctgcggttgaagaaaagctttgaaatccttgttcggaagcccatgtcctag

SEQ ID NO: 4950 - DNA, 468 bp, Artificial Sequence
  Description of Artificial Sequence: Synthetic coding sequence
atgacgcctggaaaaacaagcctagtttctctcctgctccttctctccttagaggctatcgtgaaggctgggatcaccatccctcgcaatccaggatgcccgaattcggaagataagaacttcccgcgtacagtgatggttaatttaaacatccacaatcggaataccaacacaaaccctaagcgttctagtgactattacaataggagtaccagtccctggaatctccaccgcaatgaggatcctgaaagatatcctagcgtcatttgggaggccaaatgcagacacctgggctgcattaatgcagacggcaacgtcgattaccacatgaactctgtgcccatacagcaggagatcctggtgctgagacgagaaccacctcactgccccaactcgtttcggctggagaaaatcctcgtgtccgtgggttgcacatgtgtgacccccatcgtccatcacgtcgcctag

SEQ ID NO: 4951 - DNA, 543 bp, Artificial Sequence
  Description of Artificial Sequence: Synthetic coding sequence
atggattggccccacaatctccttttcctcctcaccataagcatatttttgggattgggtcagccccgatcacctaaaagcaaacgaaaaggccagggcagacccggaccattagcgcctgggcctcatcaggtcccactcgacctcgtgtcacggatgaagccatatgccagaatggaagaatacgagagaaatatcgaggagatggtcgcacaactgcgaaactcttcagaactagcccagagaaagtgcgaagtgaacctacagctctggatgagcaataagagatctttaagcccttggggatactccattaaccacgaccccagtcggatccccgtcgaccttccagaagccagatgcctgtgcttaggctgtgtgaacccctttaccatgcaagaagaccgatccatggttagcgtccccgtgttttctcaagtcccagtgagacgtcgcctctgcccacctccacccagaaccggaccctgccgtcagcgcgctgttatggagacaattgcagtcggatgcacctgtattttttag

SEQ ID NO: 4952 - DNA, 594 bp, Artificial Sequence
  Description of Artificial Sequence: Synthetic coding sequence
atgacacttctaccaggtctgctgtttcttacatggctgcacacgtgtctcgcccatcatgatccaagccttagagggcatccgcatagccacggcaccccccattgttattcagctgaggaactgcccctgggtcaggcgcctccacacttgctggcccgtggtgcaaaatgggggcaggctctgcctgttgccctggtgagcagcctcgaagcggcaagccaccgaggcaggcatgaaagaccgagtgcaaccactcagtgtcccgttctccgaccggaggaggtgctggaagctgacacgcatcagagaagtataagcccctggagatacagagtagacacagacgaagatcgctatccacagaagttggcttttgccgagtgcctgtgtcgcggatgcatcgacgcacggactggaagagaaacagccgctcttaatagcgtacgtctgcttcagtcactgttagtattacggagaagaccatgcagccgggatggcagtggcttgcctactcctggggcatttgcctttcacacagagttcattcacgtgccggtcggatgcacctgtgtgctgccgagatcagtgtag

SEQ ID NO: 4953 - DNA, 609 bp, Artificial Sequence
  Description of Artificial Sequence: Synthetic coding sequence
atgctggtggccggatttctgttggctcttccgccatcttgggctgcaggcgcaccgagagctggccgtagacccgcaaggccacgcggatgtgccgaccggcctgaagaacttctggagcaactgtacgggagattagccgctggcgtactatcggctttccaccataccctgcagctcggcccaagagaacaagctcgtaacgcctcctgtccagctgggggacgcccagctgaccgcaggtttcggcctcccacaaatctcagatcagtgagtccttgggcctatagaattagttatgacccagccaggtatccacgttatctcccagaagcctactgtctctgccgcggatgcctcacgggcttgtttggggaagaggatgtgagatttcgcagcgctccagtctatatgcccacagttgtgcttagacgaacaccggcttgtgccggaggccgatcagtctatacggaggcctacgtcacaatccctgtgggctgtacttgtgttcccgagcccgaaaaggatgcagactccataaatagcagcattgacaagcagggcgcaaagctcctgcttgggccaaatgacgccccagccggaccttag

SEQ ID NO: 4954 - DNA, 492 bp, Artificial Sequence
  Description of Artificial Sequence: Synthetic coding sequence
atgaccgttaaaactttgcatgggcctgctatggtgaagtatctgctattgtcaattctgggccttgcctttttgagtgaggccgcagccaggaagatcccaaaagtcggtcacacttttttccaaaaacccgaatcctgtccacccgttcctggaggatcaatgaaactggatattggtatcattaacgagaatcaacgggtaagcatgtcacgaaatatagaaagcagaagcaccagcccttggaactatacagtaacgtgggaccctaacaggtatccgagtgaagtggtgcaggcgcagtgtcgcaatctgggttgtattaacgcccagggcaaggaggacatttctatgaactctgttccgatccagcaggagactctggtcgttcggcgaaagcaccagggatgcagcgtgagcttccagctagaaaaagtcctggtaacagtggggtgtacatgtgtgacccccgttatccatcacgtccagtag

SEQ ID NO: 4955 - DNA, 531 bp, Artificial Sequence
  Description of Artificial Sequence: Synthetic coding sequence
atgaaagctagcagcctggcattttctttgctatcggccgctttctacctgctttggaccccctccactggtctgaagacgttaaacttgggaagctgcgtaatcgccacaaatctccaggaaatcaggaacggcttcagtgaaattcgcggatccgtgcaggcaaaggatgggaacattgacattagaattttgagaaggacagaatcgctccaggatactaaaccggctaaccgctgttgtctgcttcgacacctgttgcggctgtatttggatcgcgtgttcaaaaattaccagacccccgaccactatactctaaggaagatatcctctctagcgaattctttccttacaataaaaaaagaccttcggctctgccacgcccatatgacctgccactgcggggaggaggccatgaaaaaatactcacagatactgagtcactttgaaaaattggagcctcaggcggctgtggttaaggccctgggggagctagatatcttgttgcagtggatggaggaaactgagtag

SEQ ID NO: 4956 - DNA, 531 bp, Artificial Sequence
  Description of Artificial Sequence: Synthetic coding sequence
atgaaagcaagtagtttggcattcagtctgttgagcgccgctttttatctgctgtggacacctagcaccggactcaaaactttgaacctcggaagttgtgtgatcgctacgaacctgcaggaaataagaaatggcttttccgagatcagaggatcagtgcaagccaaagacggcaacattgatatcaggattctccggagaacggaaagcctccaggacaccaagcctgctaaccgttgttgtttgctgagacatctcctcaggctttatctggaccgggttttcaagaattaccagacccctgatcattacacccttcgtaaaatttctagccttgcaaactccttcctgacaattaagaaggatttgaggctgtgccacgcccacatgacctgtcactgtggtgaggaggccatgaagaagtattcccagatacttagccatttcgaaaagctcgaaccacaggcagcagtcgttaaagcactcggcgaattagatattctgctgcagtggatggaggaaactgagtag

SEQ ID NO: 4957 - DNA, 456 bp, Artificial Sequence
  Description of Artificial Sequence: Synthetic coding sequence
atgaaggctagcagccttgctttttccctactgagtgctgcattctatctactgtggaccccttctaccgggctgaagaccttgaacctgggctcctgcgttattgccactaatcttcaggagattcggaacggattttccgagattaggggttcagttcaagccaaggacgggaacatcgatattcgcatccttcgcagaaccgaaagcctccaggacacaaaacccgcaaacagatgttgcctgctccgtcacctgctgaggctgtacctggatcgcgtgttcaagaactaccagactcccgatcactacacattgagaaagatcagctcactggccaacagctttctcacaatcaaaaaggacctccggctttgcctggaaccccaagccgcagtagtaaaggccctaggcgaactggacattctcctgcagtggatggaagaaactgagtag

SEQ ID NO: 4958 - DNA, 540 bp, Artificial Sequence
  Description of Artificial Sequence: Synthetic coding sequence
atggctgcactccaaaagtccgtctcatcctttctaatgggaactttggctacatcctgcctgctcctcctggcattgttagtgcagggtggagcagcggcaccaatctcttcgcactgtagactggacaaatccaattttcaacagccatatatcacaaaccgaactttcatgctggccaaggaggcttcccttgctgacaacaacaccgacgtcagactgattggggagaagctgttccacggcgtgtcgatgagcgagcggtgctacctcatgaaacaggttcttaatttcacattggaagaggtcctcttcccccagtccgacaggtttcagccatatatgcaggaggtcgtcccattcctcgccaggctcagcaatagacttagcacttgccatatagagggagacgaccttcatattcagcggaatgtccagaagctcaaggacaccgtcaaaaagttaggcgagagtggagagataaaagccatcggggagctcgatctgctcttcatgagcctccggaacgcctgcatctag

SEQ ID NO: 4959 - DNA, 540 bp, Artificial Sequence
  Description of Artificial Sequence: Synthetic coding sequence
atggctgcacttcagaaaagcgtaagttcattcctgatgggcacactcgccactagttgcttgctactgctggcactgttggtgcagggcggagccgcagctcccatctcttctcactgccgtctggataaatcaaatttccagcagccctacatcactaaccggaccttcatgctagctaaggaagcttctctggcagacaacaacaccgacgtgagactgatcggcgagaaattgtttcacggggtgagcatgagcgaaaggtgctacctgatgaagcaagtcttgaactttaccctggaggaggtactatttccacaatcagaccgctttcagccctacatgcaggaagtggtgccattcctagcacggcttagcaaccggttgagcacctgtcacatagagggcgatgacctgcacattcagagaaacgttcagaaattaaaggacaccgtcaagaaattgggcgagtcaggcgagattaaagcaataggggaactcgacttgcttttcatgagtctgagaaatgcctgcatttag

SEQ ID NO: 4960 - DNA, 1890 bp, Artificial Sequence
  Description of Artificial Sequence: Synthetic coding sequence
atgaatcaagtgaccattcaatgggacgccgttatcgccctttacattctattcagctggtgtcacggcggaatcacaaatattaactgtagtggccacatttgggtggaacctgctactatctttaaaatgggtatgaacatctcaatttattgccaagcggcaatcaagaattgccagcctcgaaaattacacttttacaagaacggaatcaaggagagattccagattacaagaatcaacaagaccacggctcgcttatggtataagaattttctggagccacacgcaagcatgtactgtacagccgaatgtcccaaacactttcaggaaacactcatatgtggtaaggacatctcgagcgggtaccccccagatatcccagatgaagtgacctgcgtaatctatgaatactccgggaacatgacttgcacctggaatgctggcaagctaacatacatcgacactaagtacgtggtgcacgtaaagtctctggaaaccgaggaagaacagcaatatctgacatccagctatattaacatatctaccgacagcctgcagggtgggaagaagtacctcgtgtgggtgcaggccgctaacgcccttggtatggaggagtctaagcagctgcagattcacttggacgatattgttattccttctgccgctgtgatatcgagggcagagaccatcaacgccactgtccccaagacgatcatctactgggacagccaaactaccatcgagaaggtcagctgtgaaatgcgttacaaggccacgaccaatcagacatggaacgtgaaagagtttgatacgaatttcacatatgtgcagcagtctgagttttatctggaaccaaatatcaaatacgtgtttcaggtgcggtgccaggagaccggcaaacggtactggcagccttggtccagcctgttctttcacaaaacgccagaaaccgtgccccaggtgacaagcaaggcctttcaacatgacacctggaattctggactcactgtggcttctatctccacaggccatctaacttcagacaacaggggggatattggactgctgttgggtatgattgttttcgctgtcatgctgagcatcctatccctgattggaattttcaacaggagcttccgaaccggaatcaaaaggcggattctgctccttattcctaagtggctgtatgaagatatcccaaacatgaaaaacagtaacgtggttaaaatgctgcaggaaaactccgagcttatgaacaacaacagctccgaacaagtcctttacgtcgaccccatgatcaccgagatcaaggaaatttttatccctgagcacaaacccactgactataagaaagaaaacaccggtcctctggagacccgcgactatccccagaactcactgtttgataacacaactgtggtgtacatcccagacctaaacaccggctataagccacagatttcaaactttttacctgagggatcacatctgtcaaacaacaatgagattacatcactgaccctgaaaccgccagttgacagtttggatagcggcaacaacccccgactgcagaagcatcccaatttcgccttctccgtttcttccgtaaactcactgtccaacaccattttcctgggcgaattgagtttaatcctgaaccagggtgaatgcagctctcccgatatacagaattcagtagaggaggagacaaccatgctgctcgagaacgattcaccctcggagacaattcctgagcagaccctgctgcccgatgaattcgtgtcctgtctcgggattgttaacgaagagctcccatctatcaatacttattttccccaaaacatccttgagtcccatttcaaccgaatttcactgctcgaaaagtag

SEQ ID NO: 4961 - DNA, 1071 bp, Artificial Sequence
  Description of Artificial Sequence: Synthetic coding sequence
atgaatcaggtaactattcagtgggatgccgtcatcgccctctacatcctgttctcatggtgccacggaggaatcaccaatatcaattgcagcggccatatctgggttgaacccgcaactattttcaaaatggggatgaatatttctatttattgccaggccgctattaaaaactgccagcctagaaagctccatttttataaaaatggaattaaggagaggttccagatcactcggatcaataagaccacagccaggctctggtacaagaactttctggaaccacatgcctccatgtattgtacagccgagtgcccaaaacactttcaagaaaccctgatctgcggtaaggacatctccagtggttatccgccagatatacccgacgaggtgacatgcgtgatttacgagtatagcggcaacatgacgtgcacctggaacgcagggaagctaacctatatcgacactaagtacgtggtgcacgttaaaagcctggagaccgaggaggagcaacagtacctgacctcctcctatatcaacattagtacggacagcctgcaggggggtaagaaatatctggtgtgggtgcaggctgcgaacgcacttggcatggaggagtccaagcagctgcagattcacctggatgatatagtgataccatcagctgcggttataagtcgtgcagaaaccatcaacgcgactgtcccgaagacaattatttattgggacagccagaccacgatcgaaaaggtgagctgtgagatgcgctataaggccaccactaaccagacttggaacgtgaaagaatttgacacaaacttcacgtacgttcagcagagtgaattttaccttgagcctaatatcaaatacgtgtttcaggtacgatgtcaggagacgggtaagagatactggcaaccctggtcttctctctttttccataagaccccggaaaccgttccacaggtgacctcaaaggcgttccagcacgatacatggaacagcggcttgaccgttgcgtcgatatcaacggggcatctcaccagtgggctcaaagaggggtcatattgttag

SEQ ID NO: 4962 - DNA, 1125 bp, Artificial Sequence
  Description of Artificial Sequence: Synthetic coding sequence
atgatcttacgaccatatcagccttgcggcaccgtgaaagagtttgacactaacttcacctacgtgcagcaatccgagttctatttggaacccaacattaagtacgtgttccaggtccgctgccaagagaccgggaagcgctattggcagccatggtcgtccctgttctttcataagacacccgaaactgttcctcaggttacgagtaaggcttttcaacacgacacctggaactctggccttactgttgcttctatatctacaggccacctgacttccgacaacaggggggacatcggcctgttgcttggtatgatcgttttcgcagttatgctcagcatcctgtctctgattggaatttttaaccggtctttccggactgggatcaagcgccgaattctgttactcattccaaaatggctgtatgaggatatacccaatatgaaaaacagtaatgtggtgaagatgctgcaggagaattccgagctgatgaacaataactcttccgagcaggtgttgtatgtagacccaatgatcaccgaaattaaggagattttcatacccgagcataaaccaaccgattataagaaggagaacactggccctttggagacccgggattatccccagaacagcctttttgataatacgactgtagtttatattcctgatctcaatacaggttacaagccgcagatctctaactttctgcctgagggctcccatctgtccaataacaatgagatcacctccctgaccctcaagccccctgtggactcgttagattccgggaataatccaagacttcagaaacatcccaatttcgcctttagcgtctcgtcggttaatagcctgtccaatacgatatttcttggagaactgtctctcatacttaaccagggcgaatgctctagccctgacatacagaatagcgtcgaggaggagacaaccatgctgttggaaaacgatagtccctccgaaacaatcccggaacaaaccctgctgccggatgaattcgtcagttgcttgggaatagtgaatgaagaactgccctctatcaatacatactttccccagaacattctcgaatcccactttaatcgtattagtctgctggagaagtag

SEQ ID NO: 4963 - DNA, 354 bp, Artificial Sequence
  Description of Artificial Sequence: Synthetic coding sequence
atgacctgcacttggaacgcaggaaagctgacctacatcgatacaaaatatgtggtccacgtcaagtctcttgagaccgaggaggaacaacagtatctgacatctagctacattaacatcagcaccgacagcctgcagggaggtaaaaagtacgtctttcaggtgaggtgccaagaaacagggaaaaggtactggcaaccctggtcctctctcttttttcacaagacaccggagaccgtgccccaggttacatctaaagcattccagcacgatacttggaactctggcctaactgtcgcatctatctctacaggccacttgacaagcgggttgaaggagggaagctactgctag

SEQ ID NO: 4964 - DNA, 1176 bp, Artificial Sequence
  Description of Artificial Sequence: Synthetic coding sequence
tgacacttcctcctgccccctctgtctaagaagagcctcctacctcccaccatgatacttagaccatatcaaccctgtggcaccgtgaaagagtttgacaccaatttcacttatgttcagcagtcggagttctacctcgagcccaatatcaaatatgtctttcaggtgcgctgtcaggagaccggaaaaaggtattggcagccttggtcctctctgttctttcacaaaactccagaaaccgtcccccaggtcacgtccaaggcctttcagcatgacacttggaacagtgggctcaccgtcgctagcatcagtacgggccaccttacctctgataaccgcggagacattggactcttgttagggatgatcgtgttcgctgtgatgctctccattctgtcactgatcggcatttttaacaggtcatttcggacaggaatcaaacgtagaatactgctcctgattcccaagtggctctacgaagacattccaaacatgaaaaactccaacgtggtgaagatgcttcaggagaattcagaattaatgaacaataactcatccgagcaggtgctgtacgtggacccaatgattaccgagatcaaagaaatcttcatccctgagcataagcccaccgattataagaaggagaacaccgggcctctcgaaacccgggactatccccagaattcacttttcgataatacgacggtagtgtacatcccagaccttaacactggctataagccccagatttctaattttctgcctgagggaagccatctttcgaacaataacgaaattacgtctctgaccctgaagccccctgtagacagcctggactcgggaaataaccctaggctccagaaacacccaaatttcgccttctccgtaagtagcgtaaactctttgtccaatacaatctttctgggagaattaagcttaattctaaaccagggtgaatgttctagtcctgatattcagaacagcgtcgaggaagagacaaccatgctgctggaaaacgacagcccatccgaaacgatacctgaacagacccttttgcccgatgaatttgtctcctgtctgggcattgtgaacgaagagcttccctccattaacacttacttcccccaaaatatcctcgaatctcactttaatcggatttccttactggagaaatag

SEQ ID NO: 4965 - DNA, 828 bp, Artificial Sequence
  Description of Artificial Sequence: Synthetic coding sequence
atgacctgcacatggaatgccggaaaattgacttatattgacacaaagtacgtagtgcacgtaaaatccctcgagaccgaggaagaacaacaatacctgacctccagctatatcaatatcagtacggacagtttgcagggcggaaagaagtacctagtatgggtccaggcagctaacgcactggggatggaggagtctaagcagcttcaaatccacttagatgacattgtcataccttccgccgctgttatcagcagggcggagactatcaatgccactgtgcccaagacaattatctactgggactcccagacaacgattgagaaggtgagttgcgaaatgcggtacaaggccacaacaaaccagacctggaacgtgaaggaatttgacaccaatttcacttatgtacagcagtctgaattctacctagaacctaacattaaatatgtgttccaggtgcggtgtcaagagacggggaagagatactggcaaccctggtcttccctattcttccataaaactcccgaaacagataatcgcggagatatcggcctgttgctggggatgatagtgttcgctgttatgctgtcaattctaagtttgatcggcatatttaaccgcagcttcaggacaggcatcaagcgacgaattctcttgctgattccaaaatggctctacgaagatatccctaatatgaagaactcgaatgtggtgaagatgctccaggaaaattccgagctgatgaataataatagctccgaacaggttctgtacgtcgatcctatgatcactgagatcaaagagatctttattcccgaacataagtag

SEQ ID NO: 4966 - DNA, 615 bp, Artificial Sequence
  Description of Artificial Sequence: Synthetic coding sequence
atgacatgtacatggaatgcaggaaaactgacctatatcgatacaaagtacgttgtacacgtcaagagtctggagactgaagaagagcaacagtaccttacttcctcttacatcaacatctcaaccgactccttacaaggcggtaagaagtatttggtttgggtccaggctgctaatgcgctcggaatggaagagtctaagcaattgcagattcaccttgacgacatcgtccctcaggtcacaagtaaggcattccagcacgacacttggaactccggactcacggtggcaagtatctcaacagggcatctgacctcagacaacagaggtgacattggacttctgctgggcatgatcgtctttgcagtgatgctgtcaatactctccctcatcggcatcttcaatcgaagcttcagaactggtattaagagacgcatactccttctcatcccaaaatggctgtatgaagacattcccaacatgaaaaacagtaatgttgtgaagatgctacaagagaattcagaactgatgaacaataatagtagcgaacaggttctgtacgtggaccccatgataacagagataaaggaaatatttatcccagaacataagtag

SEQ ID NO: 4967 - DNA, 441 bp, Artificial Sequence
  Description of Artificial Sequence: Synthetic coding sequence
atgaatatttctatatactgccaagctgcaattaaaaactgccagcccaggaagctgcacttctacaagaacggcattaaagagcggttccaaattacccgcataaacaaaacaacggcgcgtctgtggtataagaacttcttggagccacacgcatcgatgtattgtaccgctgagtgccctaagcacttccaggaaaccttgatttgtgggaaggatatctcgagcggttaccctccagatattcccgacgaggtaacatgtgtcatatacgaatatagcggaaacatgacctgtacctggaacgccggtaagctaacatatatagataccaaatacgtggttcatgtcaagagactgaagaatctaacaccaattctgcatatgtgtaattcgcagaactctacatggagtcaaacattaagtacatattttaagtag

SEQ ID NO: 4968 - DNA, 429 bp, Artificial Sequence
  Description of Artificial Sequence: Synthetic coding sequence
atgacttgcacttggaacgctgggaaactgacctatattgacaccaagtatgttgtccacgtgaagagccttgagaccgaagaggagcagcagtatctgacgtccagctatatcaacatatccaccgattcactgcaaggcggaaaaaaatacctggtctgggtacaggcagcgaatgctctgggtatggaagagtccaaacaactgcagatccacctggacgacattgtgatcccctcagctgcagtgatatctagggctgagacgatcaacgccacagtcccaaaaaccattatctactgggatagtcagaccaccatcgagaaggtctcttgcgaaatgcggtataaggcaacgacaaaccaaacttggaactttcccagatcacaccaaaaacacagtaacatgacacatggtattctgggctag

SEQ ID NO: 4969 - DNA, 669 bp, Artificial Sequence
  Description of Artificial Sequence: Synthetic coding sequence
atgaatatatctatttactgccaggctgcgatcaagaactgccagcccaggaagctgcatttctacaaaaatggcatcaaagaacgctttcagataacccgtataaataagaccaccgctcgcctttggtacaaaaacttcctggaacctcatgcctctatgtactgcaccgccgaatgcccaaaacatttccaagaaacacttatttgtggcaaggacatttccagcggctacccccctgacatcccagacgaggttacttgcgtgatatatgagtatagcgggaatatgacttgcacatggaacgcagggaaattgacatatattgataccaaatatgtcgtacacgtcaaaagtcttgaaaccgaagaagagcagcagtacctcacatcaagctatattaacatcagtacagattccctccagggcggaaagaaatatctagtgtgggttcaggccgctaacgctttgggtatggaagagagcaagcaattacagatacacctcgatgacatcgtgatcccttcagccgcagtcatctccagggccgaaacgataaacgcaaccgtacctaagaccatcatttattgggactcacagacaacgatcgaaaaggtgtcttgcgagatgcgatataaggctaccaccaatcagacttggaacgattag

SEQ ID NO: 4970 - DNA, 1632 bp, Artificial Sequence
  Description of Artificial Sequence: Synthetic coding sequence
atggatgcctttactggatctggactgaagaggaagtttgatgacgtggatgtgggttcttctgtgtctaacagtgatgacgagatctcctctagcgatagtgctgacagctgtgattccctgaatcccccaacaactgccagttttaccccaaccagtattctgaagagacaaaagcaactcagacgaaagaatgtgcggttcgatcaggtgacagtgtactatttcgctcgcaggcaggggttcacgtcagtaccttcgcagggtggtagctccctagggatggcccagcgccacaattcagtgaggtcatatactctgtgtgagtttgcccaagagcaagaagtaaatcacagagagatactgcgggagcacctgaaagaggagaagcttcatgccaagaaaatgaaactcactaaaaacggaacagtggagtccgtcgaagcagatggcttaacactggatgatgtgagcgacgaggacattgacgttgagaacgtggaggtcgacgactatttctttcttcaaccccttcctactaagcgacgtagggcgttacttcgcgctagcggagtccatcggatcgatgccgaagagaaacaagaacttcgtgccatccggcttagccgggaggaatgcggatgtgattgtaggctgtattgcgaccccgaggcctgtgcctgttctcaggctggcattaagtgtcaggtcgacagaatgtcctttccttgcgggtgttctagagatggctgcggtaacatggccggaagaatagagttcaaccccattagagtcagaacacattacctgcataccatcatgaagcttgagctcgaatccaagcgtcaagtttctcgccctgctgcccctgacgaagagccctcgcccaccgcctcttgttccctgactggggcacagggctctgaaacacaggactttcaggaatttattgccgagaacgagaccgctgtgatgcacctccagtcagcagaggagctcgaaagactcaaagcggaagaggattcttctggcagcagcgcctcacttgacagctctattgagtccctgggcgtctgcatactcgaagaacccctggccgtgccggaagagttatgccctggcttaaccgcaccgatcctaatccaggcgcaattgccaccaggttcatcagtcctatgcttcaccgaaaatagtgaccaccccaccgcatctaccgttaatagccctagctatttaaactctggcccactggtatactatcaggtcgagcagagaccggttttaggcgtcaagggggaacctgggacagaggagggaagtgcgtcatttcctaaagagaaagatcttaatgtttttagtttgccggtgacctccctcgtcgcctgctcatccaccgatccagctgctctatgtaaatcggaagtgggaaagaccccaaccctggaggctctgctacccgaagattgtaaccccgaagaacctgaaaacgaggatttccaccccagctggtcacctagcagcctacctttcagaacagacaacgaagaaggatgtggcatggtcaagacatctcaacagaacgaggatcgtccacctgaagatagttcacttgagctgccactagccgtatag

SEQ ID NO: 4971 - DNA, 621 bp, Artificial Sequence
  Description of Artificial Sequence: Synthetic coding sequence
atgaattttcaacagagactgcagagcctgtggacacttgcaaggcctttttgcccaccattactcgctacagcttcacagatgcagatggtggtgctcccctgccttgggttcacacttctgctctggagtcaagtcagtggggcacagggacaggagttccacttcggcccatgccaggtcaagggggtcgttcctcagaagctgtgggaggcgttttgggcggtaaaggacacgatgcaggcacaggacaatattacaagcgcccgacttctgcagcaagaagttttacaaaacgtctcagatgccgagagctgttacttagtgcacactctgctcgagttctacctgaaaaccgtcttcaaaaactatcataaccggactgtagaagtgcgtacactgaagtcttttagtactttagctaataacttcgtgcttatagtaagccagctgcagccatctcaagagaacgaaatgttctccatcagggatagcgctcacagaagattccttctgttcaggcgggcattcaagcagctggacgtggaggccgcactgactaaagccttaggcgaagtggacattctgctaacatggatgcagaagttctacaaattatag

SEQ ID NO: 4972 - DNA, 465 bp, Artificial Sequence
  Description of Artificial Sequence: Synthetic coding sequence
atgaatttccagcagcgtctgcaatccctgtggacactggcctcaagacccttctgtcctccactgctggcgactgcgtctcagatgcagatggtggttctgccatgcttggggtttacattgcttctttggagccaagtctccggtgctcagggacaagagtttcacttcgggccatgccaggtgaagggggtcgtcccccaaaagctttgggaagccttctgggccgtaaaggatactatgcaggctcaagacaacataaccagcgctagactgctacaacaggaagtgctgcagaatgtctcacaggagaatgagatgttcagcattagggactccgcacaccggaggttcctactctttcgacgcgcatttaaacaactagatgtggaggcggcactgacaaaagccctgggggaagtggatattctactaacttggatgcagaagttttacaagctttag

SEQ ID NO: 4973 - DNA, 624 bp, Artificial Sequence
  Description of Artificial Sequence: Synthetic coding sequence
atgaactttcagcagcgtttacaatctctctggaccctggcctcgcgcccattttgccccccactgctggctactgcgtctcaaatgcaaatggttgtgctgccatgtctggggttcacgcttctgctctggagtcaggtttctggcgcacagggacaggaattccacttcggtccatgtcaggtgaagggcgtggtgccacagaagctgtgggaggccttctgggccgttaaggacaccatgcaagcccaggacaatattacgagtgcgagattactgcagcaggaagtgctgcagaacgtctccgatgcagaatcatgttacctggtgcacacgctgctggaattctatctgaaaacagtttttaagaattaccacaaccgcaccgtggaagtccggacactgaaatccttcagtacactcgcaaataacttcgtgttgatcgtgagccagctacagcctagccaggagaatgagatgtttagtattcgtgacagcgcccatcggcgtttcctcttgttccgcagggcatttaaacagcttgatgtagaggcagcactgaccaaagctctcggagaagtggacatcttgctcacatggatgcaaaagttctataagctctag

SEQ ID NO: 4974 - DNA, 534 bp, Artificial Sequence
  Description of Artificial Sequence: Synthetic coding sequence
atgcgggaacgacccaggctgggggaggactcttcactgatctccctgttcctgcaggttgtggcctttctggccatggtgatgggcacacacacttatagccattggccctcctgctgtcctagcaaaggccaagatacaagcgaggagctgcttcgctggtccaccgtgccagtccctcccttggagcctgccaggcccaataggcatccggagtcctgtcgtgccagtgaggacgggcctctgaactccagagctatatcaccatggcggtacgaactcgatcgagacctgaataggctgccccaggacctgtatcatgcacgctgcctgtgtccacactgcgtgtcgctgcaaacggggtcccatatggatccccgaggcaattctgagctcctttatcataatcagaccgtgttttataggcggccatgccatggtgagaaaggcactcataaaggttattgtctggagcggcgtttatatcgagtaagtctcgcgtgcgtgtgtgtgcgccctcgggtgatgggttag

SEQ ID NO: 4975 - DNA, 486 bp, Artificial Sequence
  Description of Artificial Sequence: Synthetic coding sequence
atgtaccaggtcgtcgcatttcttgcgatggtcatgggcactcatacctattcccattggccctcttgctgtccaagcaaaggtcaggacacaagcgaggagcttttgcggtggagcacggtgcctgttccacctcttgagccggcacgtcccaatcgccatcccgagtcttgccgcgctagcgaggacggtcctctgaactctagggccatcagcccttggcggtacgaactcgatagagatttgaatagactcccacaggatctgtaccacgcaagatgtctctgtccccactgcgtaagcctccagaccggttcgcacatggacccccgagggaactccgagctgctttatcacaaccagacagtattctataggaggccatgtcatggggaaaaggggactcataaaggatactgtctggaacggaggctgtacagggtttctctcgcatgtgtctgcgtccggccacgagtaatgggttag

SEQ ID NO: 4976 - DNA, 2775 bp, Artificial Sequence
  Description of Artificial Sequence: Synthetic coding sequence
atggacgtcttaccaacaggcggaggaaggcctggactccgaaccgagctggagtttcggggtgggggaggggaggctcgcttggaaagccaggaggaggagacaattcctgctgctcccccagccccacgcctcaggggcgctgctgagcgacctagaagatcacgggacacgtgggacggggatgaagatactgagccaggggaggcctgtggtggacgcactagcagaactgcctcactcgtcagcggcctgctaaacgagctgtattcttgtacggaggaggaagaggcggctggcggtggtagaggagccgaggggaggaggaggcgacgcgactcacttgattcatctactgaggcctctggtagtgacgttgtgctggggggaaggtccggcgctggagacagccgcgtcctccaagaactgcaggagcgaccctcgcaacgtcatcaaatgctttacctgcgacaaaaagatgccaatgaactcaaaactattctgcgcgagctaaagtacaggatcggtatccagtctgccaagttgttacgccacttgaaacagaaggataggttgctgcacaaagtgcaacgtaactgtgatatagttaccgcatgtctccaggctgtctcacagaagagaagagtggacactaagctcaaattcaccctcgaacctagccttggccagaacgggttccagcagtggtacgatgccctcaaggccgtcgcacggctcagcacaggtatccctaaggagtggagacgcaaggtgtggcttaccctcgctgaccattacttgcactcaatcgccattgactgggataaaacaatgcgctttacattcaatgaacgctccaacccagacgacgacagtatgggcatccaaatcgtgaaggatctacataggacaggctgctcttcatattgcgggcaagaagccgagcaggatcgtgtggttctcaagcgcgtactgctggcgtacgccagatggaataaaacagttggttactgtcagggctttaacattctcgccgcattaatcctggaagtgatggagggaaacgagggggatgctctgaaaatcatgatctatcttattgataaagtcctccctgagagttacttcgtgaataatcttagggctctgagtgtggacatggccgtgtttagagatctgctccgcatgaagctaccagagctctcccaacacttggacacccttcaacgcactgcgaacaaagagtctgggggaggatatgaaccgcctttgaccaacgtgttcaccatgcagtggtttcttaccctcttcgccacctgcctccctaatcagaccgtgctaaaaatttgggattccgtgttttttgaggggagtgagatcatccttcgcgtgtctctcgcgatttgggcaaagctcggagagcagatagagtgttgtgaaacagcagatgaattctattccacaatgggacgcctgactcaggagatgttagagaatgacttgcttcagtcacacgagctgatgcagaccgtatattctatggcccctttcccatttcctcaactggctgaactgcgagagaaatatacatacaatatcactccctttccggctaccgtaaaacctacgtctgtgagcggcaggcactcaaaagccagggactccgacgaggaaaacgatcctgacgacgaggacgcagtggtaaacgcagtgggctgtttaggccctttctctgggtttttggccccagagctccaaaagtaccagaagcagatcaaagagcccaatgaggaacaatctctcaggagcaataacatcgctgagctttctccgggtgccatcaattcctgtcggtccgaataccacgccgcttttaattctatgatgatggaacgaatgaccaccgacatcaacgccttaaagcggcagtattcaagaatcaaaaagaaacagcagcagcaggtgcaccaggtctatataagggctgataaaggacctgtgacgtctatactcccaagccaggttaattcaagtcccgtcattaatcatctgctattgggcaaaaagatgaagatgacgaaccgggctgccaagaatgccgtaattcacatccctggccatactggcggtaaaatttcacccgtgccgtacgaagacctgaaaaccaaattaaacagcccatggcggacccatatcagggttcataagaaaaatatgccccgaacaaaatcacatccaggatgcggtgataccgtggggctgattgacgaacagaacgaagcctctaaaacaaatggactgggagccgcagaagcttttccaagtggatgcaccgccactgccggacgcgagggctctagccccgagggaagcacacggcgtactatagagggacagtcccccgagcccgtgtttggagatgctgatgtggatgtctccgccgtgcaggcaaaactgggggctttagagctcaatcagcgggatgccgcagctgaaacggagctacgagtgcatcccccttgccagaggcactgccccgaaccacctagtgcgcctgaggagaataaggccacctcaaaagctcctcagggtagtaacagcaaaactcccatcttctcacctttcccctccgttaagccactccgaaaatctgcaactgctcgcaaccttgggttatacggcccaaccgaaaggaccccaactgtccattttccacagatgtctcgctccttctctaagccgggaggaggcaacagcggcactaagaagcgctag

SEQ ID NO: 4977 - DNA, 732 bp, Artificial Sequence
  Description of Artificial Sequence: Synthetic coding sequence
atggggcaaacggctggagatttaggatggaggcttagtttgttgttgctcccacttctcctggtgcaagctggtgtctggggcttccccaggccccctggcaggccccaattatccctacaggaattaagaagggagttcaccgtttccttacacctggctcgcaaactcttgtcagaggtgcgcggacaggctcatagattcgccgagagccatctgcctggcgtgaacctttacctgctgcctttgggcgaacagcttccagatgtatccctgaccttccaggcctggcgacgcctgtcagaccccgaacgcctctgttttatttccactactcttcagcctttccacgcactactggggggattgggaactcaggggcgatggaccaacatggaaagaatgcagctttgggccatgcggttggaccttcgtgatctgcagcgccatcttaggttccaagtcttggcagctggatttaatctgcccgaggaagaggaggaagaggaggaggaggaggaagaggagcgcaaaggattactgcccggagccttaggatcagccttgcaaggacccgctcaggtttcgtggcctcaactgttaagcacctaccgccttcttcacagcctggagctggtgctgtctcgcgctgtcagagaactgctcttattatccaaggccggtcattctgtgtggcccctcggttttcccacactgtccccacagccatag

SEQ ID NO: 4978 - DNA, 603 bp, Artificial Sequence
  Description of Artificial Sequence: Synthetic coding sequence
atgaaactagacatgaccggcgattgtacccctgtgttggttctgatggcggcagtcctgaccgtaacaggcgcagtgccagtggcaaggctccatggagccttacctgacgccagaggatgtcatattgctcagtttaagtcgcttagtccccaggagctccaggcttttaagagagccaaggacgcccttgaggagtcactactgttaaaggactgcaggtgtcactctcggctctttcccagaacctgggacttgcgccaactccaggtccgtgagaggcccatggcattggaggcagaattggccctgactctgaaagtcctggaggcaactgccgatacagacccagctctcgtagacgtcctggatcagcctctgcacacactgcaccacatcctttcacagttccgagcctgcattcaaccgcagcccactgctggccctcgaacacggggtagactacaccattggctctaccggctccaggaagctcccaagaaagagtctcctggctgcctcgaagcgtctgtgacattcaatcttttccgcctgctgacccgggacctcaactgcgtggcaagcggtgacctgtgtgtgtag

SEQ ID NO: 4979 - DNA, 591 bp, Artificial Sequence
  Description of Artificial Sequence: Synthetic coding sequence
atgacaggtgactgtatgcccgttctagtattgatggcggcagtattaaccgtgactggggctgtgccagtggcacgcctgagaggggctcttcccgatgcacgagggtgccacatcgcccagtttaaatcgctgtctccgcaggaactacaagccttcaaacgcgctaaagatgctctggaggaatcccttttactgaaagactgcaagtgcaggtcaagattgtttcccaggacgtgggacctgcggcagttgcaggtccgggaaaggccagtagccctggaagccgagctggcactcaccctgaaggtattggaggctacggctgatactgacccagccctcggcgatgtgctagaccagcctctacataccctccaccatatcctgagccagttacgggcttgtatccagcctcagcctactgcagggccaagaacaaggggacggctgcatcattggttgcaccgtttacaggaagccccaaaaaaggagtctccgggttgcctggaggctagcgtcacatttaatctcttcagactcttaacccgggaccttaattgcgtggcaagcggagatctgtgcgtgtag

SEQ ID NO: 4980 - DNA, 603 bp, Artificial Sequence
  Description of Artificial Sequence: Synthetic coding sequence
atggctgctgcctggaccgtggtattggttaccttagtcctggggctggcagttgccggaccagtgccgacatccaagccgacaacaacggggaagggctgccatatcggaaggttcaaatccctgagtcctcaagagctggcaagctttaaaaaagcgagggatgctctggaggaatcactgaagctgaagaattggagctgctccagtcctgtcttccccggaaattgggacctgcgcctcctgcaggtgcgggaaaggccagtggccctggaggctgagctggcactaactttgaaagtgctagaggccgcagcgggacccgctctggaagatgtcctcgatcagccactgcacaccctgcatcacattttgtcccagctgcaagcctgtatccagcctcagcccactgcagggccacggcctcggggaaggttgcatcactggctccacaggctgcaggaggcaccgaagaaggagtcagcaggctgtctggaggcgtctgtaaccttcaacctgtttcggctcctgaccagggatctaaagtacgttgcggacggaaatctgtgcctacgcacatcaacgcatcctgaatccacgtag

SEQ ID NO: 4981 - DNA, 495 bp, Artificial Sequence
  Description of Artificial Sequence: Synthetic coding sequence
atggcatctcatagcggcccatcaacatctgtactatttcttttctgctgccttggcggttggttagcttctcacacccttcccgtgcggctactgaggccatccgacgacgtgcagaaaattgtcgaagagctgcagagtctgtccaaaatgcttttgaaagatgttgaggaggagaaaggcgtgctggtgtctcaaaactacaccttgccctgtctttcacctgacgcgcaaccaccaaataacatacattcaccggctatcagagcgtacttgaaaacgattaggcagctggataataagagcgttatcgatgaaattattgaacatctggataaactgatcttccaggatgccccagaaaccaacattagcgttcccactgacacacatgagtgtaaacgcttcatcctgacgatttcccagcagttctccgaatgtatggatttagccctgaagagcctcacctctggtgcccagcaagcgactacctag

SEQ ID NO: 4982 - DNA, 507 bp, Artificial Sequence
  Description of Artificial Sequence: Synthetic coding sequence
atgtgtttcccaaaagtgttgagtgacgacatgaagaagctcaaagcacgcatggtcatgtcatcactggccgagctcgaggacgacttcaaggaaggttacttggagaccgttgcagcctactatgaagagcaacaccctgaactgactccactgctcgaaaaggaaagggatggcttaaggtgtaggggcaaccgaagtcccgttcctgacgtggaggaccccgcaaccgaagagccaggcgaatcattttgtgacaaggtcatgcgctggttccaggcaatgctccaacgccttcagacttggtggcatggcgtcctggcctgggtgaaagaaaaggttgttgcgctggttcacgcagtacaagcgctgtggaagcagttccagagtttctgctgcagtctgtccgagctgttcatgtcgagcttccagagctatggagcaccacgcggagacaaggaagaactgactccgcagaaatgttctgagccccagtctagcaagtag

SEQ ID NO: 4983 - DNA, 567 bp, Artificial Sequence
  Description of Artificial Sequence: Synthetic coding sequence
atgtgctttcccaaagtcctgtccgatgatatgaagaaactcaaggctcggatgcaccaggccatcgaacggttttacgacaaaatgcagaacgcagaatcaggacggggtcaggttatgagctctctagcagaactggaggacgattttaaggaaggatatctcgaaacggttgctgcctactacgaagaacagcatcctgagctgaccccgcttctggagaaagaaagagacggactgcggtgccgcggaaaccgcagtcctgtccctgacgtcgaagatcccgcaaccgaagagcccggagaaagtttctgcgacaaagttatgaggtggttccaggccatgctgcagcgtctacaaacctggtggcacggggtgctagcctgggtgaaggagaaggttgtggccctcgtccatgccgttcaggctctgtggaaacagtttcagtctttttgttgttccctgagcgaattgttcatgtcttctttccaaagttatggggcaccacggggagacaaagaggagctgacgccccagaagtgctctgagccacagagcagcaagtag

SEQ ID NO: 4984 - DNA, 540 bp, Artificial Sequence
  Description of Artificial Sequence: Synthetic coding sequence
atgtgcttcccaaaggtcctgtccgacgatatgaagaaacttaaagcccgtatgcatcaggctatcgaacggttttacgataagatgcagaacgctgaaagtggcagaggccaggacgattttaaggaagggtatctggagaccgtggcggcttattacgaggaacaacatcccgaactaacccctctcctggagaaggagagggatggattaaggtgtaggggcaacagatcaccggtacccgatgtggaagatcccgctactgaggaaccaggagagtcattctgcgataaagtgatgcggtggttccaggcgatgctgcagagactgcagacttggtggcatggggtgctggcctgggttaaagaaaaggtcgtagctcttgtgcacgctgtgcaggcattatggaagcagttccaaagcttctgttgttctctgtccgagctattcatgtcatccttccagtcttatggagcacctagaggtgacaaagaggagcttaccccacagaaatgtagtgagcctcagtcttccaagtag

SEQ ID NO: 4985 - DNA, 396 bp, Artificial Sequence
  Description of Artificial Sequence: Synthetic coding sequence
atgtgctttcccaaagtcctaagtgacgacatgaagaagctcaaggctcggatgcaccaggcaatcgaacgattctatgacaagatgcaaaatgccgaaagcgggagaggtcaagttatgtcaagtcttgctgagttagaggatgacttcaaggagggctacttggagactgtggctgcctactatgaggagcagcatcccgaactaaccccactcttagagaaagagagggatgggttgcgctgtagggggaatagatcgccagtgcccgacgtcgaggaccctgctacggaagaacctggcgagagtttttgcgataaaagctacggggcacctcggggagataaggaggagttaaccccccagaaatgttcagaacctcagtcaagcaagtag

SEQ ID NO: 4986 - DNA, 705 bp, Artificial Sequence
  Description of Artificial Sequence: Synthetic coding sequence
atgtgcttcccaaaggttctctctgacgatatgaagaaactaaaagctcggatggtcatgttactgccaacatcggcccagggcttaggcgcatgggtctctgcctgtgatacagaggatacagtcggtcatttgggcccatggcgagataaggatcccgctctgtggtgccaactctgcctttcctcacaacaccaggccatagaacgattttacgataagatgcagaatgctgaatctggacgaggacaggtaatgtctagtctggccgagctggaggacgactttaaagagggctacctggaaacagtagcggcttactacgaagagcaacacccggagctcacgcctctgcttgaaaaggaacgtgatggtctgcggtgtagagggaaccgctcacctgtccccgacgtcgaagatccggcaactgaggagccgggtgaaagcttctgcgataaagtcatgcgatggtttcaagctatgctgcaacggctgcagacctggtggcatggtgtcctggcttgggtgaaagagaaagtggtggccttggtccacgctgtgcaggccctttggaagcagtttcagagcttctgctgttctctgagcgaattgtttatgagctccttccagagttacggggcacctcggggtgacaaagaggaacttacaccacagaaatgctcagagcctcagtcaagcaagtag

SEQ ID NO: 4987 - DNA, 567 bp, Artificial Sequence
  Description of Artificial Sequence: Synthetic coding sequence
atgtgtttcccaaaggtgctaagcgacgatatgaaaaaactgaaggcacgcatgcaccaggccatcgagaggttttacgataaaatgcagaatgctgagtcaggtaggggccaggtgatgtcatccctagctgaactggaagatgacttcaaggaagggtacctagaaacggtcgctgcctattatgaagagcagcatcctgagctgacgcccctgttagaaaaggagcgcgatggtttgcgctgtaggggcaaccggagcccagtgccagatgtggaagatccagcaactgaagaacccggagagtctttctgcgataaggtcatgcgttggtttcaggccatgctgcagcgcctgcaaacatggtggcatggggtcctggcatgggtgaaggagaaagtcgtggcccttgtacacgccgtgcaggccctgtggaagcagttccagtctttctgttgctccctgagcgaactgtttatgtcttcatttcagagttatggcgcaccacggggtgataaagaagagctgacaccacagaagtgctctgaaccacagtcctcaaaatag

SEQ ID NO: 4988 - DNA, 567 bp, Artificial Sequence
  Description of Artificial Sequence: Synthetic coding sequence
atgtgtttcccgaaggtgctgtcagatgacatgaaaaaacttaaagctcgtatgcatcaagcaattgaacgtttttacgataagatgcagaatgctgagtctggtagggggcaggttatgagcagtctggctgagctggaggacgactttaaggagggctatttagagacagtggcagcctactacgaagagcagcatcccgaacttactcctctgctggagaaagaaagagatggccttagatgccgaggcaatcgatcacctgtccctgacgtggaggatcctgccaccgaagagcctggagagtctttctgcgacaaagtgatgcgctggtttcaagccatgttgcagcgtctgcagacttggtggcatggggtgctcgcatgggtgaaggagaaggtggtggccttagtgcatgcagtccaagcgctctggaagcaatttcaaagcttttgttgcagtctgtctgagctgttcatgtcctcttttcagtcctacggcgctccacgaggagataaagaagagcttacgccacagaaatgttccgagcctcaatcttcaaaatag

SEQ ID NO: 4989 - DNA, 567 bp, Artificial Sequence
  Description of Artificial Sequence: Synthetic coding sequence
atgtgtttccctaaggtcctgagcgatgatatgaagaagctcaaggcacgtatgcaccaggccatcgagcggttttacgataagatgcagaatgcagaatcaggtagaggacaagtgatgtcctcattagcagagttggaagacgacttcaaagagggttacctggagacggtggcggcatattatgaagaacagcacccagaacttacacctttattagagaaggagcgggacggcctgaggtgtcggggaaatcggtcgcccgtgccagacgtggaggaccctgctacagaagagccaggtgagtccttttgcgataaggttatgcggtggtttcaggctatgctccagcggctgcaaacttggtggcacggcgtcctggcgtgggtgaaagagaaggtagtagcccttgttcacgctgtccaggctctatggaagcaattccagtccttttgctgttcactgagtgagcttttcatgagtagcttccagtcgtacggagctccacggggagacaaagaggaattgacgccccagaagtgttctgagcctcagtcatccaagtag

SEQ ID NO: 4990 - DNA, 567 bp, Artificial Sequence
  Description of Artificial Sequence: Synthetic coding sequence
atgtgtttccctaaagtgctgtctgatgatatgaagaaactcaaagcacggatgcatcaggccatcgagaggttctatgacaaaatgcagaatgccgaatctggaagaggacaggtcatgagctctctcgccgagctcgaggacgactttaaggaaggctatctagaaacggtggctgcctactacgaggagcagcaccccgagctcacgccgctcttggaaaaggaacgcgacgggctccgctgcagaggcaatcgtagtcccgttcccgacgtggaggacccggcaactgaggaacccggagagtctttctgcgataaagtgatgagatggttccaggccatgctccaacggttacagacatggtggcacggggtgctcgcctgggtgaaagaaaaggtggtggcactcgtccacgccgttcaggctctttggaaacaattccagtcattttgctgttcactctctgagcttttcatgtccagctttcaatcttacggtgcccctcgaggtgataaagaagaactgactccgcagaagtgcagtgaaccacaatcatccaagtag

SEQ ID NO: 4991 - DNA, 567 bp, Artificial Sequence
  Description of Artificial Sequence: Synthetic coding sequence
atgtgcttccccaaggtcttaagcgacgacatgaagaagctgaaggctaggatgcaccaagcgatcgaacgtttttacgacaaaatgcaaaatgccgagtcagggaggggccaagtgatgagctccctggctgaactggaagacgatttcaaagagggttacttggagaccgtagccgcttattatgaagaacaacacccagaactcactccactcttagagaaagagcgcgacggccttaggtgtcggggaaaccgcagcccggttccagatgttgaagatcccgctacggaggagcctggggagagcttttgtgataaggtgatgcggtggttccaagccatgctccaacgtctccagacatggtggcacggcgtgttggcgtgggtgaaagagaaggtcgtcgccctggtccacgcggtgcaagctctgtggaagcaatttcagtcgttttgttgttctctgtcagaactcttcatgtcgagtttccagagctatggagccccacggggtgataaggaggagctgactccgcagaagtgcagcgagccccagtcctccaagtag

SEQ ID NO: 4992 - DNA, 567 bp, Artificial Sequence
  Description of Artificial Sequence: Synthetic coding sequence
atgtgcttccccaaagtgctcagtgacgacatgaagaaattgaaggccagaatgcatcaggccattgaaaggttctacgacaaaatgcagaacgccgagagcggcagaggtcaggtcatgtcctctctggcagagcttgaggatgatttcaaggagggatatcttgagacagtcgcagcctattacgaggaacagcaccccgagcttacaccactcctcgaaaaggaaagagatggtcttaggtgtcggggtaataggtctcccgtacctgacgtggaggacccagccacagaggagccaggagaaagtttctgcgataaagtgatgagatggtttcaggctatgttacaaagacttcagacatggtggcatggagtgctcgcttgggtgaaagagaaagtggtagcccttgtgcatgcagtccaggcgctgtggaaacagtttcagagcttctgttgttccctttcagaactatttatgagtagcttccagagctacggggctccgcgaggcgacaaggaagagttaactccacaaaagtgcagcgaaccacagtcatctaagtag

SEQ ID NO: 4993 - DNA, 567 bp, Artificial Sequence
  Description of Artificial Sequence: Synthetic coding sequence
atgtgcttccctaaggttttgagcgatgatatgaaaaagctcaaagcaaggatgcaccaggccattgaaaggttttacgacaagatgcagaatgccgagagtggaagggggcaagtgatgtcctcgctcgcagagttggaggacgattttaaagaggggtacctggagaccgtcgccgcatactatgaggagcagcatcctgagttgactccccttttggagaaggaacgggacggcctacggtgccggggaaatagatcgccagtccccgacgtagaggatcccgcaactgaggaaccgggtgaatctttttgcgataaggtgatgagatggttccaggccatgctgcagcgactgcagacatggtggcacggggtactagcctgggttaaagaaaaagttgtagcgctggtgcatgcagtacaggctctgtggaagcagttccagtccttctgttgctcgctcagcgaattgttcatgtcctcgtttcagagctatggggctccaaggggggacaaagaggagctgaccccccagaaatgcagtgagccacagagcagtaagtag

SEQ ID NO: 4994 - DNA, 507 bp, Artificial Sequence
  Description of Artificial Sequence: Synthetic coding sequence
atgtgcttccccaaagtgctgagcgatgacatgaagaaattgaaagcccgaatggtgatgagtagtttagcggagttagaagacgatttcaaggaggggtatctggaaaccgtagcagcatactatgaagaacagcacccggagctgacaccattgctggagaaggaaagggacggcctgcggtgtaggggaaaccgctctccggttcctgatgtggaggatcctgctacggaggagccaggagaatcattctgtgacaaggtgatgcgctggttccaagccatgctccagcgactccagacgtggtggcatggggtgctggcctgggttaaggagaaggttgtggccctggtccacgctgtgcaagctctgtggaagcagttccaatcgttttgttgctctctatcggagctgtttatgtcttccttccaatcctatggtgccccacggggtgacaaggaggagttgactccgcagaaatgtagcgagccacagagcagcaagtag

SEQ ID NO: 4995 - DNA, 537 bp, Artificial Sequence
  Description of Artificial Sequence: Synthetic coding sequence
atgaagaagcttaaagctcgtatgcatcaggcaattgagagattctatgataaaatgcagaatgcagaatcagggcgaggacaggtcatgagctcccttgccgaacttgaggatgatttcaaggagggatatttagaaaccgtagcggcatactatgaggagcagcacccagagctcaccccgttactggaaaaggagcgcgacggcttgaggtgccgcggtaatcgaagcccagtgcccgatgtcgaagatccagccaccgaggaacccggagaatcattttgtgataaagtcatgcgctggttccaggctatgctgcagagactccaaacttggtggcacggagtgcttgcgtgggttaaggagaaggtggtagcattggtgcacgctgttcaggctctctggaaacaattccagagcttttgttgtagcttatctgagttattcatgtccagcttccagagttatggggcacccaggggggacaaggaggagctgacaccccagaaatgtagcgagcctcagagttcaaaatag

SEQ ID NO: 4996 - DNA, 567 bp, Artificial Sequence
  Description of Artificial Sequence: Synthetic coding sequence
atgtgtttccccaaggtgctgtcagatgacatgaaaaagctaaaggcccgaatgcaccaggcaatagaaaggttctacgacaaaatgcagaatgcagaatcaggcagagggcaggttatgtctagtctggcagagcttgaggatgattttaaggaaggctatttggagaccgtcgccgcatattatgaggagcagcacccagagcttacgcctctgcttgagaaggagcgagatggcctcagatgtcgaggaaatcgctcacctgtgcctgatgtcgaggaccccgcaaccgaggagcctggcgaatccttttgtgataaggttatgcggtggttccaggctatgttgcagcgactgcagacttggtggcacggggtgctggcctgggtgaaagagaaggtggtggccctggttcatgccgtgcaggccctttggaagcagttccaaagtttctgctgtagcctgtcagaattgtttatgtcctcctttcagagctacggggcaccacgaggggataaggaagaactgactccccagaagtgctccgaacctcagtcatctaagtag

SEQ ID NO: 4997 - DNA, 705 bp, Artificial Sequence
  Description of Artificial Sequence: Synthetic coding sequence
atgtgctttcccaaagttctaagcgatgacatgaaaaagctgaaggccagaatggtcatgctgctgcccacaagcgcccagggactcggtgcctgggtatccgcttgcgatacagaagatactgttggacatttaggcccatggcgtgataaagacccagctttgtggtgccagttgtgcctaagctcacagcatcaggcaatcgaacgtttttacgataaaatgcagaatgcagaaagcgggcgagggcaggtgatgtcaagtttagccgagctcgaggacgatttcaaagagggctacctagaaaccgtcgctgcgtattacgaggagcagcatccggagctcaccccattgcttgagaaggagagagatggcctccgttgccggggtaatcgcagcccagttccggacgttgaggacccagctacagaggaacccggagaatcgttctgtgataaggttatgaggtggttccaggccatgctccaacggttacagacctggtggcatggtgtgctggcctgggtcaaggagaaggtcgtggccctggtccacgccgtgcaggccctttggaagcagttccagagcttttgctgctccctgtctgagttgttcatgagcagctttcagtcctacggagctcccagaggagataaggaggaattgacccctcagaaatgctcagagccccagtcttctaaatag

SEQ ID NO: 4998 - DNA, 705 bp, Artificial Sequence
  Description of Artificial Sequence: Synthetic coding sequence
atgtgctttccgaaggtgctctctgacgacatgaagaagctcaaggctcgcatggtgatgttgttgccgacctccgcacaggggcttggcgcttgggtctctgcttgcgacaccgaagacacggtcgggcacctggggccatggcgagataaggaccccgctctgtggtgtcagctgtgcctgagcagtcagcaccaggcgatcgaaagattttacgataagatgcagaacgcagaaagcgggaggggccaggtcatgagcagtctcgcggaactggaagacgattttaaagaagggtacctggagaccgttgctgcttactacgaagaacagcaccccgagctaacgccacttttggagaaagaaagagacgggttgcgctgccggggtaataggagccctgtccctgatgtcgaggaccctgcgaccgaggagccaggagagagcttctgtgataaggtcatgagatggttccaggccatgcttcaaaggttacagacctggtggcacggagtgcttgcatgggtgaaggagaaagtagtagccctggtgcatgccgttcaggctctatggaaacagttccagtcattttgctgctcactctccgaactttttatgagctcctttcagagttacggagccccacggggtgacaaagaagagcttaccccgcagaagtgcagcgaaccacaatcttccaagtag

SEQ ID NO: 4999 - DNA, 540 bp, Artificial Sequence
  Description of Artificial Sequence: Synthetic coding sequence
atgtgcttcccaaaggtcctgagtgatgacatgaagaaactgaaagccagaatgcaccaggctatcgagcgcttctatgataagatgcagaatgccgagtccgggaggggccaggatgacttcaaggagggttatctggagacagtggccgcttactatgaggagcaacaccccgaacttacacccctcctggagaaagagcgggatggtctgagatgtaggggcaacagatctcctgtgccagacgtggaagatcccgctacagaagaaccaggggagtcgttttgcgacaaagtcatgaggtggttccaggccatgcttcagcgccttcagacttggtggcatggcgttctcgcttgggtgaaggaaaaagttgtggccctcgtgcacgcggtgcaggctctgtggaaacagttccagagtttctgttgttctttgtcagagctatttatgtcgagctttcaaagctacggggcacctagaggggataaggaggagctgacccctcagaagtgtagtgagccacaatccagcaagtag

SEQ ID NO: 5000 - DNA, 678 bp, Artificial Sequence
  Description of Artificial Sequence: Synthetic coding sequence
atgtgcttcccaaaagtcttatcagatgacatgaaaaagctcaaggcccgaatggtaatgcttctgcccacctccgctcaggggcttggtgcctgggtgagcgcttgtgacactgaggacacagtgggacatcttggaccctggagggacaaggatcccgcactgtggtgtcagctctgtctttccagtcagcatcaggctattgagcggttctacgacaagatgcagaatgcggaaagcggcagagggcaggtcatgtcgtccttagcagagctcgaggatgacttcaaggagggctatctggagaccgtcgcggcatactacgaagaacagcaccctgaactgacccctttgttggaaaaagaaagggacggcctgcgatgtagaggtaaccgatcccccgtacccgatgttgaagatcctgcgaccgaggaacccggagaatctttctgcgacaaggtgatgcgctggttccaggctatgctgcagcgccttcaaacttggtggcacggcgtgctggcatgggtaaaggagaaggttgtggccctggtgcatgctgttcaagccttatggaaacaatttcagagtttttgttgctccctgagcgagctctttatgtctagctttcaatcctatggcgctcccagaggagataaggaagagctcactccccagtag

SEQ ID NO: 5001 - DNA, 396 bp, Artificial Sequence
  Description of Artificial Sequence: Synthetic coding sequence
atgtgtttccctaaggtgcttagtgatgatatgaagaaactgaaggcacgcatgcaccaagctatcgagcgattttatgacaaaatgcagaatgccgaatctggacgcggacaagttatgtcgagtctggctgaattagaagatgactttaaagagggctacctggagacggtcgctgcgtactatgaagagcaacaccctgaactcacacctctgctcgaaaaagaacgggatggcctcagatgcagaggaaaccgatcacccgtacctgatgtggaggaccctgcaacggaggaaccaggggagtcgttttgtgacaagtcctacggtgctccacgcggagataaggaggagctgactccccagaaatgcagcgaaccccagtcatccaagtag

SEQ ID NO: 5002 - DNA, 396 bp, Artificial Sequence
  Description of Artificial Sequence: Synthetic coding sequence
atgtgctttcccaaagtgctttctgacgacatgaaaaagctgaaagcccgtatgcatcaggccatagagagattctacgacaagatgcagaatgctgagagcggaaggggtcaggttatgagttctctggcagagctggaggacgattttaaagaaggctaccttgagactgttgccgcttattacgaggagcagcaccctgagctgactcctctgctggaaaaagaacgagatggactgaggtgtagagggaataggagtcctgtccccgatgtagaggaccccgcaacagaagagccaggggagagtttctgtgataagtcttacggcgctcctcggggagataaggaggagctgacaccgcagaagtgctccgagccacagagtagcaaatag

SEQ ID NO: 5003 - DNA, 507 bp, Artificial Sequence
  Description of Artificial Sequence: Synthetic coding sequence
atgtgcttccccaaggttttaagcgatgacatgaaaaaacttaaagcacgcatggtgatgtcctccctcgcggagttggaagacgacttcaaagagggttaccttgaaacagttgccgcttattatgaagaacagcaccctgagctgaccccactgctggagaaagagcgtgatggtctgagatgccggggtaataggagtcctgtgcctgacgtggaggaccccgctacggaggaaccaggggagagcttctgcgacaaggttatgaggtggtttcaggcaatgttgcagaggctgcagacctggtggcatggcgtactggcttgggttaaagagaaggtggtagcattggttcacgcagtgcaagccctgtggaaacagttccagtccttctgttgtagcctttcagagctcttcatgtctagctttcaatcatacggcgctccccgaggggataaagaggagttgaccccacagaaatgcagcgaacctcagtctagcaagtag

SEQ ID NO: 5004 - DNA, 567 bp, Artificial Sequence
  Description of Artificial Sequence: Synthetic coding sequence
atgtgtttccctaaggttctgtctgatgatatgaaaaagctcaaagcgagaatgcaccaggccatagaacggttctacgacaagatgcagaacgctgagagcgggagggggcaggtaatgtcttccctggcagagctcgaggacgacttcaaagagggctacctagagaccgtggcggcatactacgaggagcagcatccggagctgactcccctccttgagaaagaaagggacggattgagatgcaggggaaacagaagtcccgtgcccgacgtggaggacccagccacagaagagcctggagagtcgttttgcgataaagttatgagatggttccaggccatgcttcagcgcctgcagacttggtggcacggcgtcttagcatgggtcaaagaaaaagtggtcgctttagtgcacgcagtgcaggccctttggaagcagttccagtccttttgttgctccctgagcgaactctttatgagtagtttccagtcctatggagctcctcgcggagacaaggaagagctcacgccccagaaatgtagcgaaccacaaagctcaaaatag

SEQ ID NO: 5005 - DNA, 813 bp, Artificial Sequence
  Description of Artificial Sequence: Synthetic coding sequence
atgaagccgaaaatgaagtactcgaccaataagatctcgacagccaaatggaaaaacactgcctccaaagccttgtgctttaagctgggtaaatcccagcagaaagccaaagaggtgtgtccgatgtatttcatgaagttgcgttccggactcatgattaagaaggaggcctgttattttaggcgtgagactacaaagcgaccttctctcaagacaggacggaaacataaacgccacttagtgctggcggcatgccagcagcagtctaccgtggagtgcttcgcctttgggattagtggagtgcagaagtacactcgcgcattgcatgactcctccattactggtatctctcctatcacagaataccttgcgtccctgagtacctacaatgatcagtctatcaccttcgctctagaagatgagagctatgagatatatgtggaagatctcaaaaaggatgaaaagaaggataaagtactactcagctattatgagtcacaacatcctagcaacgaaagcggcgacggagtcgatgggaagatgctcatggtaactctctctcctacgaaagatttctggctgcacgctaataataaagaacactccgtggaattacataaatgcgaaaaacccctgcctgatcaggcgttctttgttctgcacaatatgcactctaactgcgtgagctttgagtgcaaaactgatccaggggtgttcataggagttaaggacaaccacctggccttgataaaggtggattcgtcggaaaacctctgcacagaaaacattcttttcaagctgtccgaaacctag

SEQ ID NO: 5006 - DNA, 435 bp, Artificial Sequence
  Description of Artificial Sequence: Synthetic coding sequence
atgaaaccgaagatgaaatattccactaacaaaatttccaccgcgaagtggaagaataccgccagtaaggctctctgctttaagctcggcaataaagtgctcttaagctattacgagtcccagcaccccagtaatgagagcggggatggcgtggatggcaagatgctgatggtgacactctcacctacaaaagatttctggctgcatgctaataacaaagagcactctgtagaactccataagtgtgaaaaacctttacctgaccaggccttcttcgtcttacacaatatgcacagtaactgtgtgagtttcgagtgcaaaactgatccaggcgtgtttattggagtcaaggacaaccatcttgccttgatcaaggtcgactcttctgaaaacctgtgcactgagaacatcctattcaaactttcagagacatag

SEQ ID NO: 5007 - DNA, 687 bp, Artificial Sequence
  Description of Artificial Sequence: Synthetic coding sequence
atgaaaccaaagatgaagtactccacaaacaaaatttctactgccaaatggaagaacacggcgtccaaggccctttgctttaagctaggtaaatcccagcagaaagccaaggaagtgtgccccatgtatttcatgaaactgcgcagtggtctgatgatcaagaaagaagcatgctacttccgaagggaaactacaaagcgcccatccctcaaaaccggcaggaagcacaagagacacctcgtcctggcagcttgtcagcagcagtctactgtcgagtgtttcgcctttggtatctctggtgtccagaaatataccagagcgttgcatgatagctctatcacggacaaggttctgctgagctactacgaatcccagcaccccagtaacgagtcgggggatggggtggatggcaagatgctcatggtgacactgtcacctactaaggacttttggcttcacgccaataacaaagaacactcagttgaactgcacaagtgcgagaagcccctccccgatcaggcctttttcgtgctgcataatatgcatagcaactgtgtttctttcgaatgcaaaaccgatcccggagtgttcatcggcgtaaaagacaaccaccttgctctcatcaaggttgactcatccgaaaatttatgtactgaaaatatacttttcaagctaagcgagacatag

SEQ ID NO: 5008 - DNA, 729 bp, Artificial Sequence
  Description of Artificial Sequence: Synthetic coding sequence
atgccccgtgggttcacatggctcagatacttaggcatttttctgggtgtggctctgggaaacgaaccgctcgagatgtggcctttgacccagaacgaagagtgcacggtgacgggattcctgcgtgacaagctccaatatcgctctcgtctgcagtacatgaagcactactttccaataaactataaaatttccgtcccctacgagggcgtatttcgcattgcaaacgtaacccgcctccagcgtgcccaagtcagtgagcgagagctgagatacctgtgggtccttgtaagccttagcgcgactgagagtgttcaagacgtgctcctcgaagggcacccgagttggaagtatcttcaggaggtggagaccctgctgctcaatgttcagcaaggcttaacagatgtggaggtctctccaaaggtggaaagtgtgctgtccctgctgaacgcccctggccctaacttgaagctggtaaggccaaaggcgcttctcgataattgctttagggtcatggagctcctgtactgttcctgctgcaaacaaagttcagtgctcaattggcaggattgtgaagtgccaagcccacagagctgcagccctgagccaagtctgcagtacgccgctacccagttgtatccaccaccaccatggagtccaagctcccctccacattctacaggatcagtgaggcctgtccgcgctcagggggagggacttctgccttag

SEQ ID NO: 5009 - DNA, 729 bp, Artificial Sequence
  Description of Artificial Sequence: Synthetic coding sequence
atgccacgaggcttcacctggctgcgctatcttggcatcttcctaggagtagccctcggcaacgagccactcgaaatgtggcctctcacacagaatgaggagtgcaccgttaccggctttctgcgcgataagctgcagtatagaagcagactccagtatatgaagcattatttcccgataaattacaaaattagcgtaccttacgagggggtattcaggatagctaatgtgaccaggttgcaacgcgctcaagtctcagagcgggagctgcgttatctttgggttcttgtgagcctctccgctactgagtctgtccaggacgttttgctggagggccatccctcctggaaatacctccaggaagtggagacgctcctcctgaacgtccaacagggcctaacggatgtggaggtgtccccaaaggtcgaatccgttctgtcactgctgaatgctcccggtccaaacctcaagctggtacgccctaaagccctgctcgataattgtttcagggtgatggaactgctttactgtagttgctgcaagcaatcttcagtgctgaactggcaggattgcgaggtgccgagtccacagagctgttctcccgaacctagtctgcagtacgccgctactcagctgtaccctccccctccttggtcaccctccagtcccccacacagcacaggttccgtgaggccagtacgagctcaaggggaagggttgctgccttag

SEQ ID NO: 5010 - DNA, 477 bp, Artificial Sequence
  Description of Artificial Sequence: Synthetic coding sequence
atggagaaggccctgaagatcgacacaccgcagcaaggaagcatccaggacatcaaccatcgcgtgtgggtgcttcaggaccagacacttatcgcagtccccagaaaagaccggatgagtccggtgactatcgctcttatctcctgcaggcatgtggaaaccctagagaaggaccggggaaatcctatctacctgggactgaacggtctcaatttgtgcctgatgtgcgcaaaggtgggtgatcagcctaccttgcagctgaaagaaaaagacataatggatctctataaccagcctgaacctgtcaagtcttttctgttttaccactctcagtccggaagaaacagtacattcgagagtgtagcttttcccggatggttcatagccgtttccagcgagggagggtgccccctcatcctgacacaggaattggggaaggccaacaccacagatttcggcctaaccatgctgttttag

SEQ ID NO: 5011 - DNA, 132 bp, Artificial Sequence
  Description of Artificial Sequence: Synthetic coding sequence
tccacattcgaatccgtggcatttcccggatggttcattgccgtctctagcgaaggagggtgccccctgatcttgacacaggagttgggtaaggccaacacaaccgactttggcctgattctggtagagtag

SEQ ID NO: 5012 - DNA, 495 bp, Artificial Sequence
  Description of Artificial Sequence: Synthetic coding sequence
atgaacccacaaagagaagccgctccgaaaagctatgctattcgagacagccgtcagatggtatgggtgttgagcggaaattccctgatcgccgcacccctcagccggtccatcaaacccgtgacactgcatctcatagcatgcagagataccgagttctctgataaggagaaagggaatatggtttacctgggaataaagggtaaggatctttgtttgttctgcgcggagatccaagggaagccgactctgcagctaaaactccagggatcccaggacaacataggaaaggacacttgttggaagctagtggggattcatacctgcataaatttggatgtacgggagtcctgcttcatgggcacgctagatcaatggggaattggcgtgggccgtaagaagtggaaatcatcctttcagcatcaccatctgcggaagaaagataaagatttttcaagcatgcgcaccaacattggaatgccgggacggatgtag

SEQ ID NO: 5013 - DNA, 474 bp, Artificial Sequence
  Description of Artificial Sequence: Synthetic coding sequence
atgaatccacagagggaagcagccccaaaatcctacgctatccgcgacagcagacagatggtgtgggtactgtccggtaactcccttattgccgctcctcttagccggtcaatcaaaccggtgactctgcacctaattgcttgtcgggacacagagttctctgacaaagagaagggaaacatggtttatctgggtattaagggtaaggacctatgcctcttttgcgcagagatacaggggaaacctaccctgcagctgaaagagaagaacattatggatctatatgtggaaaagaaagcccagaagcccttcctctttttccataataaggagggatccaccagtgtttttcagagcgttagttacccaggttggttcattgcaacctccacaacatcaggccaacccatatttctcacgaaggagcgtggaattactaataacacaaatttttaccttgacagtgtcgaatag

SEQ ID NO: 5014 - DNA, 510 bp, Artificial Sequence
  Description of Artificial Sequence: Synthetic coding sequence
atgcgcggaacaccaggcgacgctgatgggggaggcagggcagtctaccagtcaatgtgcaagcctatcacaggcactatcaacgatttgaaccaacaggtgtggaccctgcagggccaaaatctggtggcagttcccaggtcagacagcgtcactcctgtcacagtggccgtgattacatgcaagtatcctgaagcccttgaacagggccgtggcgatcctatttatctcggtatccagaatccggagatgtgtctgtactgcgagaaggtgggtgagcagcctaccctccagctcaaggagcagaagattatggacctgtacggccaacccgaaccagtgaagccgttcttattttatcgtgctaagactggaagaacctcaaccctggagtcggtggcctttccagactggtttatcgcctcctccaagagggaccaaccaattatcttaacatcagagctgggcaagagctataatactgccttcgagcttaatatcaatgattag

SEQ ID NO: 5015 - DNA, 117 bp, Artificial Sequence
  Description of Artificial Sequence: Synthetic coding sequence
atgaggggtacgcctggcgatgccgacggaggaggcagggccgtttaccagagcatgtgtaaacccatcacaggcaccatcaacgacctgaatcagcaggtctggactctacagtag

SEQ ID NO: 5016 - DNA, 657 bp, Artificial Sequence
  Description of Artificial Sequence: Synthetic coding sequence
atgagtttcgtaggggagaactcgggggtgaaaatgggaagcgaggactgggaaaaggacgaacctcagtgttgcttggaagatcccgcaggctccccactggagcctggaccatcactgcctactatgaattttgttcatacaagtccgaaagtcaaaaatcttaaccccaaaaagttctccatccatgaccaagaccacaaagtgctcgtgctggattcaggtaatctgatcgctgtcccagacaagaactatattcgtcctgagattttcttcgcccttgcctcttcgctctcatccgcaagcgccgaaaaagggagcccaattttactgggggtttccaaaggagagttttgtttatattgcgacaaggacaagggacagtcccacccatccttgcaactcaaaaaagaaaagctgatgaagcttgcggcacagaaggagtccgctcgcagaccattcatcttttatcgagcccaggtgggctcatggaacatgctggaatctgccgctcacccgggatggttcatctgcacgtcttgcaactgcaacgagccagtgggagtcacagacaagtttgagaatagaaagcatatcgagttcagctttcagcctgtgtgtaaagcggagatgtccccgagcgaggtgtctgactag

SEQ ID NO: 5017 - DNA, 579 bp, Artificial Sequence
  Description of Artificial Sequence: Synthetic coding sequence
atgagcgggtgcgacaggagagagactgaaaccaagggcaaaaattcttttaagaaacgactaaggggaccaaaagtgaagaatcttaaccctaaaaagtttagcattcacgaccaagaccataaagttttagtgctggattcagggaacctgattgccgtacccgacaaaaactacatcagacctgagattttttttgcactggccagtagcctgtcctctgccagcgctgaaaaggggtctccaatccttttgggtgttagcaaaggcgaattctgcttgtactgcgacaaagataagggccagtctcaccctagcctacaactgaagaaggagaaactaatgaaactggccgcacagaaagagtccgccagaagaccattcattttttatcgggctcaggttggtagttggaacatgttagaaagtgccgctcatccaggttggtttatttgcacctcctgtaattgcaacgagcccgtgggtgtaactgacaaatttgagaatcgcaagcacatcgaattttcttttcagcccgtttgtaaggctgaaatgagtccctcagaggtttctgattag

SEQ ID NO: 5018 - DNA, 474 bp, Artificial Sequence
  Description of Artificial Sequence: Synthetic coding sequence
atgtccttcgtcggcgagaacagcggcgtgaagatgggctctgaggactgggagaaggacgaaccacagtgttgtttagaagagatcttttttgctctcgcctccagccttagcagcgctagcgccgagaaaggaagtccaatcctgctgggcgtgagcaaaggagaattctgcttgtattgcgacaaggataaaggacagagtcaccccagcctgcagcttaagaaagagaaactgatgaaactcgctgcacaaaaggagtcagcccgacgtcccttcatcttttatagggctcaggtaggctcttggaatatgctggaatccgctgcccaccccggttggttcatctgtactagctgcaattgcaacgagcccgtaggggtcacagacaagttcgaaaacagaaaacatattgagttttcatttcagcccgtgtgcaaagccgagatgagcccctcagaggtgtcagactag

SEQ ID NO: 5019 - DNA, 594 bp, Artificial Sequence
  Description of Artificial Sequence: Synthetic coding sequence
atgtctttcgtcggcgagaattccggcgttaagatgggctccgaggactgggagaaagacgagccccagtgctgtttagaaggacctaaagtgaaaaacctcaatccaaagaaatttagcatccatgaccaggatcataaagttctagtgctggactccggcaatttgatcgccgtgcctgataagaactacattaggcctgaaatatttttcgctctggcttcaagtctgtccagcgcaagcgccgaaaagggttctccaatcctgttaggagtctccaaaggagagttctgtctgtactgtgataaggataaggggcagtctcacccatctttacagttgaagaaggagaagctgatgaagctcgccgcacagaaggagtccgcccgtcgacctttcattttctatagggctcaggttggttcttggaacatgttggagtccgcagcccacccaggctggttcatttgtacatcctgcaattgcaatgagcctgtaggcgttaccgataaattcgagaacagaaaacatatcgaattctctttccaacccgtgtgtaaggcggagatgagcccctccgaagtctctgattag

SEQ ID NO: 5020 - DNA, 537 bp, Artificial Sequence
  Description of Artificial Sequence: Synthetic coding sequence
atgtcatttgtcggggagaattccggcgtcaagatggggagtgaggattgggaaaaggacgaacctcagtgctgtctcgaagatcccgcaggctcacccctcgagcccggtccttcactgcccacaatgaacttcgtgcacacaaagattttctttgcgctggcctcgagcttgtcaagtgcgagcgcagagaaggggtcacccatcctactcggggtgtcgaagggagaattttgcctttattgtgataaggataaagggcaatcgcatcccagcctgcagttgaagaaggagaagctgatgaaattggcggctcagaaggaaagtgctagacgcccttttattttctacagggcccaggtgggctcatggaatatgctggaatctgctgctcaccccggttggtttatatgtacctcatgcaattgcaatgagcctgtgggcgtcactgacaaattcgaaaaccgaaagcacattgaattcagcttccagcctgtgtgcaaggccgagatgagtcctagcgaggtgtcggactag

SEQ ID NO: 5021 - DNA, 1770 bp, Artificial Sequence
  Description of Artificial Sequence: Synthetic coding sequence
atgccgaatgacgacttttgcccagggttgaccataaaggccatgggagctgagagggcaccacagagacagccatgtacgttgcacctgctagtgcttgttccaattctacttagtctggtggcctcacaagactggaaggcggagaggtcacaagacccctttgagaagtgtatgcaggatccggattatgaacagctgctaaaggttgtgacgtgggggttaaatcgcaccctcaaaccccagagagtgatcgtcgttggcgctggcgttgcgggactggttgctgcaaaagttctgagcgacgctggacataaggtgaccattcttgaagctgacaataggatcgggggtcgcatttttacataccgggatcaaaacaccgggtggatcggggaactcggggcaatgcgcatgccaagctctcacaggatcctgcacaagctgtgccaaggtctggggctgaacctgactaaatttacacaatacgacaagaatacgtggacggaggttcacgaggtcaagctgcgaaactacgtcgtagaaaaggtacctgaaaaacttggttacgctctccggcctcaagagaaaggccacagtcctgaggatatttatcagatggcattgaatcaggctttgaaagatctgaaggccctcggctgcaggaaagccatgaagaagtttgaacgccataccttgctagaatacctccttggggagggtaaccttagtaggcctgccgtgcaattacttggcgacgtcatgagtgaagatggctttttttaccttagctttgcagaggctctgcgggctcacagttgtttgtccgatcgacttcagtattcgaggattgtgggaggatgggatctgctccctcgcgctctcctgtctagtctgtcaggcctcgtacttctgaacgccccagtagtagccatgacccaggggccacacgacgtgcacgtccagatcgaaacatctccacccgctaggaatctcaaggtcctcaaagccgacgtagtgttgctgacggcctccggtcctgcagtcaaacggattacctttagcccgccactgcccaggcacatgcaggaggccctgaggcggctgcactacgtaccagctacgaaggtgttccttagtttcagacgcccattttggcgggaagaacacattgaggggggacatagcaacaccgatcgtcctagccggatgatattctatcctccaccgcgtgagggggctctgctgctggctagctacacatggtcagacgcggctgccgcattcgcgggtctgagccgagaagaggcactgaggcttgctttagatgatgtagctgccctccatggaccagtggttcgccagctttgggacggcaccggagtggtgaaaaggtgggctgaggatcagcactcccagggcggattcgtggtgcagccacctgctctgtggcagacagagaaggatgattggaccgtgccatacggaaggatttacttcgctggtgagcacaccgcctacccgcacgggtgggttgagaccgccgtgaaaagcgctctgagagccgctattaagatcaacagtagaaagggccctgcgtctgacactgcatctcctgaaggacacgcgagtgacatggaaggccagggacacgtgcacggagtcgcaagctcgccaagccacgacctggcaaaggaggaggggagccatccgcctgtacagggtcaactgtccctccaaaacacaacacacactcggacttcacattag

SEQ ID NO: 5022 - DNA, 1704 bp, Artificial Sequence
  Description of Artificial Sequence: Synthetic coding sequence
atggcacctttagctctgcatttactggtgctggtgcccatattattaagcctggtggcttctcaagactggaaggctgagagatcgcaggatccatttgagaagtgtatgcaggaccctgattacgagcagctgctgaaggtcgttacctggggccttaacagaacactcaagccacagagggtgattgtcgtgggggctggagttgcaggactcgtcgctgcgaaggtcctgagtgatgccggacacaaggtgacgattctcgaagcggataatcgtatcggcggtaggatatttacttaccgggaccaaaacaccggctggatcggcgagctgggtgctatgagaatgccaagtagccaccggatcttacataaactctgtcagggcttaggtctcaacctgacaaaattcactcagtatgacaagaacacctggaccgaagtccatgaggttaagcttcgcaactacgtggtggagaaagttcccgagaaactggggtatgctctacgaccacaggagaaaggacacagcccagaagatatttatcagatggcgctcaatcaagccctgaaagaccttaaagctctgggatgtcgaaaagccatgaaaaaattcgaaaggcacactctattagaataccttctgggcgaagggaacctatctagacctgccgttcagctgcttggcgacgttatgagcgaggatggcttcttttatctgagctttgctgaggctcttcgggcacattcctgcctgagcgaccgtctgcagtactccaggatagtggggggttgggacttgctgccacgagcactgctatctagcttgagcggcttggtgttattgaatgctccggtggtagccatgacccaagggccacatgatgtccacgtgcagatagagaccagccccccagctagaaacctcaaagtgttgaaggccgacgttgtcctgctgacggccagcggtccggctgtgaagcgtattacattctccccaccactgccaagacacatgcaggaggctcttcgacgactccactacgtgccggctaccaaagtattcttgagcttccgccgtcctttctggcgcgaagagcacattgaggggggtcattctaacaccgacagaccttcaagaatgatcttttacccaccccctcgagagggcgcattactcttagcgtcctacacttggtctgatgccgcagccgcttttgctggattatcaagggaggaagccctccgcctggcattggacgacgtggcggctttacacggacccgtggtccgccaattatgggacgggaccggcgttgttaagagatgggccgaagatcaacacagccagggcggattcgtggtgcaaccacccgctctttggcaaactgagaaagacgattggaccgtgccctacgggaggatttacttcgcgggtgaacatacagcttacccgcatggctgggtggagacggccgttaagagcgccctgcgggcagctataaagattaatagccgcaaagggcctgcttctgacacagctagccctgagggacatgcaagtgatatggaggggcagggccatgtgcacggagttgctagcagtccaagtcatgatttagccaaggaagaagggtcccatcccccagtgcaaggccaactctctctgcagaacaccacccacaccaggacatcccattag

SEQ ID NO: 5023 - DNA, 1770 bp, Artificial Sequence
  Description of Artificial Sequence: Synthetic coding sequence
atgcccaatgacgacttctgtcccggtcttacaattaaggctatgggggcagaacgggcaccgcagcgtcagccttgtacgctgcaccttctcgtcttagtacctatcttgctatctctggtggccagtcaggattggaaggctgagcgctcgcaggatcctttcgaaaagtgtatgcaagatcccgactatgagcagttactgaaagtagtgacttgggggcttaaccgcacgttgaagccacaaagagtgatcgtggttggagctggcgtggccggactagtggctgctaaggtgcttagcgacgctggccataaggttaccattctcgaggctgacaatcgcataggagggcgaatttttacgtacagagatcagaataccgggtggataggtgagttgggagctatgcgtatgcctagcagccaccgaattctgcataagctgtgccaaggactgggcttaaatttgactaagttcacacaatatgataagaacacatggaccgaggtgcacgaagtgaaactgcgtaactacgtagtggagaaggttcctgagaaactcggctacgccctgcggccacaggaaaagggccattcaccagaggacatttaccaaatggccctgaatcaggctttgaaggacttgaaggcacttggctgtaggaaggcgatgaagaagtttgaaagacacaccctgctggaatatctactgggtgagggtaacctctctcgcccagccgtacagttattgggcgatgtcatgtctgaggacggtttcttttacctctcctttgcagaggccttgcgtgctcattcctgcttatccgacaggcttcagtactctcggatcgtcggaggatgggatctgctcccccgagctttgctgagcagtttgtctggactagtgttgctgaatgcccctgtggtggcaatgacccaggggcctcatgatgtacacgtgcagatcgaaacatcacccccagctcgcaaccttaaggtcttgaaagcagatgttgtgctgcttaccgcctcgggacctgcagtgaaacggatcactttttcacctcctcttccgagacacatgcaggaagcgctgaggcgactccactacgtgccggcaactaaggtgtttttatcatttcgtcgaccgttttggagggaggaacacatcgaggggggacatagcaacaccgaccggccttctcgcatgattttttacccccctcccagagaaggtgctcttttattagcctcctatacttggtccgatgccgctgccgcatttgccggattatcccgagaggaagctcttagactcgcactggacgacgtcgcagctctccacgggccagtggtgcggcagctttgggacggaactggggtggtgaaaagatgggccgaggaccagcattcacagggtggctttgtcgtacagcctcctgctctctggcagacagagaaagacgattggacagtaccttacggtcggatctacttcgcgggagagcatacagcttacccacacggttgggtcgaaaccgcagtgaagagtgcactccgtgcagctataaagatcaacagtcgtaagggtccagctagtgataccgctagtccagagggccacgcctcagatatggagggccaggggcacgtgcacggtgtagcttcttctccctcccacgacttggctaaagaagaggggagtcacccccctgttcaaggccagctgagcctgcagaacacgactcacacaaggacttcacactag

SEQ ID NO: 5024 - DNA, 462 bp, Artificial Sequence
  Description of Artificial Sequence: Synthetic coding sequence
atgggacttactagtcaattgctacccccattgttttttttgcttgcttgtgccggaaattttgtgcacggccataaatgtgacatcacactgcaggagataataaagaccctgaactcactgacggagcagaaaacgctgtgcacagagcttacagtgacagatatctttgctgcatccaaaaacaccacggagaaagaaacattttgcagggcagccaccgttctgaggcaattctactcacaccacgagaaggatacaaggtgcttaggtgccaccgctcagcagtttcatcgccacaaacaactcattcgtttcctcaagaggctcgatagaaacctctgggggctggccggactgaatagctgcccagtcaaggaggccaaccagtcaaccctagagaattttctagaaagactcaagaccatcatgcgtgaaaaatacagcaaatgcagcagctag

SEQ ID NO: 5025 - DNA, 435 bp, Artificial Sequence
  Description of Artificial Sequence: Synthetic coding sequence
atgctgctggccatggtgctaaccagcgcgctgctactttgctctgtggctgggcagggctgtccaacactggcaggtattttggatataaactttttgatcaataagatgcaggaagatcctgctagtaagtgccattgtagtgccaatgtgacttcctgtctgtgcctgggcataccctcagacaactgcacacgtccttgctttagtgagaggctgtcacaaatgacaaatactacaatgcagacacgttacccactgatattctcacgagtcaaaaaatcggtggaagtgctcaagaataacaagtgtccttatttctcctgtgagcagccctgtaatcagacaaccgctgggaatgctctcacctttttgaagagtctgctggaaatcttccaaaaagagaagatgcggggaatgagggggaagatctag

SEQ ID NO: 5026 - DNA, 2109 bp, Artificial Sequence
  Description of Artificial Sequence: Synthetic coding sequence
atgcgaccaatgcgcatttttgtgaatgacgatcggcacgtgatggccaagcactccagcgtgtacccaacacaagaggagcttgaagcagtgcagaatatggtctcccatactgaaagagccctgaaggccgtctccgattggatcgacgaacaggaaaaaggaagctccgaacaagcagagtcagataacatggatgtgccgccagaggacgatagcaaagagggcgctggcgagcagaagactgaacacatgactcgcactcttaggggggtgatgcgtgttggcctagtggctaagggcctgctgcttaaaggcgatctcgatctggaacttgttctcctgtgcaaagaaaagccaactacagccctgctggacaaggtggcagataatttggctatccagttggccgcagtgaccgaggataaatacgaaattctccaatcagtggatgacgcagccatcgtgatcaaaaatacaaaagaacctcccctgtcgttaacaattcatcttacaagtccagtggtgagagaagagatggaaaaagtgctagcgggtgagaccctttcggtcaatgatccacctgacgttcttgaccggcagaaatgtctcgctgctctggcttcactgcgccacgccaagtggtttcaggcaagagccaacggcctcaaatcttgcgttattgtcatccgggtcctaagggatctgtgtacacgggttcctacttggggcccactccggggttggcctttagaattgctgtgtgagaagtcgattggcactgctaatagaccgatgggggctggcgaagccctgcgaagggtactggagtgcctagccagcggcatagtcatgcctgatgggagtgggatctacgacccttgcgaaaaggaggcaaccgacgccatcggtcatctcgatcggcagcaaagggaggatatcacacagagcgctcagcacgccctgaggctcgctgctttcggccagctccacaaggtactggggatggaccccctaccatccaagatgcctaagaagccaaaaaatgagaaccctgtggactacacagtgcaaatccctccctctaccacgtacgctataactccaatgaagcgcccaatggaggaggatggcgaagagaagtccccctctaagaagaaaaaaaaaattcaaaaaaaagaagaaaaggcagagcctccccaagccatgaatgcgctgatgagactgaatcagctgaaaccaggacttcagtataagttagtcagccagaccgggcctgtgcatgccccaatcttcacgatgagtgtagaggtggatgggaactccttcgaggcaagcggacctagtaagaagacagctaagctccacgtggctgtgaaagtattgcaggacatgggcctcccaacgggagccgagggaagagactcatccaagggtgaagattctgcagaagagacagaagccaagcccgcagttgtggctccggcacccgttgtcgaggcagtgtccacacctagcgccgcattcccaagcgacgctacagccgaacagggcccaattctgactaagcatggaaagaatccagtcatggagttgaatgaaaaaagaaggggcttgaaatatgagttgatctctgagacaggcggatcacatgataaaagattcgtaatggaagtcgaggtagacgggcagaaattccagggggcagggagcaacaaaaaggtggctaaggcctacgctgccctcgcagctctggaaaaattattccctgatacgccactcgccctggatgctaataagaaaaagcgagcaccagtgcctgtgaggggaggtcctaagtttgccgcaaagccacataaccccggttttgggatgggcggaccaatgcataacgaggttcctcctccccctaacttgcggggtcgaggtaggggcggatccattcgaggccgagggagagggagaggctttggaggagcaaaccacggcggatacatgaatgccggtgccggttatggcagctacggctatggcggaaactcagccacggccggatacagcgatttcttcacggactgttatgggtaccatgattttggctccagttag

SEQ ID NO: 5027 - DNA, 2109 bp, Artificial Sequence
  Description of Artificial Sequence: Synthetic coding sequence
atgaggcccatgagaatttttgtgaatgatgacaggcacgttatggccaagcattcaagcgtgtaccctacgcaagaggaacttgaggcggtgcagaatatggtgtctcacaccgagagagcgctgaaagcagtctcagactggatcgatgaacaggaaaaaggaagctctgaacaggccgaaagtgacaacatggacgtccctccagaagatgacagcaaagagggcgctggcgaacagaagaccgaacacatgacaagaacattacgtggcgtgatgcgggtgggacttgtcgctaaaggattgttgctgaagggagatttagatcttgaattggtgctcctatgcaaggagaagccgaccacagctctcttggataaagtcgcagataaccttgcaatccagctggccgctgttaccgaggataaatatgaaatccttcagtctgtggatgacgctgccatcgtgatcaaaaacacaaaggaacctcccctgagtctcaccattcacttaacatcacctgtggttagagaggaaatggagaaggtgctggccggtgaaacactcagtgtgaatgacccgcctgatgtgctggataggcagaagtgcctagctgcgctggcatccttgaggcatgctaagtggtttcaggcgagggctaatggtctcaaatcctgtgttattgtcatccgggtcttaagggatctatgcacaagggtgcccacgtggggacctctgcgcggatggccactggaacttctgtgcgaaaaaagtataggcacggccaacagacccatgggcgctggagaagctcttcgccgagtgctcgagtgcctcgcttccggaatcgtcatgcctgacggctctgggatttatgacccttgcgaaaaagaggccacggatgcgatcggccacttggaccgccagcagcgggaggatattacacagagcgcgcagcacgcactcagattagccgcttttggtcaattgcacaaagtactggggatggacccgcttccatcaaagatgcctaagaagcccaaaaacgagaacccagttgactatacggtccagattcctcccagcaccacatatgccattactcccatgaagcgcccaatggaggaggatggagaagaaaagtccccaagcaagaaaaaaaaaaaaattcagaaaaaggaagaaaaggccgaaccccctcaggcgatgaacgctctaatgagactgaaccagttaaaacccggtttgcaatataagctggtatcccagacaggccctgttcacgccccaatctttaccatgtctgttgaagtggatgggaactcttttgaggcctctggccctagcaaaaaaacagccaagctccacgtcgctgtcaaagtccttcaggacatgggcctcccaacaggtgctgagggacgagactccagcaaaggagaggactctgccgaggaaaccgaggccaagcccgcagttgtggccccagccccagtcgtggaggccgtgtctactccttcagccgctttccccagtgatgccacagccgaacaaggtcccatcttgacgaagcacgggaagaaccccgtgatggaactgaacgagaaacgcagaggactcaaatatgagctgattagcgagaccggagggagccacgacaagcgctttgtgatggaggtggaagttgacggtcagaagtttcagggtgccggttccaacaagaaggtagctaaagcatacgctgcactagctgcacttgagaagctgtttcccgacactccactggccttggacgcaaataagaaaaagagagctcccgtaccagttaggggtgggccaaagttcgctgctaagccgcataacccgggtttcggcatgggaggacctatgcacaatgaagtgcctcctcctcccaatctccgtggcaggggcagagggggttctataagaggtaggggccgaggccgtggctttggcggtgccaaccatggagggtacatgaatgctggggctggttatggcagctatgggtacggcggaaactctgcgacagctggatattccgattttttcacagattgctatggctaccacgacttcggtagctcctag

SEQ ID NO: 5028 - DNA, 2685 bp, Artificial Sequence
  Description of Artificial Sequence: Synthetic coding sequence
atgcgtcccatgcgaatcttcgtgaacgacgaccgccatgtgatggcaaaacattctagtgtgtatccaactcaggaagaattggaggccgtccagaacatggtgtcccacaccgagcgtgctctcaaagctgtaagcgactggattgatgagcaggaaaagggatcatctgagcaggccgaaagcgataacatggatgttccccctgaggacgactcgaaggagggtgcaggcgagcagaagactgaacacatgacgcggactttacggggagtgatgagggttggtctggttgcaaaagggcttctgctgaaaggcgatcttgatctggagctggtattgctctgcaaagagaaacctaccacagctctgctggataaagtcgctgataacctagccatccagctcgccgctgttacagaagacaaatacgagattcttcagagcgtggatgatgcggctatagttataaagaacaccaaggagccccctctctccctaaccatacacctcactagtcccgtagtgagggaagagatggagaaagtactcgcaggagagaccttgtccgtaaacgatccgccagacgtgctggacagacaaaagtgtctggctgcgctggcgtctctgcgtcacgctaagtggttccaggcgcgtgcaaatggtctgaaatcttgtgttatagtaattagagtgctgcgcgatctctgtacaagggtcccaacttggggtcccttaaggggatggcctctcgagctgctctgtgaaaagtctatcgggacagcgaacagacctatgggggctggagaggccctccgccgagtcctagaatgtttggcatccggcatagtgatgcctgatggctccggcatctacgacccctgtgaaaaggaggccaccgatgccattgggcacctagatcgtcagcagagagaagatattacccagtctgcacagcacgctctacgcctggcagctttcgggcaactccacaaggttcttggcatggatccactaccatctaaaatgcccaagaaacccaagaacgaaaatccagtggactacactgttcagattccacctagcactacatacgccattacacctatgaaacgtccaatggaggaggatggggaagagaaaagtccttcaaagaagaagaagaaaatccagaaaaaggaggagaaagcagagccaccacaggcgatgaatgcactgatgagactgaaccagttgaaacccggactccagtacaaactggtcagtcaaacagggcctgtgcatgctccaattttcaccatgtcagtagaggtagatgggaactctttcgaagcatccggcccatccaaaaagacagcaaagttacatgtcgctgtgaaggtacttcaggacatgggtctgcctaccggggctgagggcagagactcgtctaaaggagaggatagcgccgaagagactgaagcaaaacccgctgtggtagcgccagctcctgttgtcgaagcagtgtccaccccctccgcagctttcccctctgacgcaactgccgaacaaggcccaatcctgacaaagcacggcaaaaatccagttatggaattgaatgaaaagcggcgaggcctcaagtatgagctcatctcagaaactggcggtagccacgacaagcgattcgtcatggaggtggaagtcgacggacaaaaatttcagggagctgggtctaataaaaaggtcgctaaggcctatgccgcactggctgctctggaaaagcttttccccgatacgccactggcgttagacgcaaataagaaaaagcgcgcaccggtgcctgtcagggggggtcccaaattcgcggctaaaccacacaacccaggatttggcatgggtggtccaatgcataacgaagttcccccacctccaaatctgagaggacggggaagaggagggtctatcaggggccgtggtagaggaaggggattcggcggagctaatcacggcggatacatgaatgccggagctgggtatgggtcctatggctacggtggaaactcggctacagctggctactcccaattctatagcaacggtgggcatagcggcaacgcatccggcggaggagggggaggaggaggagggtcatctgggtacggttcctactaccagggggataattacaattccccagtgcccccaaagcatgccggaaagaaacagccacacggcggacaacaaaaaccctcgtatggttccgggtaccagtcccaccagggccaacaacaatcttacaaccaatccccctattccaattatggccctcctcaagggaagcagaagggatataatcacgggcaaggtagctatagttactctaacagctacaactctcccggaggagggggtggctctgactataattacgagtcaaaattcaactactccggctcaggcggaaggtcagggggaaattcatatggttccgggggagcatcatataatcctggcagtcacgggggatacggtggtggcagcggcggtggcagtagctaccagggcaaacagggaggttactcccagagtaactacaactcaccgggatctgggcaaaactatagtgggcctccttcctcttatcagtcctcacagggtggatacgggagaaacgccgatcacagtatgaactatcagtacagatag

SEQ ID NO: 5029 - DNA, 2295 bp, Artificial Sequence
  Description of Artificial Sequence: Synthetic coding sequence
atgagaccgatgcggatcttcgtgaacgatgaccgtcatgtgatggctaagcacagcagcgtttaccccacacaggaggagctggaagccgttcagaatatggttagccacaccgaacgagccctgaaagcagtttctgattggattgatgaacaagagaagggatctagcgaacaggcagagtccgacaacatggacgtgcctcccgaggacgactcaaaggagggtgccggtgaacagaaaaccgagcacatgactaggactctccggggagtgatgcgggtaggtcttgtcgctaaaggactgctgctgaagggggatctcgatctcgagctggtcctgctgtgtaaggagaagccaacgaccgcgctgctggataaagtggctgacaaccttgccatccagcttgccgctgtgaccgaggataaatacgaaattctacagtctgttgacgatgccgcaattgtcataaaaaacacgaaagaacctcccctgagccttacaatccacttgacctctcctgtcgtaagagaggaaatggaaaaggtactcgcaggggagactctgagcgtgaatgatccccctgacgtcttggacagacagaagtgtttagccgcattggcaagtctacgtcacgctaagtggtttcaagcacgcgcaaatggattaaagtcctgtgtgattgttatccgggttctccgggacttgtgtacgcgcgtgcccacatggggccctttgcggggttggcccctcgagcttctctgcgagaaatcaattggcacggccaatagacccatgggcgcaggcgaggctctccgacgcgtgctcgagtgcctggcatccgggatcgttatgcccgatgggtctgggatttatgatccctgtgagaaggaagcaactgacgcaatcggccacctggacagacagcagcgtgaggacatcacacagagcgctcagcacgccctacgattagctgcatttggccagctccacaaggtgttaggcatggatccccttccttccaagatgcccaagaaacccaagaatgaaaatcccgttgactataccgtacaaattcccccaagcactacttacgctatcaccccgatgaaaagacccatggaggaagatggagaagaaaagtcaccctccaaaaagaagaaaaagatccagaaaaaagaggagaaggccgagccgcctcaagccatgaacgccctaatgagactcaatcagctgaagccagggctacaatacaagcttgtctcccagacggggccagttcacgcacccatctttacaatgagtgtcgaagttgatggcaatagttttgaagcctcgggcccatcgaagaaaacagccaaattgcacgtggccgtgaaagtccttcaggatatgggcttgcccaccggtgcggaaggacgggatagttccaagggagaggattctgcggaagagactgaggccaaacccgctgtggtcgcccctgcacctgttgtcgaggcagtgagtacgcccagcgcagctttcccttctgacgcaacagccgaacagggacccatattaaccaagcacgggaagaatcccgtgatggagctcaatgaaaagaggcgaggactgaaatacgaactcatttccgaaaccggcggtagccacgataagcggtttgtgatggaggtggaggtggacggacaaaagtttcagggggcaggctccaataagaaggtggctaaagcttacgctgcactggcagccctcgagaagttgtttcccgacactcccctggccctagatgctaacaagaagaagagggctcccgtacccgttaggggtgggcctaagttcgctgccaaaccccacaaccctggcttcgggatgggcggtcctatgcataacgaggtcccccctccgcctaatttaagaggacgaggccgaggcggatccatccgaggtcgagggagaggacgtgggttcggcggagccaaccacggagggtacatgaatgcgggtgccggatatggatcttacggctacggagggaatagtgctacagctggatacagtaagtcgagccgccctcctccacccagtcgacctaggtgttgtgtcgtgcgttgctctggttcgccctgtgggcctagctgtgacccatatttggcagtattcggtacgccatgccttcagtggttcgtcagttgccactataacttcgtctgggttgagttcctttccttctgttctagcgtgtccctctgcttgttcacactacgagtgtccggtaatagcgtctgcctttag

SEQ ID NO: 5030 - DNA, 2121 bp, Artificial Sequence
  Description of Artificial Sequence: Synthetic coding sequence
atgaggcccatgagaatcttcgtgaatgacgatcggcatgtcatggccaagcattcttcagtttatcccacacaggaggagttggaggcagtgcaaaatatggtctcacacactgagagagccctgaaagctgtgagcgactggattgatgagcaggagaaggggagtagcgaacaggccgaaagcgacaacatggatgtgcccccagaggatgattctaaagagggggctggcgaacagaaaactgagcacatgacaagaaccctaagaggcgtgatgcgagtcggacttgtagccaagggtctgctgttgaaaggagacctggatctagagttggtgcttttatgcaaggaaaagcctactaccgctctcctggataaagtggccgacaatctcgctattcaactggctgcggtgactgaggacaaatacgagattctgcagtctgtggacgacgccgcaatagtaattaaaaatactaaggagcctccactgtccctaactatccacctcacgtccccagtggtgagggaggaaatggagaaagtgctcgccggtgagaccttgagcgtcaacgatcctccagatgttttggaccggcagaagtgcctagcagccctggcgtccttacgacatgccaaatggttccaagcaagagctaacggtctgaagtcttgtgttattgtcatccgcgtactgagagacttatgcactcgagtgcccacatggggacctctgaggggatggcccttggaactgttgtgtgagaagagtataggcaccgccaatagaccaatgggcgctggagaagctctcaggcgcgtgctcgagtgcctggcatctggaatagtgatgcccgacggttctggcatctacgacccttgtgagaaggaggctacagatgctattggacacctggatagacaacagcgggaggatattactcagagtgcccaacatgcactgaggctggcagcctttggccaactgcacaaagttctgggtatggacccactgccttctaaaatgccaaaaaagcccaagaatgaaaatcctgtcgactataccgtgcaaatccctccttctaccacctatgcaataacacctatgaagcgcccaatggaggaggatggggaagagaagagccctagtaagaagaaaaagaaaatccaaaagaaggaagagaaagcagagccaccacaagctatgaacgctcttatgcgcctgaaccagctgaagcctggtttgcagtacaagcttgtatcccagactgggccagtccatgcaccgatttttacaatgtcagtggaagtggacgggaactcattcgaagcctcaggcccttctaagaaaactgctaaattacacgtggcagtgaaagtgttgcaggatatgggtcttcctacaggcgctgaggggagggatagctccaaaggtgaagattcggccgaggagacagaggcaaagccggcagtcgttgcacccgcacctgtggtcgaagccgtgtccacgccaagcgccgcttttccctcggacgccacagccgaaaatgtgaagcagcagggtcccatactgacaaagcacgggaaaaaccctgtgatggagttgaatgagaaaagacgcggtttgaagtatgagctgatcagcgagacggggggatctcacgacaaaaggtttgtgatggaggtggaagtggatggccagaagtttcaaggagccggatccaacaaaaaggtggccaaggcttacgccgcactagctgccttggaaaaactgtttcccgacaccccactggcactggacgcaaataagaagaaacgcgctccagtgcctgtgcggggagggccaaagttcgctgcaaagccccacaaccccggattcgggatgggaggtccaatgcacaacgaggtgcctccaccccctaatcttaggggtagaggaagaggcggttctatacgcggaagaggaaggggccgtggatttgggggagccaaccacggcggatatatgaatgccggagctggttatggctcctacggttatgggggaaacagtgcaacggccggatatagcgatttctttacagattgctatggctaccacgatttcggatcatcttag

SEQ ID NO: 5031 - DNA, 2073 bp, Artificial Sequence
  Description of Artificial Sequence: Synthetic coding sequence
atgcgcccaatgcgcatttttgtgaatgatgacagacatgtcatggccaagcattcttccgtctatcctacccaagaggaactcgaggccgtgcagaatatggtttctcacactgagagagccctcaaagcggtcagcgactggatagacgagcaggaaaagggttcttccgagcaagcagaatcagataacatggacgtgcctcctgaggacgacagcaaggagggagccggagaacaaaagaccgagcacatgactagaactctcagaggagtcatgagggtggggcttgtcgcaaaaggccttcttttgaagggagatctggatctagagctggtcctcctgtgtaaagaaaaacccaccaccgcattattggataaggtggcagataatctggcaatccagctggcggctgtgacggaggataagtacgagatcctgcagtccgttgacgacgccgcaatagttattaaaaatacaaaagagcctcccctcagcctgacaattcatcttacttcaccagtagtcagagaggaaatggaaaaggtgctggcaggcgaaaccttgagcgtgaatgacccccctgacgtcctggataggcagaagtgtctcgcagccctagctagcctccgacatgcaaagtggtttcaggctcgagcaaacggactgaagagctgcgtgatagttatccgagttcttagagatttgtgcacccgcgttcctacatggggaccactgcgcggatggcccttagaactgctatgtgagaagagcattggaactgcaaataggccaatgggtgctggagaggccttacgcagggttcttgagtgcctcgccagcggcattgtgatgcctgacggcagtggcatttacgatccgtgtgaaaaggaagcaacagatgccatcggccatctcgaccgccagcagcgagaagatatcacgcaatccgcccagcatgcgctgagactcgctgcttttggacagctgcacaaagttctcggaatggatcctctcccgtctaagatgccaaaaaagcctaagaatgagaatcccgtcgattataccgttcaaatccctccatcaacaacttatgccatcaccccaatgaagcggccaatggaggaagatggcgaagagaagtccccctctaaaaaaaagaaaaagatccagaagaaagaagagaaggctgagcccccacaagccatgaatgccttgatgaggttaaaccagctgaaacctgggttgcagtacaaacttgtgagtcagacaggaccagtccacgccccaatttttacaatgagcgtggaggtggacgggaactcgtttgaggccagcgggccatctaaaaaaaccgcaaagctccatgtggccgtgaaagtattacaagacatgggactgcccaccggggctgagggaagagatagcagtaaaggcgaagatagcgccgaggagactgaggcgaaacctgctgtagtggcgcctgccccagtagtggaagccgtcagcacgccctccgctgctttcccttcagatgcgactgccgagcagggacccatcttaaccaaacacggaaagaatccagtgatggagctaaacgagaagcgcagaggtctaaagtacgagctaatcagcgaaacagggggatcccacgacaaacgctttgtgatggaggtcgaagtggatggtcaaaagtttcagggcgcagggtcaaataaaaaagtagctaaagcctacgccgcactagctgccctggagaagctgttccctgatacaccactcgcgctggacgcaaacaaaaaaaagcgtgcacccgtaccagtgagaggaggaccaaaatttgccgctaagccgcacaacccaggctttgggatgggagggccaatgcataacgaggtccctcccccacccaacttgagaggaagaggacggggtggatccatcagaggcaggggtcgcggtcgagggttcgggggagccaatcatgggggatatatgaatgccggtgccggttacggtagttacggctatggaggaaattctgctacggccggatatacggggttcgtttag

SEQ ID NO: 5032 - DNA, 2697 bp, Artificial Sequence
  Description of Artificial Sequence: Synthetic coding sequence
atgcgccctatgaggatattcgtgaacgacgacaggcacgtcatggcaaagcactcaagcgtctatcccacccaggaggaactggaggctgtgcagaatatggtaagccataccgagagggccctcaaggcagtgtctgactggatcgacgagcaagagaaggggtcatctgaacaggctgagagcgacaatatggacgtgcccccagaagatgacagcaaggagggagctggcgaacagaagaccgagcacatgacccgaactctgagaggtgtgatgcgggtagggctggtggccaaagggttacttttaaaaggcgatcttgacctcgaattggttctgctttgtaaagagaagccgacaactgccctgctggacaaagtggcagacaatctcgccatccagttggcagctgtgaccgaggataagtacgagatacttcaatcagtggacgacgctgcgatcgtcattaaaaacacgaaggaaccgccactgtcacttaccatacatctgacctctcctgttgtgagagaggagatggagaaggttcttgccggtgagacactgtctgtaaacgaccctccggacgtgctggaccgccagaaatgtcttgcagctctcgcatcattgaggcacgctaagtggtttcaggcacgggctaacggactgaagagctgtgtaatagtgatccgtgttctgagggacctctgtacaagggtccccacttggggcccacttaggggatggcctttagaattactctgtgaaaagagcattggcactgctaataggccaatgggagcaggcgaggctctccggcgagtccttgaatgccttgcaagcggaatagtcatgcctgacggaagtggtatctacgatccttgtgaaaaagaagccactgacgctatcgggcatcttgataggcagcagcgtgaggatataacacagtctgcgcagcacgctttgcgcctggcggcatttggtcagctacacaaggtgctcggtatggatcccctaccttctaagatgccaaagaagcccaaaaatgagaaccctgtggattataccgtccagatcccacctagcaccacctacgccattacacccatgaaacggccaatggaggaagacggggaagagaagtcaccatcaaaaaaaaaaaaaaaaatccagaaaaaggaagagaaggcagagccgcctcaagccatgaatgctctcatgagattgaatcagctgaaacccggtttgcaatataaacttgtctctcagaccgggccagtgcacgccccaatctttacgatgtccgtcgaagtggatggcaatagttttgaagctagcggcccttcgaagaagactgccaaactccacgtcgctgtgaaggtgctgcaagacatgggacttccaactggcgctgaagggagagactcgtcaaaaggagaggattccgctgaggagacagaagcaaagcctgcggtagtggctcctgcacccgttgtggaagctgttagtacaccgtctgctgctttcccttccgatgccacagcagagaacgttaaacagcaaggaccaatcctcaccaaacacgggaagaatcctgtgatggagcttaatgaaaagcggagggggctaaaatacgagctgatcagcgaaactggcggatcccacgacaagcgatttgtgatggaggtggaggttgatgggcagaaattccagggcgctggtagcaacaagaaggtggctaaggcctatgcagcattggctgccctcgagaaactgttcccagataccccactggctcttgatgcaaacaaaaaaaagagagcccctgtccccgtgcgtggcggacccaaattcgcggctaaacctcataatccgggatttgggatgggaggacctatgcacaacgaggtaccacctcctcctaatcttcgaggcagaggcaggggcggaagtattcgcggacgtggccgtggcagagggtttgggggagccaatcatggcggttatatgaacgctggagcaggttacgggtcgtacggatatgggggtaattcagcgaccgccggatactcccagttctattccaatggcggtcacagtgggaatgctagcgggggaggcggtgggggtggtgggggatcttccgggtacggcagttactaccagggcgataactataactcgccagtcccaccaaagcacgctggaaaaaagcagcctcatggtggtcagcagaaaccttcatatggtagtggataccagtctcatcagggacagcagcagagttataaccagtcaccatattcaaactatggcccaccacaagggaaacagaaaggatataatcacggacaaggaagctactcctatagcaattcatacaactctccaggcggaggtgggggatctgactacaactacgagtcaaagtttaactattctggatctggaggacgttctggaggcaatagttacggctcaggcggagcatcctacaacccgggatcccatgggggttacggaggtggctctggtggcggaagtagttatcaaggaaagcaggggggatactcccaatctaattataactctcctgggtcaggacagaattactcaggccctccatcatcataccaatccagtcagggaggctacggaaggaacgccgaccattcaatgaattaccagtatcggtag

SEQ ID NO: 5033 - DNA, 882 bp, Artificial Sequence
  Description of Artificial Sequence: Synthetic coding sequence
atggcgactgccaggccaccctggatgtgggtgctgtgcgcgctgatcacagctctgcttttaggcgtgaccgagcacgtgctcgctaataatgacgtgtcatgtgatcatccttcaaataccgtgcctagcgggtctaatcaagatctaggagctggcgcaggagaggatgccaggtccgacgactccagcagccggatcattaacggctccgattgtgacatgcatactcaaccctggcaggcagccttactgctccgcccaaaccagctgtactgtggagctgtgctggtccacccccaatggctcctgaccgctgcacactgtcggaaaaaagtattccgggttcggctgggccattactctctgtcaccagtgtatgagtcagggcagcaaatgtttcagggagtcaagtcgattcctcatccgggttacagccacccgggacacagcaacaacttgatgctcatcaaacttaacaggagaatccgccctactaaggacgttaggccaattaatgtgtcatcccactgccctagcgccggaaccaagtgcctggttagtggatggggcacaacaaaaagccctcaggtacattttccaaaggttctgcagtgcttgaatatatctgtgctctcccagaaaagatgtgaggacgcctatccccgacagattgatgacacgatgttctgcgcaggagacaaagcaggtagggacagctgccagggagacagcggcggacccgtcgtgtgtaatggtagccttcagggtcttgtgtcttggggcgactacccttgtgctcggcctaaccgcccaggagtctacacaaacctgtgcaaattcacaaagtggatccaggaaaccatacaggctaactcttag

SEQ ID NO: 5034 - DNA, 882 bp, Artificial Sequence
  Description of Artificial Sequence: Synthetic coding sequence
atggccacggccaggcctccttggatgtgggtcctgtgcgcactgattaccgcattattgctgggcgtgacagaacacgtactggctaacaacgatgtatcttgtgaccacccctcaaacactgtgccatcaggatcaaaccaggacctgggggctggtgccggagaggatgcacggtcggacgattcaagctcacggatcattaatggttccgactgcgacatgcatacacagccatggcaggcagcactattactgcgtcctaatcagctttactgcggcgctgtgctcgtacacccacagtggctcctgacggctgcccattgtagaaaaaaggtcttccgcgtgagattaggtcactacagcctgtcgcctgtctatgagtccggacaacaaatgtttcagggggtgaagagcattccccatccgggatactctcacccgggtcactccaacaacctgatgctgatcaaactcaaccgccgtatcagacctaccaaggacgtgaggcctatcaacgtgtcgagccactgcccatcggccggaactaaatgtttagttagcggctggggaacaactaaaagcccccaagttcactttcccaaagtgctgcagtgtctcaatatctcagtcctgagtcagaagcgttgtgaagacgcttaccctcgccaaatcgacgacaccatgttctgtgcaggtgataaagccggaagggattcctgccaaggtgattccggcggtcctgttgtttgcaatggttctctgcagggccttgtctcctggggggattatccatgcgcacgccctaataggcccggtgtgtataccaacctctgtaagtttactaagtggatccaggaaaccatccaggcaaattcctag

SEQ ID NO: 5035 - DNA, 882 bp, Artificial Sequence
  Description of Artificial Sequence: Synthetic coding sequence
atggcaactgcgagaccaccttggatgtgggtgctgtgcgctctcatcactgctctgctgctgggagtaactgagcatgttctcgcgaacaatgatgtgtcctgcgatcatccaagcaacaccgtgccgtctgggtcaaatcaggacttgggggcaggggctggtgaggatgcgaggagcgacgactcatctagcagaatcattaatgggtccgattgcgacatgcacacacagccttggcaggccgcactcctgcttcgcccaaaccaattatactgtggcgcagtgctagtgcacccacaatggcttctgaccgctgcccactgcagaaagaaagtcttcagagttagactgggccactatagcttatcccctgtgtacgagagtgggcaacagatgtttcaaggagtaaagagtattccccacccgggatactcccatcccggacattccaacaatttgatgctgatcaagctcaaccgaaggattcgccctactaaggacgtcagacctattaacgtgagtagtcattgtccgagtgccggtactaagtgcctggtgtcaggctggggcaccactaagagcccacaggtacattttcccaaggtcctgcagtgcctgaatatctccgtgctcagtcaaaaacgctgtgaggacgcatatccgagacagatcgacgataccatgttttgcgcgggagacaaggctggacgagacagttgccaaggggacagtggaggccctgtggtgtgcaatgggagcctccagggtttggtgtcatggggggactatccatgtgccagaccgaatcgcccaggcgtttacaccaacctttgcaaattcaccaaatggatccaggagaccatccaggctaactcgtag

SEQ ID NO: 5036 - DNA, 2109 bp, Artificial Sequence
  Description of Artificial Sequence: Synthetic coding sequence
atgccaattaacaaaagcgaaaagccagaatcctgcgacaacgtcaaggtggtagttagatgtagaccccttaatgaacgcgaaaaatccatgtgttataagcaggctgtcagcgtcgatgaaatgagggggaccattacagtgcataaaacagattcttcaaacgagccaccgaagacctttacatttgatacagtgtttggtcctgagtccaagcaactggacgtgtacaacctgactgctcggccaattatcgacagcgtcttagagggctacaatggcacgatcttcgcatatggacaaacagggactggcaaaaccttcaccatggagggggtcagggcaattcctgagctgaggggaattatccccaattctttcgcccacatctttgggcatatagccaaggctgaaggcgataccaggttcttggtgagagtatcataccttgagatttacaacgaggaagttagggacctgcttggaaaagatcagacacagcggctggaggtcaaagaacgacccgatgtgggggtgtatataaaggatttgtcagcctacgttgtgaacaatgctgatgatatggacaggataatgacattaggccacaaaaatcggagcgtcggagctacaaacatgaacgagcactccagccgctcacatgctatctttacgatcacaatcgaatgttctgagaaagggatcgacggcaatatgcacgtcaggatgggtaagttgcatctggtcgatctggctggaagcgaaagacaggccaagacaggggctaccggccagcggttgaaggaagcgaccaagatcaacctttccctgtcaaccctgggaaacgtgattagcgccctcgtggacgggaagtctactcatgttccttaccgtaatagcaaattaacccggttgctgcaggatagtcttggcggaaacagtaagacaatgatgtgcgctaatatagggcctgccgattataattacgatgaaacaatctctacactccgctacgccaacagggctaaaaatataaaaaataaagccagaattaacgaagaccctaaggatgctttgttgagacagtttcagaaagaaattgaagaattaaaaaaaaaactcgaagagggcgaagagatcagtgggtccgacatcagcggctcagaagaagatgatgatgaagagggtgaagttggagaagatggagaaaaacggaagaaaagaagggatcaagctgggaagaagaaagtgtcccctgataaaatgatcgaaatgcaggctaaaatcgacgaggagagaaaggctctggagactaagctcgatatggaggaggaggaaagaaacaaggctcgcgcagaattagaaaagagggagaaggatctcttaaaagcccaacaagagcaccagagcctcttagagaaactctcggcgctggaaaagaaggtgatagtgggcggtgttgaccttcttgctaaggccgaagagcaagagaaactgctcgaagagagtaatatggaattggaagaaagacgcaagagggctgagcagttacgcagagagcttgaagaaaaggagcaggagcgcttggacattgaggaaaaatataccagtctccaggaggaagcacagggcaagacaaagaaactgaagaaagtgtggactatgctcatggccgcaaagtctgagatggccgatttacagcaggagcatcagcgcgagatcgagggcctgctggagaacattcgccagctgtcccgagaactgagactgcagatgttgatcatcgacaatttcattccacgagattaccaggagatgattgagaattatgtacactggaacgaagacattggcgaatggcaactcaagtgtgtcgcctacaccggaaataacatgagaaagcagactccagtaccagacaagaaggagaaggatccattcgaagtggatctttcccatgtgtacctggcatacaccgaggagtcactgcgccagagtctgatgaaactcgaacgccctagaacttcgaaggggaaggcacggccaaagacaggtcgcaggaagaggtcagccaaaccagagaccgtgatcgactcactattacagtag

SEQ ID NO: 5037 - DNA, 2100 bp, Artificial Sequence
  Description of Artificial Sequence: Synthetic coding sequence
atgcccatcaacaaatctgagaaacccgagagctgcgataatgtgaaggttgttgtaaggtgcaggcctttgaacgagagagaaaagtcaatgtgctataagcaggcagtgagcgtggatgaaatgaggggcactatcacagtacataagaccgattcttccaacgagccaccgaagacctttacattcgacactgtgtttggtccagagagtaagcagttagacgtgtataaccttactgctagaccaattatcgactccgtcctggaagggtacaatggaacaatctttgcctatggacagactggaactggaaaaaccttcactatggagggggttcgggctatccctgaactgagagggatcatacctaacagcttcgcgcatatatttggtcacatcgcaaaggcagagggcgatacgcgcttcttggtgcgggtgtcatacttggagatctataacgaggaagtccgagatctgctaggaaaggaccagacccagagactggaggtcaaggaaagaccagacgtgggcgtctacatcaaggatctatccgcttatgtggtgaacaatgcagacgacatggatcggattatgacattgggacataagaatcgcagtgttggggctaccaatatgaatgaacattcaagccgctcccacgccatttttacgataaccatcgagtgctcagagaagggcatcgacggcaatatgcacgtgcgcatgggtaagctacacttagttgatctggcgggaagtgagagacaggcaaaaactggcgctactgggcagcggctgaaagaagccacgaaaattaacctgtctctgagcaccttgggaaacgtgatatccgcacttgttgatggcaaatccactcatgtgccctataggaattccaaattgacacgcctgctccaggattcgttgggcggtaattccaaaaccatgatgtgtgcaaatatcgggcctgcggactacaattatgatgaaacaatttccaccctgcgctacgccaaccgtgccaagaacataaagaacaaggctagaataaatgaggatcccaaggatgccttactgcgtcagttccagaaggagatcgaggaactgaagaagaagctggaggaaggagaggagattagcggttccgacattagcggctctgaggaggatgacgatgaggagggcgaggtgggggaggatggagagaagcgcaaaaagagacggggaaagaaaaaagtttctcctgacaaaatgatcgagatgcaagccaagatcgatgaggaacggaaagctctcgaaactaaactggatatggaagaggaggaacggaacaaagctcgagccgaacttgagaaaagagaaaaagacctgctgaaggcccagcaggaacaccaaagcttgttagaaaaattatccgccctcgagaagaaggtgattgtgggtggagtggacttgctggctaaagccgaagaacaggaaaaacttttagaggagtctaatatggaactcgaagaaaggaggaagcgtgccgaacagctccggcgagagctggaagagaaagagcaagaacggctggacattgaggagaagtatacctccctccaagaggaagcccagggcaaaaccaagaaactgaaaaaggtgtggacaatgcttatggctgccaagtccgagatggccgacctccagcaggaacaccagagagagatagagggactcctggaaaatattcggcagctgagccgcgagctgcgcttgcagatgctaatcatagacaatttcattccacgggactaccaagagatgatcgagaattatgttcattggaacgaggatatcggcgaatggcagctgaagtgtgtggcttacacaggcaacaacatgcgcaagcagacccctgtgcctgacaaaaaagagaaggatccatttgaagtggatttgtcacacgtttacttagcctacacagaggaatcgctaaggcagtctctgatgaagctcgagagacccaggacttcgaaggggaaggctaggcccaaaaccggaagacggaagcgttccgcgaagcccgaaacggtcatcgattcactcctacagtag

SEQ ID NO: 5038 - DNA, 1230 bp, Artificial Sequence
  Description of Artificial Sequence: Synthetic coding sequence
atgtgttacaaacaagccgtatcagtcgacgaaatgaggggtactattactgtacataagaccgacagcagtaatgaaccaccaaagacattcacattcgacacagtgtttggccctgaatccaagcagctggacgtttacaatctgactgcacgccctatcattgattcagtgctcgaaggctacaatggcaccatcttcgcgtatggccagacaggtacagggaaaacgttcaccatggagggagtccgggcaattcctgagttgaggggaataatccccaactcctttgcacatatcttcggccacattgccaaggccgagggcgataccaggttcctggttagagtgtcctacctggaaatttataatgaagaggttagagatttactagggaaagaccagacccagagactggaagtcaaggagaggccagacgtaggagtgtacatcaaggatctctccgcctatgttgtaaacaacgccgacgacatggatcgcattatgacgctcggacataagaaccgttccgtgggggcaactaacatgaatgaacactcctcacgtagtcacgcgatttttacaattactatcgagtgctctgaaaagggcatagatggaaatatgcatgtcagaatgggaaagttgcacttggtagatttggccggaagtgagcgtcaggcaaagacaggtgcaactggccagcgactgaaggaagctactaagatcaatctgtcgctgagcacactgggaaacgtcatttcggcactggtcgacggcaagtctacccacgtcccatataggaattcaaaactgactcgtcttttgcaggactctctcggcggtaactctaaaaccatgatgtgtgccaacataggtccggctgactacaactatgacgaaactataagcaccctcagatacgcgaaccgagcaaagaacatcaagaataaggcaagaattaacgaagacccaaaagacgcactactgcgacagtttcagaaggagattgaggagcttaagaaaaagcttgaggagggagaagaaatttccgggagcgacatatccggctccgaggaggatgatgacgaggaaggggaagttggcgaagatggcgagaaacgcaagaagcggagaggcaagaagaaggtctctcctgacaagatgatcgaaatgcaagccaaaatcgacgaagaacggaaaaagaaaaaaaagaagaaaaagaaatag

SEQ ID NO: 5039 - DNA, 2181 bp, Artificial Sequence
  Description of Artificial Sequence: Synthetic coding sequence
atgccaattaacaagtctgaaaagcccgagtcttgcgacaatgtgaaggtagtggtgcggtgtcggcctctcaacgaacgggagaaaagtatgtgttacaagcaggctgtgtcagtcgacgagatgcgaggcaccatcacagtgcataagaccgactcttcgaatgaacctcccaaaacttttacctttgacacggtttttggaccagagagcaagcagctggacgtgtataatttgaccgctagacccataatcgacagtgtgttagaaggctataatgggaccattttcgcttatggacagactggcacagggaagacatttaccatggagggagtgagagctattcctgagctcaggggtattatccctaattccttcgctcacatcttcggacatattgccaaggccgagggggatacccgcttcctagtcagggtgtcctacttagaaatctacaacgaagaagtgagagacttactgggcaaagatcagacacagcggctcgaggtgaaggagagaccagacgtgggtgtgtacatcaaagacctcagcgcttatgtcgtcaacaacgctgacgacatggaccgaatcatgaccctaggacacaagaatagaagtgtgggagccaccaatatgaatgagcactcgtcacgatctcatgcaatctttacgatcacgatagagtgctcagagaaagggatcgacgggaatatgcacgtgcggatgggtaaactccacctggtagacttggcaggctctgagcgtcaggccaaaaccggtgccacagggcaacgattgaaagaagctacgaaaataaacttgtccctctccactttaggcaacgttatctcagccttagtcgacgggaagtcaacccacgtcccttacagaaattccaaactcacgcggctcttacaagattccctcggcggaaatagcaagacaatgatgtgtgccaatatcgggccagccgattacaattacgacgagacaatctctactctgagatacgcaaacagggccaagaacattaagaacaaagcacgcatcaatgaagaccctaaggacgccctgctgcgccagtttcagaaagagatcgaggagctgaagaaaaagctcgaagagggagaggaaatctccggctccgatattagcggctccgaggaggacgatgacgaggagggggaggtgggcgaggatggcgagaaaagaaagaaaagaaggggaagctcttccagctccagcagtgactccacctgcagtgtcatcgagaagcctctcgataagttcctgcctattcagatcggcaagaagaaagtgagtcctgacaaaatgatagagatgcaggctaagattgacgaagaacgcaaggctctagaaacaaagctggacatggaggaggaggaacgcaacaaggctcgggcagagctcgagaagcgagagaaagacctgctcaaggcacagcaggaacatcagagcttattggaaaaattgagtgccttggaaaagaaagtgattgttggtggggtggacctgctggccaaggcagaggagcaggagaagttgcttgaagagtctaatatggagttagaagagcggcgtaaacgagctgagcagttgagacgcgagctcgaggagaaagagcaggagcgtctcgacatcgaggagaagtatacctctctacaggaggaagcacagggcaaaacaaaaaagctgaagaaggtctggactatgctcatggccgcaaaatcagagatggcggacctccagcaggagcatcagcgtgagattgagggcctgctagaaaatatcaggcagctctcccgggaactccggttgcagatgctgattattgacaattttatcccacgcgactatcaggagatgattgagaactatgttcactggaatgaagatatcggagagtggcagcttaaatgcgtggcatatactggtaataacatgcggaagcaaacgccagtccccgataaaaaagagaaggatccatttgaagtggatctgtcccacgtgtatctcgcatacactgaagaaagcttacgacagtctctcatgaagctggagcggccacgtacaagtaaaggaaaagccagaccgaaaactgggaggcgcaaaaggtccgcgaagccagagaccgtgatcgattccttgcttcagtag

SEQ ID NO: 5040 - DNA, 1035 bp, Artificial Sequence
  Description of Artificial Sequence: Synthetic coding sequence
atggtcagtgtgaactcatctcactgcttctataatgactcatttaagtatactctctacggatgtatgttctcaatggtgttcgtgctgggcctgattagtaactgcgtagccatttatatcttcatttgtgtactgaaagttcgcaatgaaacaaccacttacatgataaatctggcgatgagtgatctgctgttcgtgttcactcttccattcaggattttttactttacaacccgcaattggcctttcggcgatctactttgcaaaatctctgtcatgctgttctacacaaacatgtacggttctatactgtttctgacttgtatatcagtcgaccgattccttgcaatcgtgtaccctttcaagtctaagacccttcgcaccaagaggaacgcgaagattgtctgtacgggcgtgtggctcaccgtcatcgggggatccgcccctgcagtgttcgtacagagcacgcactctcaaggaaacaatgcttccgaggcttgttttgagaactttccagaagctacgtggaagacttatctttctagaattgtaatttttatcgaaatcgtcggcttcttcatcccgctcatcctcaatgttacctgtagtagtatggtattgaagaccttaaccaagcctgtgactctgtccaggtcaaagataaacaaaactaaggtgctcaaaatgatattcgtacacctaatcatattctgcttttgctttgttccctacaacatcaatttgatcctgtactctctggtccggacacagacattcgtgaattgctcagtggtggccgctgtgagaacaatgtatccaatcacactttgtattgcggtgagcaactgttgtttcgatccaatcgtgtactatttcaccagcgatacaatccagaactccattaagatgaagaattggtcagtgcggaggagcgacttccgtttttcggaggtgcacggtgctgaaaatttcatccagcacaaccttcagacactgaaatctaaaatttttgacaatgaatcggccgcatag

SEQ ID NO: 5041 - DNA, 1035 bp, Artificial Sequence
  Description of Artificial Sequence: Synthetic coding sequence
atggtcagtgtcaacagctcccattgtttctataacgactccttcaaatacaccctttacggctgcatgtttagcatggtgtttgtgttgggcttgattagtaactgcgtggctatatatatttttatttgcgtccttaaggtgagaaatgagaccactacctacatgattaacctcgcaatgtctgatctgctgttcgtcttcacgctcccattcagaattttctattttacaacccggaattggccttttggtgatttactgtgtaaaatcagcgtgatgctcttttacaccaatatgtatgggtcgatcttatttctcacttgtatctccgtggacaggttccttgccatcgtttacccatttaaatccaaaacactcaggacaaaacgcaatgccaagatcgtgtgcacaggagtgtggttgacagttatcggaggctccgccccagccgtcttcgtccaaagcacacactcacagggcaacaatgcctccgaggcttgcttcgagaacttccctgaggctacatggaaaacctatctgtcaagaatcgtaatttttatcgaaatagtcggcttcttcattccccttattctgaacgtcacatgttctagtatggtcctcaaaactttgactaagcctgtcaccctgtccagatcgaagatcaacaaaacaaaggttttaaagatgatattcgtgcaccttatcatattctgcttttgctttgtaccctacaatatcaatttgatcttgtactctctggttaggacacaaacattcgtcaattgctccgttgttgctgcagtgcgaaccatgtacccgattactctgtgtatcgccgtctctaactgctgctttgaccctatcgtgtactacttcacatccgatacgatccagaacagcatcaagatgaaaaactggagcgtgaggaggagcgactttcgatttagcgaggttcatggcgcagaaaactttatccagcataatctgcagactttaaagtccaaaatcttcgataatgaaagcgcagcctag

SEQ ID NO: 5042 - DNA, 795 bp, Artificial Sequence
  Description of Artificial Sequence: Synthetic coding sequence
atgcttaggggcccttgggcttttcactacaacgtgagttcccatgggtgtcagctcctgccttggactcagcacagtccccacacgagactgcgacggtcaggccgttgtgatctcttccagaagaaagattatgtgaggacctgcatcatgaataatggagtggggtatcgtgggacaatggccacaacggtaggcggattaccctgccaggcgtggtctcataagttcccgaatgatcataagtatactccgaccctgcgtaatggtctggaagagaacttctgcagaaatcccgacggcgaccctggtggaccctggtgctatacgactgatcccgcagtgcgctttcagtcttgtggaattaaatcctgccgtgaggctgcttgcgtctggtgcaatggggaagaatataggggggcagtagaccgaaccgaatctgggagggaatgccagcgttgggaccttcagcatccccatcaacacccgtttgaaccaggaaaattcttggaccaggggctggacgacaactattgtcgcaaccctgatggctccgagagaccctggtgctataccactgacccccagattgaaagggagttctgtgacttgccgagatgcggcagcgaagcgcagcccaggcaagaggccacaactgtgagctgtttcagagggaaaggtgaaggctaccggggtacggctaatacaacaacggctggagtcccatgtcagcgatgggatgctcagatcccgcaccagcataggttcacccctgagaagtatgcttgtaaatag

SEQ ID NO: 5043 - DNA, 2178 bp, Artificial Sequence
  Description of Artificial Sequence: Synthetic coding sequence
atgggactgtggtgggttaccgttcaacctccagcgagaaggatggggtggttgccactgctgctgctgttaacacagtgtttgggagtcccaggtcagaggtcccccttgaacgacttccaggtcttgagaggtacagagctccagcatttacttcacgccgtggtacccggaccatggcaggaagacgttgcagacgccgaagagtgcgctggacggtgtggccctttaatggactgccgggcattccactataacgtctcatcccatgggtgtcaactgctgccatggacccagcattccccccacacaaggctgcgaaggagcggtagatgcgacctctttcagaagaaagattacgttcggacctgcatcatgaacaacggagtagggtatagggggacaatggcaaccacagtgggaggcctcccctgtcaagcctggtctcataagttccccaacgaccacaagtacactccgaccctgagaaacggactggaggaaaatttttgtcggaacccggacggagatccaggcggaccctggtgctataccacagaccctgcggtgcgcttccagtcttgtggaataaagagttgtagggaagcagcctgcgtatggtgcaacggagaggagtaccggggagccgtcgacaggaccgagtctggtagagagtgccagagatgggatctccagcaccctcaccagcatcctttcgagccaggaaagttcctggatcagggtctggatgacaactattgtcgaaatccagacgggtccgaaaggccctggtgctacaccaccgatcctcagatcgagagggaattctgtgatctgccacggtgcggatctgaggcccagccgaggcaggaggcgacaaccgtgagttgttttcgcggaaagggtgaagggtatcgtggcaccgcaaatacgactactgcgggtgtaccttgccaaaggtgggacgcccagatcccgcaccagcaccgctttaccccagagaaatatgcctgtaaagatctacgagagaacttttgtcggaatccagatggatccgaagcaccttggtgctttactttacgcccaggaatgagagcggcattctgttaccagatccggagatgcaccgacgacgtgcgtccccaggactgctatcacggtgctggcgagcagtataggggaacagtctcaaaaacccggaaaggcgtgcagtgtcagagatggtctgcagaaacgcctcacaaacctcagtttacctttacctctgagccccacgctcagttagaggaaaatttttgccgcaaccctgacggcgacagtcacggtccttggtgctacactatggatcccaggaccccttttgattattgcgccctgcggagatgtgccgacgatcagcctccatccatcctcgaccctcccgaccaggttcagttcgaaaaatgcggcaagcgcgtcgacaggctggaccagagacgaagtaaattacgcgtggtggggggacaccccggtaacagcccctggaccgtatcattgcggaatagacaaggacaacacttctgtgggggtagcctagtaaaggaacagtggatcctcaccgccagacagtgttttagctcctgccatatgcccctgactggctatgaagtgtggctggggactctctttcagaacccacaacacggggaaccttctcttcagagagtccctgtcgccaagatggtttgtggccctagcggctctcagctcgttctgttaaaactggaacggtcagtgaccctcaaccagagagtggctctgatttgtctccctcctgagtggtacgtggttcctcctggaaccaaatgtgagattgctggatggggagagaccaaggggaccgggaacgacacagtgttgaacgtagcactccttaacgtcatctctaaccaggagtgcaacataaaacacaggggcagagtgagagagagcgaaatgtgtactgagggcctgttggcaccagtgggggcatgcgaaggcgattatggcggaccactggcatgttttacgcacaactgttgggtgctggagggaatcattattccaaatcgcgtctgcgctcgaagccgctggcccgctgtgtttacccgagtcagtgtattcgtcgactggatccacaaggtaatgaggttgggatag

SEQ ID NO: 5044 - DNA, 495 bp, Artificial Sequence
  Description of Artificial Sequence: Synthetic coding sequence
atggggtggctccctctgttgctgctcctcacacagtgcctgggtgtccccggacagaggtctcccttgaacgacttccaggtcttacgcggaaccgaactgcagcacttactccatgccgttgtccctgggccatggcaggaagacgttgctgatgcagaggagtgcgctggtaggtgcggaccgctgatggactgccgcgctttccattacaatgtgagctcccacggatgtcaattactcccctggacccagcattcaccacatacccgcctccggagaagtggcaggtgcgacctgttccagaaaaaaggcacccggcctctgagtgggatggcatggaaaagaacctcagctgttactttgatggccactcctgaggtgctgggggcaactcaacagactctgctttgcgcaagtcgtgccgcagcttccaatcccgctggacgcccacgagtgagcggtgctatggcgcgaaataccgcagcacgctag

SEQ ID NO: 5045 - DNA, 2070 bp, Artificial Sequence
  Description of Artificial Sequence: Synthetic coding sequence
atggcacccgctcccgtaactctgctcgcccctggcgctgccagctccatgtcctgctcccaacccggacagcggtccccatctaacgatttccaggtattgaggggcacggaactacagcatctgctgcatgctgtagtgccaggaccatggcaagaagatgtggccgacgccgaggaatgtgccggtcgttgcgggcctcttatggattgctgggccttccactacaatgtgagcagccacgggtgtcagctgctcccctggacccagcacagtccccacagcaggctgtggcattctggcaggtgcgacctttttcaggagaagggcgaatggggctatatgccaaccttgaggaacggcctggaagagaatttctgcagaaatccagacggagaccctgggggaccatggtgtcacacaaccgatcccgctgtcagatttcaatcttgttctatcaagagctgccgagtggctgcatgcgtgtggtgcaacggcgaggaataccgcggagccgtggaccggaccgagagcggtcgagagtgtcagcggtgggacttgcagcatccacaccaacatccattcgagcctggcaaattcctggaccaggggttggatgacaactactgtaggaatcccgacggcagtgagaggccttggtgctacacgactgatccgcagatcgaaagagaattttgtgatttgccacgttgtggctccgaggcccagcccagacaggaggcgacaagcgtgtcatgtttccgcggtaaaggagagggttaccgcggtaccgccaatacgacaacggcggcatacctggcctcagtcggaacccgaaagagtcacattagtactgatttgcggcaaaagaatacaagggcctcggaagttggcggaggagccggagtggggacctgttgttgcggagatctgagggaaaacttttgttggaatctcgatggttctgaagccccttggtgttttacactcagacctggtacacgcgttgggttctgctatcagatcaggcggtgcacagacgatgtgagaccccaggactgctatcacggagccggtgagcaatacagagggactgtgagcaagacacgaaagggagtacaatgtcagagatggagcgccgagacgccccacaaactccaagcccttaccctgggaagacatgcattaatgagtggaaccagggcctggaagtggctgagattgccctgccatgattttgcgccagcccctgcctctgtgcatatttaccttcgtacagcctgcacaactgggggtgagcttctccctgaccctgatggagactctcatgggccttggtgctataccatggatccgaggacgccttttgattactgtgccctccggcgatgcgaccaggtccagttcgaaaaatgcggcaagcgggttgataggctggaccaaaggaggagcaaattaagagtggctggtgggcacccgggaaactctccttggacagtgtcccttcgcaaccgacacatgccactcacgggctatgaggtgtggctgggaacactgtttcaaaatccccagcatggggagccgggactgcagagagtgccagtggcgaagatgttatgtgggccttctggatcccagctggtcttacttaaacttgagagatcagttactctcaatcagcgcgttgctttgatttgcctgcctccagaatggtacgtagttccgcctggtactaaatgcgaaattgctggttggggtgagacaaaagggaccggcaatgatacagtccttaacgtcgccctgctaaatgtgataagtaatcaggagtgcaatatcaaacatagaggccatgtccgcgaatctgagatgtgtaccgagggcctgctcgcccctgtcggtgcttgcgagggagattacggcggtccccttgcttgcttcacacacaattgctgggtactcaagggcatacgcattccaaatagggtctgcaccaggtccagatggccagctgtattcacccgcgtgagcgtattcgtcgactggattcacaaggtaatgcgactcggctag

SEQ ID NO: 5046 - DNA, 1698 bp, Artificial Sequence
  Description of Artificial Sequence: Synthetic coding sequence
atgacatccagatgctccggggctcaaagttatctgctgcacgctgtagtccccggaccctggcaagaggatgttgcagacgcagaagagtgtgccggacgttgcgggcctctcatggactgctgggcttttcactataatgtatccagccacgggtgccagctacttccatggacacagcacagtccgcatagccggctgtggcatagtggcagatgtgacttatttcaggagaaagactacattcgcacctgtattatgaacaacggtgtgggctatagaggtaccatggccacaacggtgggtggactatcctgccaagcctggtcacataaattcccgaacgaccacaaatatatgccaacacttcgcaacgggcttgaggaaaacttctgcagaaatccagacggcgatcccggtgggccttggtgccataccaccgatcctgccgttaggttccaaagctgctcaatcaaaagctgtcgcgtggccgcttgtgtatggtgtaatggtgaggaatatagaggggctgttgataggacagagtcggggagggagtgccagaggtgggatctgcaacaccctcatcagcatccttttgagccaggaaaattcctcgaccagggtctggacgataattactgtagaaatcctgacggcagcgagaggccttggtgctacacaacagacccccaaatcgagcgggagttctgtgacttgccccgatgcgggtcagaggcacagcctcgacaagaggctacaagcgtttcatgtttccgaggcaagggggaaggctatcgagggactgctaacaccaccaccggagtgccgtgccagagatgggacgcacagattccccatcagcacagattcacccccgaaaaatatgcctgtaaggatctgcgcgagaacttttgctggaatctagatggttctgaggctccctggtgcttcactctccgtccaggcactagggtcggattttgttatcaaatacgcagatgcacagatgatgtgaggccccaagattgctatcatggtgctggtgaacagtacagaggcacagttagtaagaccaggaagggggtgcagtgccagcgctggtctgccgaaacaccccataagttacaatttacttttacttccgaacctcacgcccagctggaggagaacttttgccagccagatggtgactcccatgggccatggtgctacacgatggacccaaggacccctttcgattattgcgccttacgccgatgtgccgacgatcagccacccagcatccttgaccctccgaatcaggtgcaattcgaaaaatgtgggaagagagtcgaccggctcgatcagcgcagatccaagttgagggtggccggaggtcatcccggaaattcgccctggactgtgagccttaggaatagacagggacagcacttttgtgccggtagcttggtcaaggaacagtggattttgactgccaggcagtgcttttcatcttgccatatgccactgacaggctatgaggtctggctcgggaccctgtttcagaaccctcagcacggggagccaggactgcagagggtgccagtcgccaagatgctgtgtggcccttcagggtcccagttggtcctgttgaaactggaacgttccgtcaccctcaatcagcgggtggctctgatatgtttacccccagagtag

SEQ ID NO: 5047 - DNA, 2148 bp, Artificial Sequence
  Description of Artificial Sequence: Synthetic coding sequence
atggcccctgcacccgtcacactgttggctcccggagcagcatcctccatgagctgctctcagccaggacagaggtctccttcaaatgactttcaagtcctacgtggtactgaacttcagcacctgctgcatgccgtggtgccgggaccttggcaggaagatgttgctgatgcagaggaatgcgctggcaggtgcggtccccttatggactgctgggcctttcattataatgtgtccagtcatggatgccaactgctgccctggactcaacattctccccactcccggctttggcactccgggcgatgcgatttgtttcaggaaaagggcgagtggggatatatgccgacactgagaaatggccttgaggaaaatttctgcagaaatccggatggcgaccccggaggtccgtggtgccacaccacagatccagccgtccggttccagtcctgtagtattaaatcatgtagggtagcggcatgtgtgtggtgtaacggagaggaatatcgcggagctgtagatcgcaccgagtctgggagagagtgtcagcgctgggatttacaacatccacatcagcacccctttgagcccggaaaatttctggatcaaggcctggacgacaactactgtcgcaaccccgacggctcggaacgaccttggtgttataccacagatcctcagatcgaaagagagttttgcgatctgcctcgatgcggaagcgaagcgcaacctaggcaggaggctacaagcgttagctgttttcgcggaaaaggagaagggtaccgtggtacagcgaacacaactaccgcagcctatcttgcaagcgttggaactcggaagtcccacatatcgactgacctccggcaaaagaatactcgggctagcgaagtcggtggtggcgctggggttggtacatgttgctgcggtgaccttagggagaatttctgctggaacctcgacggtagcgaagctccatggtgtttcacactgagacccggtaccagggtggggttttgctatcagattagacggtgcactgacgatgtgcggccacaggactgctatcatggggcaggcgagcaatatagaggtacggtcagcaagaccagaaaaggtgttcagtgccagcgctggtccgctgagactccgcataagctgcaggccctgacactgggaagacacgcactcatgtccggaacacgcgcttggaagtggctcagactcccgtgtcacgatttcgccccagccccagcaagcgtccatatttacctgcgtacagcttgtacaacaggtggagagcttctgcctgatccagacggcgacagccatggcccttggtgctacactatggaccccaggaccccatttgattattgtgctctgagacggtgtgatcaggtgcaatttgagaagtgcggaaagcgggtggatcgcctagaccaacgtcgatctaagctgcgcgtagccggaggacaccccggtaattccccctggactgtatcactgcgtaaccggcaggggcagcatttttgtgctggcagcctcgtaaaagaacaatggattttaaccgcccgacaatgcttctcgtcttgccatatgccattaacaggatatgaggtatggctgggaacactgttccaaaacccacagcatggagagcccggactacagcgagtgcctgtggccaaaatgctgtgtggaccaagcggatcccagctagtgcttttgaagctggaaagaagtgtgacattgaatcagcgggtggccctgatatgcctgcctcccgagtggtatgttgtgcctccagggacaaagtgtgagatcgctggttggggcgagaccaagggaacaggcaatgataccgtccttaacgtcgctctgctgaacgtcatctctaaccaggaatgcaatattaagcacagggggcatgtgagagaaagcgagatgtgcactgaaggcctcctcgctcccgttggagcctgtgaaggcgactacgggggacccctcgcgtgcttcacacataactgctgggtactcaagggcattcgaatccctaatagagtatgcacgaggtctcgctggccagctgtctttactcgggtctcggtcttcgttgattggatccacaaagttatgcggctgggatag

SEQ ID NO: 5048 - DNA, 1101 bp, Artificial Sequence
  Description of Artificial Sequence: Synthetic coding sequence
atgagggtgatggctccgagagccttgctgctcctgttatccggcggactcgctttaaccgaaacttgggcctgcagccactcaatgcgctatttcgatacggctgtctcacgtcctggccgaggcgaacctaggtttatttccgtgggctatgttgacgatactcagtttgtgcggttcgactcggacgctgcctcacccaggggcgagccccgtgccccatgggttgagcaggagggcccagaatactgggatcgggaaactcagaagtataaacggcaagctcaggcagatcgtgtttccctccgtaacctcagggggtactacaaccagtctgaagatggctcccacaccctgcagaggatgtcagggtgcgacctgggtcccgatggtaggctgctcagaggttacgaccagtcagcatacgatggtaaagactatatcgcccttaacgaggatctacggtcctggactgccgcagataccgctgcacagattacgcagagaaagctcgaggcggcaagagccgctgagcaactcagagcgtatctggagggcacctgtgtcgaatggctgcggagatacttggagaatgggaaggaaacccttcaacgcgcagagccccctaaaacacacgtgacccatcatcccctgtccgatcatgaggctaccctgcggtgttgggccctcgggttctaccctgcagagatcactctgacgtggcagcgagatggtgaagaccagacacaggataccgaactagtcgaaactaggcctgctggtgacggcacttttcagaaatgggccgctgtcgtggttccgtcgggccaggaacagcggtacacctgtcatatgcagcacgaaggcctgcaagagcccctcaccttaagttgggagccctcaagccaacccactattcccattatgggaatcgttgcgggactggctgtgctggtcgtcctggctgtgctcggagctgtggttacagctatgatgtgcaggcgtaagtcctccgggggtaagggcggatcttgttcccaggccgcttgctccaactcagcccagggatcagatgagtctctgatcacttgtaaagcttag

SEQ ID NO: 5049 - DNA, 396 bp, Artificial Sequence
  Description of Artificial Sequence: Synthetic coding sequence
atgagagttatggcgcctcgagctctactactgctgctctctggaggactcgcattgacggaaacgtgggcttgttctcattccatgcggtacttcgatacggccgtgtcaagaccagggagaggggagccgcgtttcattagcgttggctatgtggacgatacacagtttgttaggttcgactctgatgccgcttccccaaggggcgagcccagagcgccttgggttgagcaggaagggccagagtattgggaccgagaaacacagaagtacaagcgacaggcccaggccgatagggtttctctgcgcaacctacgaggctattacaaccaatccgaggacgaagatgtgtggctgcgaccaggcgctagacgcgctccaccccctagagtctag

SEQ ID NO: 5050 - DNA, 1119 bp, Artificial Sequence
  Description of Artificial Sequence: Synthetic coding sequence
atgcgggtcatggcaccccgaaccctcattctcctgctgagtggcgcacttgccttaaccgagacttgggcttgtagccattccatgcggtatttctacacagctgtgtccagacccggtcggggagagcctaggtttatcgctgtgggttatgtcgatgatacccagttcgtgcaatttgacagtgatgctgcgtcgcccaggggagagcccagggccccttgggtggagcaagaaggaccagagtactgggatcgtgagacacagaaatacaaaagacaggcccagactgacagggtcaatctccgcaagctcagagggtattacaatcagtccgaagccggaagtcataccttacagaggatgtacggatgtgatctcgggcctgatggcagactgctccgcggatataatcaatttgcctacgacgggaaagactacatcgcactgaacgaggacctccgcagctggactgccgctgataaggcagcgcagatcactcaaagaaagtgggaggccgcaagggaagccgaacaacgaagggcctacctcgaaggaacttgtgtggagtggcttcgcaggtatttggaaaatggtaagaagacgttacaaagagctgagcatcctaaaacccacgtgacgcaccatccagtatctgaccacgaggcgacactgaggtgctgggcacttgggttttacccagccgagatcaccctgacgtggcagagggacggcgaagatcagacacaggacacagagcttgtggagacacgtcctgcaggcgatggaacatttcagaagtgggccgctgtagttgtgccaagtggggaagaacagcgctacacctgtcacgtccagcatgaaggattgccagaaccgctgacactccgttggggcccttcgtctcaacccacgatccctatagtcgggatcgtcgcagggctagccgtcctcgcagtgctcgctgtcctgggggctgtgatggccgtggtcatgtgtcgtaggaaatcttcgggccattttctccctactggaggaaaggggggttcttgctcccaggccgcttcatcaaacagtgcccagggctccgatgaaagtctcattgcttgtaaagcatag

SEQ ID NO: 5051 - DNA, 1119 bp, Artificial Sequence
  Description of Artificial Sequence: Synthetic coding sequence
atgcgagtgatggctcctcgggctctgttgctccttttatcaggaggactggccctcacggagacctgggcctgttctcatagtatgaggtatttcgacaccgcggtgagccgtccaggacggggagaaccaaggttcatctcagtggggtacgtggatgatacgcagttcgttcggtttgatagtgacgccgctagtcccagaggtgagcccagggcgccatgggttgagcaggaagggccagagtattgggaccgagagacgcagaagtacaagagacaggctcaggcagacagagtatccctacgaaacctacgcggatattataaccagagtgaagacggctcccacaccctgcagagaatgtcaggctgcgaccttgggccagacggccgactgctcagggggtatgaccagtcagcctacgacggaaaggactatatcgccctcaatgaagatctgcgaagctggacagccgcagatactgccgcacagatcacccagcgcaaattagaagccgcaagggccgcagaacagctaagagcctatcttgaggggacgtgcgttgagtggctacggagatacctcgagaacggcaaagagacgctgcagagggccgagccccctaaaactcacgtaacccatcaccccctctccgatcatgaagccacactcagatgctgggcactgggtttctaccccgctgagatcacacttacttggcaacgcgatggcgaggatcagacccaagatacagagctggtcgagaccaggcctgcaggagatggcacctttcagaaatgggcagcggtggtcgtgccaagcggccaggagcagaggtacacttgccacatgcagcacgaagggttgcaggagcccttaacactgagctgggagccgtctagccagcctacaataccgatcatggggatagtagcgggactcgccgtgctagttgtgcttgccgtcctaggcgctgtagttactgctatgatgtgccgcaggaagtcaagcggccattttctacccacaggcggaaaggggggaagctgcagtcaggcagcgtgttctaattctgcacagggcagtgacgaatctctgataacctgtaaagcatag

SEQ ID NO: 5052 - DNA, 1194 bp, Artificial Sequence
  Description of Artificial Sequence: Synthetic coding sequence
atgagagttatggcccctcgcactctcatcctcttactcagcggcgcattggcactgaccgagacttgggcctgcagtcacagtatgcgctacttttacacggcagtgtcgcgtccaggaagaggtgagcccagatttattgcagtcgggtacgtagatgacactcagttcgtgcagttcgacagcgatgcagcctctccgaggggagagcccagagccccatgggtcgagcaggaggggccagaatattgggatagagagactcaaaagtataagaggcaagctcagacagaccgagtcaacttgcggaaattgagagggtattacaaccagtccgaagctggatcccacacactccaacgaatgtacgggtgcgacctgggtcccgacgggagactgctaagaggatataaccaattcgcgtatgacggtaaagattacatcgccctgaatgaagatcttaggtcctggacggctgctgataaagctgctcagattacacagagaaagtgggaagctgccagggaagcagagcaaaggcgggcatatctcgagggtacatgcgtggagtggttaaggcgttacttggaaaatgggaagaagaccctccagagggcagagcaccctaaaacacacgtcactcatcatcccgtgtccgaccacgaagcgacactgcgctgctgggcactcgggttttatcctgccgaaatcactctgacctggcagagagatggcgaggaccagacccaggacacagaactggtggagacccgtccggctggagacggcacctttcagaagtgggctgctgtggtggtgccaagcggcgaagaacaaagatacacctgtcatgttcagcatgaaggtctgcctgagccgctaacactgaggtgggggccttcaagccagcctactattcccatcgtgggcatcgtagccggtctagccgtgctggcagtcttagctgtgcttggagctgtcatggccgtggtgatgtgtcggagaaagtcttctggtagggagggcgtgcggagcggagtctggccagccacagtgcctcgcgcactaatgtccctgtcgtccctggtgaagcctgagaccgccgcttgtgttggccttcggtgtcggatctctagccacctcagttttgtgacctctcgagcaagcggaatcagcttctgtaagggcatttag

SEQ ID NO: 5053 - DNA, 1119 bp, Artificial Sequence
  Description of Artificial Sequence: Synthetic coding sequence
atgcgggttatggcacccaggacgctgattctgctgctatctggggcactcgcactcaccgaaacttgggcctgtagccactccatgcggtacttttataccgcagtctcccgccctgggaggggggagcctcggttcattgccgtgggatacgtggatgatacccagttcgtccagttcgactcagacgctgcttctccccgaggagagccacgcgctccttgggtggagcaagaagggccagaatactgggaccgggagacacagaagtacaaaagacaggctcagactgacagggttaacttgagaaagctaaggggatattacaaccaaagcgaagcagggagccataccttacaaaggatgtacggctgtgacttggggcctgatggccgactgctacggggatataatcagttcgcatatgatggtaaagattacatagctctgaatgaggacctcagaagctggaccgctgcggataaggcagcacagatcacacaaaggaaatgggaagcggctagagaagcagaacagagaagagcttacctggagggtacttgtgttgagtggctgcgaaggtacctggagaatgggaaaaaaactctgcagcgtgctgaacatcccaagacacatgtcacccaccatcccgtttctgatcacgaggcgacactgcggtgctgggctcttggtttttatcccgcagagataactttgacctggcagagagatggagaagaccagacacaggatactgagctggtggagacaaggcccgcaggagacggcacgtttcagaagtgggctgctgtagtggtacccagcggcgaggaacagaggtacacctgccatgttcagcacgaaggcctcccagaaccactgacactcaggtggggaccgtcttctcaaccaactatcccaattgtgggcattgtggccggactggccgtgttagctgtgctggcagtcctgggagccgtgatggccgtggtcatgtgtcggagaaagagctcggggcacttcctgcccactggaggcaaaggcggtagctgttctcaggctgcctcctccaattccgctcagggaagtgatgagtccttgatagcttgcaaggcgtag

SEQ ID NO: 5054 - DNA, 1194 bp, Artificial Sequence
  Description of Artificial Sequence: Synthetic coding sequence
atgagagtgatggctccaagggccctactgctgctcctgagcggagggttggccttaactgaaacctgggcctgctcccattctatgcgctattttgacactgcggtcagtcgtcccggaaggggtgagccgaggtttatcagtgtggggtatgttgacgatacacaatttgttagatttgactccgacgccgctagcccaagaggggaacctagggctccttgggtggagcaggaaggacccgagtactgggatagggagacccagaagtacaaacggcaggctcaagctgacagggtcagcctgcgtaatcttcgaggctactacaatcagagcgaagatggaagccataccctgcagcgtatgtccgggtgcgatctgggaccagacggccgtctcctgcggggatacgatcagtcagcttacgatggaaaagactatattgccctaaatgaagatctgcgcagctggaccgccgcagataccgcagctcagatcacccagaggaagctggaggcagcgcgtgccgctgagcaactgcgcgcttatctggagggcacttgtgttgaatggcttaggcgctacctagagaatggcaaggaaacattacagcgcgctgaacctccgaagacacacgttacgcaccatccgctgtctgatcatgaggctacgctgagatgctgggccctgggcttctatcccgctgaaatcactctaacctggcagagggacggagaggaccagacccaggatacagagttggtagaaacccgtccggcaggcgatgggacattccaaaagtgggccgctgtggtggtgcccagcggacaggaacagagatacacctgtcatatgcaacacgaggggctccaagagcccctgactttgtcctgggaaccctcatctcagcctactatccccatcatgggcattgtggcgggattggcggttctggttgtgctcgcagtcttgggcgcagtcgtgacagccatgatgtgtcgacgcaagagtagcggaagagaaggagtgaagagcggggtgtgggccgctaccgttcctcgcgcactgatgagtcttagtagtctagtgaaacccgaaacggccgcttgtgtcgggttacgctgccgcatcagctcacacctgtcttttgtgacctcaagggcgtctggaattagtttctgcaagggcacctag

SEQ ID NO: 5055 - DNA, 1101 bp, Artificial Sequence
  Description of Artificial Sequence: Synthetic coding sequence
atgcgggttatggctcccagaacactcatactactgctgagcggcgcactggctcttacggagacatgggcttgcagtcactctatgaggtacttttataccgcagtcagtcgacccggaagaggcgagcctcgtttcatagccgttgggtacgtcgatgacacgcagttcgtacagtttgacagtgacgccgcaagtccgaggggcgagcctagagcaccctgggtcgaacaggaggggccagagtattgggacagggaaacgcagaaatataaaaggcaagcccagacagacagagttaaccttagaaagttaaggggttactataaccagtcagaggccggtagccatacgctgcagagaatgtatggctgcgacctcggccctgatggcaggctcttacgcggatataaccaattcgcgtacgatgggaaagattacatcgctctgaatgaagacctgaggtcctggactgccgctgacaaagccgctcagattacacaaaggaaatgggaggcagccagagaggcagagcagcggagggcttacctggaggggacctgcgtggagtggctaaggcggtacctcgaaaacggcaaaaaaacgctacagagggcggagcacccaaagacccacgtaacccatcaccccgtctctgaccatgaggctacccttcgttgctgggccctgggcttctaccctgccgagataacactaacctggcagagagatggcgaggatcagacacaggataccgagcttgtggagaccaggccagccggtgacggcacattccaaaaatgggccgcagttgtcgtcccgtccggggaggaacagcggtatacctgccacgtccagcatgaagggcttcccgagcccttgacactgaggtggggaccctcctcacagcccacgattcccatagtggggattgtggccggtctcgccgtcctggcagtgttggcagtcctgggagctgtcatggctgtagtaatgtgcagaaggaagtcttcaggtgggaaaggcggttcctgtagtcaggccgcttcatctaattccgcgcagggctctgacgagtccctcatcgcctgtaaagcttag

SEQ ID NO: 5056 - DNA, 1101 bp, Artificial Sequence
  Description of Artificial Sequence: Synthetic coding sequence
atgagagtgatggctccaagaacgctgatcttgctgctttccggggcactggcactgaccgaaacctgggcgtgtagccattcgatgcggtatttttacacggcagtctctcgtcctggcaggggagaaccaaggttcattgcagtcgggtacgtggacgatacccaattcgtgcaatttgactccgatgccgcatcaccacgaggcgagccgagggccccttgggttgagcaggaaggaccagaatattgggatcgcgagacgcaaaaatacaagaggcaggcccagacggatcgagttaacctgagaaaactccgtggctactataatcaaagcgaggctggaagtcatactctccagaggatgtacggctgtgatttaggacctgacggccgactgttgcgaggctacaaccagtttgcctacgatggtaaggattacatcgcattaaacgaggatctccggtcctggacagcagcagataaggctgcccagatcacacagcgcaagtgggaagctgcaagagaggccgaacaaagaagggcctacctggaggggacatgtgttgaatggctcagacgctacctggagaatgggaaaaagaccctgcagagggctgaacacccaaaaacacacgtcactcaccatcctgtgtccgaccacgaagctactctaaggtgctgggcacttggattttaccccgcagaaatcacgctcacctggcagagagatggggaagaccagacacaagacaccgagctggttgagacacggcctgccggagacggcacttttcagaagtgggcagcggttgtagtgcccagcggcgaggagcaacgatatacttgtcacgtgcagcacgaggggctccccgagcccttaaccctgcgctgggggcctagtagtcagcctacgatcccgatagtcgggatcgtggccggactggcagtgctcgccgttctggctgttctcggtgccgttatggcagtcgtaatgtgtcgtagaaaatcatcaggaggaaagggcggtagctgcagtcaggccgcttcctcaaactccgcccagggcagcgacgaatcacttattgcttgtaaggcctag

SEQ ID NO: 5057 - DNA, 1194 bp, Artificial Sequence
  Description of Artificial Sequence: Synthetic coding sequence
atgagggttatggccccacgcactctgatactgctgctttccggggctctggcattgaccgagacttgggcatgtagccatagcatgagatacttttacactgcagttagtcggcctggcaggggagaaccgcgattcattgcagtcggctacgtcgatgatacacagttcgtccaattcgattcagacgcagcctcccccagaggagagcctcgtgccccatgggtggagcaggagggtcccgaatattgggacagagagactcagaagtacaagcgacaggcccagacagacagagtcaatctgagaaagctacgcggatattataatcaaagcgaagccggatctcacacactgcagcgcatgtatggatgtgacctgggaccggacggcaggcttttaaggggctataaccaattcgcctatgacggcaaggattacatcgctttgaatgaggatctgcgatcatggacagccgctgacaaggccgctcaaattacacaaagaaaatgggaagcagctagggaggcagagcaacgcagagcatatctggaaggcacatgtgtggaatggctgaggagatacctggagaatggtaagaagactctgcaacgcgcagagcaccctaagacgcatgttacccaccatcctgtgtccgaccacgaggcgacattaaggtgttgggcgctcgggttctaccctgctgaaattacactgacatggcagagggacggtgaggatcagacacaagacacggagctcgtcgagacccgacccgcaggagatgggactttccagaagtgggctgctgtagtggtcccctctggcgaggaacagagatatacctgccatgtccagcatgaaggcttaccggaaccactgacactaagatggggacctagcagtcagcctactattccaatcgttggcatagtcgctggcctggccgtgctggcagtgctggccgtactgggggcagtaatggccgtagtgatgtgtagacggaaatccagtgggagggaaggggttcgatccggagtgtggccagcaactgtgcctcgggctctcatgtccctgagcagcctggtcaagcccgaaaccgccgcatgtgtggggttgagatgcagaatctcgtcccacctgtccttcgttacatctagggcatcaggcattagcttttgtaagggaatctag

SEQ ID NO: 5058 - DNA, 1194 bp, Artificial Sequence
  Description of Artificial Sequence: Synthetic coding sequence
atgagggtgatggctcccagaaccttgattctgcttctttccggcgcattggccctaacagagacctgggcctgttcccactctatgaggtacttctataccgctgtgagccgaccaggccgtggggagccccgtttcatagccgtcggatatgtcgatgacacccagtttgtgcggtttgactcagacgctgccagcccacgaggagaacctcgcgcaccctgggtggagcaggaagggccagagtactgggatagggagacccagaagtataaaaggcaagcccaaacggatcgtgtgagcctgaggaacctgcgaggctactataatcagtcagaagccggatctcacacccttcagtggatgtacggctgcgatcttggacctgacggtcgactcctgcgcggatatgaccagtcagcatacgacgggaaagactacattgcgctgaacgaggatctgcgttcctggaccgctgccgataccgcggctcagatcacacagcggaagtgggaagccgctagggctgccgaacagcaaagggcctatcttgaaggaacctgtgtggagtggttgcgaagatatttggaaaacggcaaagagaccctccagagggcagagcacccaaagacacatgtgacacatcacctggtcagcgatcacgaggctactctgcgttgctgggctctgggattctacccggctgagataacactcacatggcaaagggatggagaggaccagacacaggataccgagttagtcgaaaccaggccagctggtgacggaacattccaaaagtgggccgcagtggtcgttcctagcggagaggagcagcgctacacatgccacgttcagcacgagggcctgccagagccgcttacactaaggtgggagccgtcgagtcaaccaacgatccccatcgtaggaatcgtggccggtctggccgtgctcgctgtgcttgccgtgctaggagccgttgtagccgttgtgatgtgtcggaggaaaagttccggaagagaaggcgtgcggagcggagtatggcccgctactgtcccacgcgctttaatgtcattgtctagcctggtcaagcctgagaccgccgcatgtgtggggttgaggtgtcggatctcaagtcatcttagcttcgtgacaagtagagcctctgggatctcattttgtaagggaatctag

SEQ ID NO: 5059 - DNA, 786 bp, Artificial Sequence
  Description of Artificial Sequence: Synthetic coding sequence
taacgggtcatggcccctcgcgctttgctactgttactgtcagggggactcgctctgaccgaaacctgggcgtgtagccactctatgagatatttcgatactgccgtctcaagaccaggtaggggcgagcctcggtttatttccgtgggatacgtagatgatacccaatttgtccgcttcgacagcgacgcggctagcccaagaggcgaaccccgagccccatgggtggaacaggaagggccagaatattgggaccgcgagacccagaaatacaagcggcaggcccaggcagatagggtctcactccgcaatctgcgtggctactacaatcagtctgaagatggatctcacaccctccagcgtatgtcaggatgtgatttagggccagatggtcgcctgcttagaggttatgaccagagcgcttatgatggaaaagactacatcgctctgaatgaggatctccgatcttggactgctgccgataccgcggcacaaataactcagcgcaaacttgaggccgcacgcgctgccgaacaattgcgagcctacctcgagggcacctgcgttgaatggcttagacgctatttggagaatgggaaggaaacgctccagcgggcagagccacctaaaacacatgtcacgcaccatcctctcagtgatcacgaagcttcaaggcgctggaacctccctgaagtcggtagctgcggcggtgccttctggactagagctgaaatccacgtaccctacgctgcacgaggggcagccagagccccacacccagaatag

SEQ ID NO: 5060 - DNA, 1119 bp, Artificial Sequence
  Description of Artificial Sequence: Synthetic coding sequence
atgcgtgttatggcccctcgtacgttgatcctgctgttgagtggtgcacttgccctcactgaaacctgggcgggttcccattcaatgcgttacttttatacagcggtgtctcgtcccggtaggggcgagccccacttcatcgccgtcggctacgtagatgacacccagttcgtccgcttcgatagcgacgcagcatctcccaggggtgagccccgagccccttgggtcgaacaggaaggcccagaatattgggatagagagacccagaagtacaagcgccaggcccagacggatcgcgtttccttgcggaacctgcggggatattataatcagagcgaggccggaagtcacattattcagaggatgtatggttgcgatgttggacctgatggccgattgcttcggggatacgaccagtacgcctacgacgggaaagactacatcgcactcaatgaggacttacgttcatggacagctgccgacactgccgcacaaatcactcagcgcaagtgggaggccgctcgggaagccgagcaacttagggcgtacttagaaggattgtgcgtggagtggctgagacgctatctgaagaacggcaaggagacactccagagggccgaacatcccaagacccacgtgactcaccaccccgtttccgaccacgaggccacactcaggtgctgggcccttggattctatccagccgagatcacactcacttggcagtgggatggtgaagatcaaactcaggatactgaactcgtggagacccggcctgccggagacgggacattccagaagtgggcggctgtcgtagtgccctccggggaggaacagagatatacctgtcacgtccagcatgagggcctgcctgaacctctgacacttcggtgggaaccttcttctcaacccaccattccgatagtggggatcgtggccggacttgccgtcctcgctgtgcttgccgttctgggcgcagtcgtggccgtggtgatgtgtcgtcgaaagagctctgggcactttcttccaaccggtgggaaggggggtagttgcagccaggctgcctcaagcaactctgcacagggttccgacgaatcactgatcgcctgtaaggcttag

SEQ ID NO: 5061 - DNA, 1020 bp, Artificial Sequence
  Description of Artificial Sequence: Synthetic coding sequence
atgagggtcatggctcccagaaccctgatcctgctcctcagcggcgctcttgccttaacagaaacatgggcctgttctcactctatgagatatttctatacggctgttagcaggcctggtagaggcgagcccaggtttatagccgtgggctatgtcgacgatactcagttcgtgagatttgactccgacgccgcatccccaaggggggaacctcgggcaccctgggtggaacaggaagggcctgagtattgggaccgggaaacccagaaatacaaaaggcaagcacagactgaccgtgtatcccttaggaatctgcgcggttattataaccagagtgaagcaggctcccataccctgcagtggatgtacggttgcgacctcggtcctgatggtagactcttgaggggatatgatcagagtgcctatgatgggaaggattacatagctctgaacgaggacttacgcagttggacggcagccgacaccgccgctcagattacgcagagaaagtgggaggctgccagggccgctgagcagcagcgagcatatctggagggtacatgtgtggaatggctgcgcagataccttgagaacggaaaagaaacattgcagagggcagagcatcctaagactcacgtcacccaccatttggttagcgaccacgaagctaccctacgatgctgggcccttggcttttatccagccgagattacgctgacatggcaacgcgacggcgaagatcagacccaagacaccgaattggtggagactcgcccagccggagatggtacctttcagaaatgggcggctgtcgtcgtcccgagcggggaggagcagaggtatacctgtcacgtacagcatgaaggtttgcccgagcctctgacccttcggtgggaaccctcatcgcaaccgacgattcccattgtaggtatcgtcgccggactagccgtactagcagtcctggctgtgcttggcgctgttgtggcagtggtaatgtgccgtaggaaaagctccgcttag

SEQ ID NO: 5062 - DNA, 1101 bp, Artificial Sequence
  Description of Artificial Sequence: Synthetic coding sequence
atgcgggtgatggcccctcgcacgcttatactcctgctctcgggagcactggcactgaccgaaacctgggcctgctcccactctatgcgttatttcgacacagctgtctcacgccctgggaggggcgagcctcgctttatatcagtggggtacgtcgatgatactcagttcgtgaggttcgacagcgatgcagcctctccacgcggtgaacccagggcgccttgggttgagcaggaggggccagagtattgggaccgagaaactcagaaatataagcgacaagctcaggccgaccgcgtaaatctccgcaaacttaggggctactataatcagagtgaggacggaagtcacaccctgcagtggatgtatgggtgcgacttgggccctgacgggcgactcctgaggggatatgaccagagcgcatacgacgggaaggactacatagcacttaatgaagatctacgctcatggaccgccgcagacactgctgcccaaattacccaaaggaagtgggaggccgcacgggaagcagagcaatggcgcgcatacttagaagggacctgcgtcgaatggttaaggaggtacctcgagaacggcaaggagacactgcagcgcgcagagcacccaaaaacccatgttacccatcatcctgtgagcgaccacgaagccactctgagatgctgggcactcggcttttacccagcggaaattaccctgacctggcagagagatggtgaagatcagacacaggacacagagttggtagaaacccggccagctggggatggaaccttccagaaatgggccgctgtggtcgtaccatcaggggaggaacagcgctacacttgccatgtacagcacgaaggcctacccgaacctctgacactcagatgggaacccagctcgcagcctacgattccgatagttggtatcgtggccggattggccgtgctcgccgtgctggctgtcctgggtgctgtgatggcagtagtgatgtgcagaaggaagtcctctggcggaaaagggggttcttgctcccaagccgcatcgtccaattcggcacaagggtcagatgagtcactgattgcgtgtaaagcctag

SEQ ID NO: 5063 - DNA, 1107 bp, Artificial Sequence
  Description of Artificial Sequence: Synthetic coding sequence
atgagggttatggcacctcgagcccttttgttgctgctttcaggcggtctagccttgacagagacttgggcctgctcacactcaatgagatacttcgataccgcagtgtctcggcctgggaggggggagcccaggttcatatctgtaggctacgtcgacgatactcagttcgtccgatttgattccgatgccgcatctccaaggggcgaaccacgcgcaccttgggtcgaacaggagggccctgaatattgggaccgagaaacccagaattacaaaaggcaggctcaagcagaccgcgtgagcttacgtaacctccgaggctactataatcagtcagaagacggatcccacacccttcagagaatgtatgggtgtgatcttggccctgatggcagattgttacggggttacgatcaaagtgcctacgatggcaaggattatatcgcactaaacgaggatctcagatcatggactgcagctgataccgctgcccagatcacacagcggaagctggaagcagcacgtgctgctgagcagttgcgcgcttatctagagggaacctgtgtggagtggctacgtaggtacctcgagaatggcaaggaaacgctgcagcgcgcagagccaccgaaaacacacgtgacacaccacccattgagcgatcatgaggcaactcttagatgctgggcgcttggtttttaccccgcagaaatcacactcacgtggcagagggacggcgaagaccagacccaggacacggagctggtcgagacacgtccggctggagacggtacgttccagaaatgggctgccgtagttgttccgtcaggtcaggagcagcggtacacctgtcatatgcagcatgaaggtcttcaagagcccttgaccctgtcgtgggaacccagcagccaaccaaccatacctattatgggtattgtggcagggctggcagtcctggttgtactcgcagtactgggggctgttgtcacagccatgatgtgcagaagaaagagttccgcagcttgtgtggggcttagatgtcgcatctctagccacctgagctttgtaacctcacgggcatccggcattagcttctgcaagggagtgtag

SEQ ID NO: 5064 - DNA, 1194 bp, Artificial Sequence
  Description of Artificial Sequence: Synthetic coding sequence
atgagagttatggcccctcgtacccttatcttactgctatccggcgcattagctctgaccgaaacatgggcatgctcacacagcatgagatattttgatacagcggtgtcgaggcctggccgaggagagccacgtttcatatccgtgggctacgtggatgatacgcagttcgtccgattcgattccgatgcagctagtcctcgcggagaacctagggcaccttgggtcgaacaggagggccctgaatattgggatcgggaaacccagaagtacaagcgccaggctcaagccgacagggtcaacctgcgcaagttgcgagggtactacaatcagtctgaagacgggtcacacaccttgcagtggatgtacggatgcgacctaggtccagatggacgcctgctgcggggttatgaccagtccgcctacgacggaaaggattacatcgccctgaatgaggacctgaggtcctggaccgccgcagacacagccgctcagatcacacaaaggaaatgggaggccgctagagaggccgagcagtggagagcctacctggaggggacgtgtgtggagtggctgcggaggtatttggagaatggcaaagagaccttacagagggccgagcacccaaagacccatgtcacccaccaccctgtgtcagaccatgaggccactctgagatgctgggcgctgggattttaccctgctgagatcactttaacctggcagagagatggtgaggatcagactcaagataccgaacttgtagagactcgacctgctggggacgggacattccagaaatgggccgctgtggtcgtgccttccggggaggagcagcgttacacctgtcatgtgcagcacgagggacttcccgaacccctgacactgaggtgggagcctagcagtcagccaacaatcccaatagtcggtatcgttgccggactcgcagttctggccgtcttggctgtgctgggggctgtcatggccgtggttatgtgccgacgtaagtcctccggcagagagggcgtgagatccggcgtctggcccgcaactgtgcctagagccctcatgtccctgagctctttagtgaagcccgaaacagccgcatgtgtcgggctgcggtgccggattagcagccacctctcgtttgtgaccagccgcgctagcggaatctcattctgcaaaggcatatag

SEQ ID NO: 5065 - DNA, 1119 bp, Artificial Sequence
  Description of Artificial Sequence: Synthetic coding sequence
atgcgagtaatggcacccagagcgctgttgctgctgttaagcgggggtctagccctgacagagacatgggcatgttcacactcgatgcgctattttgacaccgctgtctctaggcctgggcgaggagagcctcgatttatctccgtgggatacgtggatgacactcagttcgtccggttcgactctgacgcggctagccccaggggagagcccagagcaccctgggtagagcaggaaggcccagagtactgggatcgggaaactcaaaattataagcggcaggcccaggcagaccgcgtctctctccgtaacctgagaggctactacaatcagagtgaggatggatcgcacaccctccagaggatgtatgggtgtgacctgggaccagacggcagactgttgagaggatacgatcagtctgcctatgatggtaaggattatatcgccttaaacgaggaccttaggtcatggaccgcagctgatactgcagcgcaaatcactcagagaaagctggaggcagctcgtgccgcagagcagctgcgagcctacctggagggcacatgtgtagaatggctacgaagatatttagagaatggaaaagagacgttgcaacgcgctgaacccccaaagacacacgtcacccatcacccactgtctgatcacgaagctacactacgatgctgggctttggggttttaccccgctgagattaccctgacatggcagcgcgacggggaagatcaaacacaggatacagagctcgtggagacccgcccagccggtgacggaacattccagaaatgggccgcagtggtagtccccagtggccaagagcagcgctacacatgccatatgcaacacgaagggctgcaggagccgcttactctgagctgggagcccagctcacaacctacaatccccattatgggaatcgtagccggtctcgctgtgctagtcgtcctcgcggttctgggcgcagtggtaaccgctatgatgtgtaggaggaagtcgtcggggcattttctgcccaccggcggaaaaggaggaagctgcagtcaggcggcttgtagcaactcagctcagggctccgatgagtcactcatcacgtgcaaggcctag

SEQ ID NO: 5066 - DNA, 1101 bp, Artificial Sequence
  Description of Artificial Sequence: Synthetic coding sequence
atgcgcgttatggcacccagggcactcctgcttcttctgtctggcggactcgctctgactgaaacctgggcctgctcgcactccatgcggtattttgacaccgctgtgagtaggcccggacggggtgaaccacggttcatttcagtcgggtacgtggacgatacacagttcgttcggtttgacagtgacgctgcatcccctagaggagagccgagagctccgtgggtggagcaagagggccctgaatactgggaccgggaaacacagaactacaaaagacaggcccaggccgatagggtctctctacgcaacctgcgaggttattacaatcagagcgaagacggatcgcacactctccaaaggatgtatggctgcgacctcggacctgacgggagactgctgagaggctacgaccagagcgcctatgatgggaaggactacatagcgctcaacgaggatctacgctcttggaccgccgcagacactgctgcacagatcacccaaaggaaactggaagccgctcgagccgcagagcaactgcgtgcctacctcgaggggacatgtgtcgagtggctccgcaggtatttagaaaatggtaaggaaacccttcagagagccgagccccctaaaacccatgtgactcaccacccgttgtccgaccatgaggccacactcaggtgttgggctctagggttctaccccgctgagatcacattgacctggcaaagggacggggaggaccagacccaagatacggaacttgtggagaccaggcccgcaggtgacggcacatttcagaaatgggccgctgtggttgtacctagtggtcaggaacaacgctacacgtgccatatgcagcacgagggcctccaggagcctctgaccttatcatgggaaccctcatctcagccaacaatacccattatgggaatcgtggcgggtttggctgttctggtggttctggcagtgcttggcgcagtggtcaccgcaatgatgtgccgccgaaagagcagcgggggaaaaggcggtagctgttctcaggccgcttgtagtaacagtgcccagggctccgacgagagcttaattacctgtaaggcctag

SEQ ID NO: 5067 - DNA, 1107 bp, Artificial Sequence
  Description of Artificial Sequence: Synthetic coding sequence
atgcgagtcatggcaccaaggacactgatattgttactgagcggagctctggccctcaccgaaacgtgggccggtagtcacagcatgcgttacttttatactgctgtaagccgacccggacgtggggaaccccattttatagctgtgggctatgtcgatgatacccaatttgtgcggtttgatagcgacgccgctagtccgaggggcgaaccaagggccccttgggtcgaacaggaaggaccagaatactgggacagagaaacccagaagtacaagaggcaggcacagaccgatcgggtgtccttacgcaatttaaggggctattacaaccagtccgaggctggaagtcatattatccaaagaatgtacggctgcgacgtcggccctgacggacgccttctgcgcggttatgatcagtatgcctacgacggcaaagactacatcgcgctcaacgaggatcttcggtcatggacggcagctgacacggctgctcagatcactcaacgcaaatgggaagccgctcgagaagccgagcaactgagggcttatttggaagggctgtgcgttgagtggttgcgacgatacctgaaaaatggaaaagaaacccttcaacgagcagagcatcctaaaacacatgtaactcaccaccccgtatcagatcacgaagccactctgcggtgctgggcactgggcttttacccagccgaaattaccctgacttggcagtgggacggggaagatcagacacaggataccgaattggtggaaacaaggccagcgggagatggaacatttcagaagtgggctgcggtggttgtgccgagcggggaggaacagagatacacctgccacgtccagcacgaaggattaccagagccgcttaccttgcggtgggagccgtcaagccagccgactatacccattgttggtatagtggcgggattggctgtgctcgcagtcctcgccgtgctgggtgccgtggtggctgtagtcatgtgcagacgcaaaagctctgcagcctgcgtgggactgaggtgtcggatcagctcccacctgtcctttgtgacttccagagcctctggtatatccttttgtaaaggaatctag

SEQ ID NO: 5068 - DNA, 1194 bp, Artificial Sequence
  Description of Artificial Sequence: Synthetic coding sequence
atgcgagtcatggctccacgggcactcctcctgctgctgtccgggggtttggctctgacagaaacttgggcatgcagtcatagcatgcggtatttcgatacagcagtgtcacggcctggaaggggggagcctcgcttcatttccgtcggctacgtcgatgacacacaattcgtgcgattcgactccgacgcggctagccctcgcggtgagcccagggctccctgggtcgagcaggaagggcctgaatattgggaccgcgaaacccaaaactataagagacaggcacaagccgacagggtaagcttgcggaatctgagaggttactataatcagtctgaagacgggtcccatactctccagcgcatgtacggttgtgatctggggccagacggtagactgcttaggggatacgaccaaagcgcgtatgacggcaaggactacatcgctcttaatgaggacttgagatcctggacagcagctgatacagcagcgcaaatcacacagcgcaagttggaggccgctcgagccgctgagcagttgcgcgcatatttggaggggacgtgtgtggagtggttgaggagatatctcgagaatggcaaggaaaccctacagcgcgcagagccgcctaaaacccacgtgactcaccatcccctgagtgatcatgaggccacgcttcggtgctgggcactcggattctatccagccgagataaccttaacttggcagagggacggtgaggaccaaacccaggacacggaattagtcgagacaaggccggctggcgacgggacatttcaaaaatgggcggctgtagtggttccatcagggcaagagcaacgatacacgtgtcacatgcaacacgagggcctgcaggagcccctcacgctgtcatgggagcctagctcccaacccaccattcctattatgggcatcgtcgcgggtctggcggtgcttgtggtgcttgcggtcctaggcgctgtggttaccgctatgatgtgtcgacgcaagagctctggtagagagggcgtgaaaagtggcgtttgggcagccaccgtcccacgggctctcatgtccctgagtagtcttgtcaagccggagactgctgcgtgtgtaggtcttaggtgcaggatcagttcacatctgagtttcgttactagcagggctagcggcatcagcttttgcaagggagtctag

SEQ ID NO: 5069 - DNA, 1068 bp, Artificial Sequence
  Description of Artificial Sequence: Synthetic coding sequence
atgagggtgatggctccacgaaccctgattctgctgttaagcggggctctggcccttaccgagacctgggcgggaagtcatagtatgaggtacttttataccgccgtgtcccgacctggacggggagagccgcacttcatcgccgtgggatacgtcgatgacacacagttcgtccggttcgactcagacgccgcaagccctagaggtgaacctcgagccccatgggtggagcaagagggccctgaatactgggatcgggagacacaaaaatacaagagacaggctcagacagatcgcgtgtcccttaggaacctgcgcggatattataatcagtctgaggctggttctcatatcatccagcgcatgtatggctgtgacgtgggtcctgacggacggctcctcaggggatacgaccaatatgcctacgatggaaaggactacatcgcccttaacgaggatctgcgctcctggaccgccgctgataccgctgcacagatcacacaacggaagtgggaagcagctagggaggccgagcagcttagggcttacctcgaaggactgtgcgtggaatggctccgacgctatctaaagaacggaaaggagacccttcaacgggctgaacatcccaagacccacgtcacgcaccacccagtctccgaccacgaggcaacattaaggtgttgggccttgggtttctatcccgcagaaatcacgctcacctggcagtgggacggagaggaccaaacccaggacactgaattggtggagactcgcccagcaggtgatgggaccttccaaaagtgggccgcagttgtcgtcccctcaggtgaagaacaacgttatacttgtcacgtccaacacgagggccttcccgaacctttgactctgcggtgggagccgagctctcagcccactataccgattgtgggaattgtggccggactggccgtcctcgccgtgctagcggttctgggggctgtcgtggccgtcgtaatgtgtaggcggaagagctcagcctcgaattctgcacaaggaagcgatgaatccctgatcgcgtgtaaggcctag

SEQ ID NO: 5070 - DNA, 1107 bp, Artificial Sequence
  Description of Artificial Sequence: Synthetic coding sequence
atgcgcgtcatggctccacgaaccttgatattgttgctgagcggagctctggctctgactgagacttgggcatgcagccactcaatgcgatacttttacacagccgtctcgcgccctggacgtggagagccccgtttcattgccgtaggatatgtggacgatactcagttcgtgcaattcgattctgacgctgcttctccccgaggggagccgagggccccttgggtcgaacaggaggggcctgaatattgggacagggaaacccagaaatacaagaggcaggctcagaccgatagagtcaacctgcgaaaactccggggatactataatcagagtgaagcgggatcccacactcttcagaggatgtatggatgtgacctgggccctgacggcagactgttacggggttacaaccaatttgcttatgatgggaaggattatatcgcgcttaatgaggatctgcggagctggaccgccgctgacaaagctgctcaaatcactcagagaaaatgggaggccgcaagggaagcagaacaacggagggcctatctggaaggcacttgtgttgagtggcttcgacgctatttagaaaacgggaaaaagactttacagcgcgctgagcaccccaagacccatgttacccaccatccagtatccgatcatgaagctacattgcgctgctgggctcttgggttctatcccgctgaaattaccttgacctggcaaagagatggtgaagatcagacccaggatactgagctcgttgaaactcgcccagccggtgacggcaccttccagaagtgggcggctgtagtggtgccgtccggggaagagcaacgctacacctgccacgttcagcatgaaggccttcctgagcccctgaccctgaggtggggcccaagttcccagccgaccattcccatcgtcgggatcgtggcagggttggccgttcttgccgttctggccgttctgggcgctgttatggcggtcgtaatgtgtcggagaaagtccagcgccgcttgcgttgggttaagatgccgtatctcgagtcacctgagcttcgtgacctcccgagcgtcaggcatttctttctgtaaaggtatctag

SEQ ID NO: 5071 - DNA, 786 bp, Artificial Sequence
  Description of Artificial Sequence: Synthetic coding sequence
tagcgagtgatggctcctaggaccttaattttactgttatctggggcactggcgttgacggagacatgggcctgtagtcatagcatgcgctacttttacacagcagtgtcgcggcctggcaggggagaacccaggttcattgctgtcggttacgtggacgatacccagttcgtcaggtttgactctgacgctgcctcccccaggggggaacccagagctccctgggtcgaacaggagggcccagagtactgggatcgggaaacacagaagtacaaacggcaggcccaaaccgaccgggtcagcctgcgaaacctccggggatactataatcagtcagaagccggatcccataccctgcagtggatgtacggctgtgacctgggtcccgatgggcgacttctgagaggttacgatcaaagcgcttatgacggtaaggactatatagccctgaatgaggacctgcggtcctggaccgccgcagatacagccgctcagataacgcagaggaaatgggaagccgctagagctgctgagcaacagcgagcctacctggagggaacgtgcgttgagtggctaaggcgctatctagaaaacggcaaggaaactctgcagcgagctgaacaccctaaaacccatgtgacccaccatctagtgtctgaccatgaggcaagcagaagatggaatttgcccgaagtgggctcttgcggcggtgctttctggcgacgagccgaaatccacgtcccttgtgccgctagaggcgctgccggagccccacatccagagtag

SEQ ID NO: 5072 - DNA, 1101 bp, Artificial Sequence
  Description of Artificial Sequence: Synthetic coding sequence
atgagggtcatggcaccccgaaccttgattctgctactcagcggcgctctggcgctcacagaaacatgggcctgttcacactctatgaggtatttctatacagccgtctcacggcctggacgcggtgaacccagatttatcgccgtgggctacgtagacgatacccagttcgtcagattcgacagcgatgccgcaagcccacgtggggagcccagggctccatgggtcgaacaggaagggcctgagtactgggacagggagactcagaaatataagagacaggcacagactgacagggtcagcctacggaacttaagggggtattacaaccaaagtgaagcaggaagtcacaccctacagtggatgtacggatgcgacctaggaccggatgggagacttctgcgtggttatgatcagtctgcatacgatggcaaagattacatcgccttaaatgaggacctgaggtcgtggactgccgcagataccgcggcacaaatcacccagcggaaatgggaggccgcacgagcagctgaacagcaacgagcgtacctggaaggtacatgtgttgagtggctacgtagatacctcgaaaacggcaaggaaactctgcaaagagccgagcacccaaaaactcacgtgactcaccatctggttagcgaccacgaggctaccctccgctgctgggcccttgggttctatcccgctgaaattactttgacctggcaaagggacggagaagaccagactcaagatactgagctggtggagaccagacccgctggagacggcaccttccagaagtgggccgctgtggttgtgcccagcggcgaagagcaaaggtacacctgccacgtgcaacacgagggtttgcccgaaccactgacactgcggtgggaaccctcaagccaacctaccattcctattgtaggcatcgttgcaggacttgccgttctggccgtgcttgcggtgctgggggctgttgttgccgttgtgatgtgtagaaggaagtcatccgggggtaaagggggttcttgcagtcaggctgccagcagcaacagtgctcaaggatcagacgagagtctgatcgcctgtaaagcttag

SEQ ID NO: 5073 - DNA, 786 bp, Artificial Sequence
  Description of Artificial Sequence: Synthetic coding sequence
taaagagttatggcgcctcgtactcttattcttctgctttcgggagcactggccctgaccgagacatgggccggatcgcacagcatgcgctacttttacacagcagtgtcccgtcccggacgaggtgaaccgcacttcatcgcagttggttacgttgacgacacacaatttgtccgatttgatagtgatgccgcttcacccaggggagaacctcgtgcaccctgggtggaacaagaaggccctgagtactgggaccgagaaacccagaaatacaaaagacaagctcaaactgatcgcgtgagcctcagaaatcttagaggatactataaccaaagtgaggcagggagccacatcattcagcgcatgtatggatgcgatgttggtcctgatggacgactgctgaggggttatgatcagtatgcctacgacggaaaagactatatcgccctaaacgaggacctgagatcctggactgctgctgacaccgcagcccagatcacacaacgcaaatgggaagccgctcgcgaggcagagcaactcagagcctacctcgaggggctttgtgtggaatggttgcggcgttaccttaagaacggtaaggaaaccttacagcgcgcagaacacccgaaaacccacgtgacccatcaccccgtgagcgaccacgaggcaagtagacgctggaacctgccagaggtgggcagttgtggaggtgccttttggcgccgtgctgaaatccacgtgccttgcgcagccaggggggcagcgggtgctccccatcccgagtag

SEQ ID NO: 5074 - DNA, 786 bp, Artificial Sequence
  Description of Artificial Sequence: Synthetic coding sequence
taacgcgtgatggcaccgagaacactgatcctgctgctgtccggagccctggctctcaccgagacgtgggcctgcagccactctatgaggtacttttatactgctgtctccagacctggaagaggtgaacccagattcatcgccgtggggtacgtggacgacactcaattcgtacaatttgacagcgacgctgcgagcccccgaggagagccgcgtgccccatgggtcgaacaggaaggccctgagtactgggaccgcgagactcagaagtacaagcgacaggcgcagactgatcgggtgaacctccgcaagctccgaggctactataaccagtctgaagccggatctcacacactgcagaggatgtacggatgcgatctgggacccgacgggcgacttctcaggggttacaatcagtttgcctacgatgggaaagactacatcgctctgaatgaggatctccgctcttggaccgccgctgacaaggctgcacaaataacccaaaggaagtgggaggcagctagggaagctgaacaacgcagggcttaccttgaaggcacatgcgttgaatggttaaggcggtatttggaaaacggtaaaaagaccctacagcgcgcagagcatcccaagacacacgtcactcaccatcctgtgagtgatcacgaggcaagcaggaggtggaacctccctgaagttggatcgtgtggaggagctttctggcggcgagccgaaatccacgttccttgcgcagcaagaggcgctgctcgagcgcctcatcccgagtag

SEQ ID NO: 5075 - DNA, 786 bp, Artificial Sequence
  Description of Artificial Sequence: Synthetic coding sequence
taacgtgtcatggcgcctcggactctaattttactactgagcggggctctggcactgacagaaacctgggcttgttcccactcaatgcgttacttctatactgcagtctcacggccagggaggggcgagccgaggtttattgctgtaggatacgtagacgacacccaattcgtgcagttcgattcagacgccgcaagtccccgtggtgagccacgggcaccctgggtggaacaagagggcccagaatactgggatcgcgagacgcagaagtataaaagacaggctcagaccgacagggtgaatctgaggaagctgaggggatattacaatcagagcgaggctggctcccacaccttacagaggatgtatggatgtgatcttgggccagacggaaggttactgcggggttacaaccaattcgcttatgacggcaaagattacattgccctgaatgaagacctaagaagttggaccgctgccgacaaagccgctcagatcactcagaggaaatgggaggctgctagagaagctgagcaacgccgtgcatatctggagggcacctgcgtggagtggctacggcgttacctggagaacgggaaaaaaacactccagagggccgaacatcccaaaacccacgttacccatcatccagtgtccgaccatgaggcatcgaggaggtggaacctacccgaagtcggctcctgtggcggtgcattctggcgcagagccgaaatccacgttccttgcgcagcgaggggggctgctcgagctcctcatcctgaatag

SEQ ID NO: 5076 - DNA, 1119 bp, Artificial Sequence
  Description of Artificial Sequence: Synthetic coding sequence
atgagagtgatggcgccacgcaccctgattctcctgctgtctggggctctggctctgaccgagacctgggcttgcagccactccatgagatacttttacaccgcagtgtcccgacccggacgtggcgagcccaggtttattgccgtggggtacgtcgacgatacccagtttgtgcggttcgatagcgatgctgccagcccgaggggagagccgcgagccccttgggttgaacaggaagggcctgagtattgggatcgtgagacccagaagtataagcggcaggcacagacagatcgggtttccttgcggaatcttcgcggatactacaatcaatcagaggctgggagccataccctgcaatggatgtacggttgtgatctggggcctgatggccgacttctcagggggtacgaccagtcagcctatgatggcaaggactatattgccttgaatgaggacctcagaagttggacggccgctgacacggccgctcagatcacacagagaaaatgggaggcagcccgagccgcagagcagcaaagggcttacctagaagggacctgcgtagaatggcttcggaggtaccttgagaacggtaaggagacattacaaagggcagaacaccctaaaacacacgtgactcaccacctggtgtccgatcatgaggctacactcagatgttgggccctgggattttaccccgcagagattacacttacctggcaaagagacggggaagaccagacacaggataccgaactggttgaaacccgtcctgcaggggatggaacttttcaaaagtgggctgctgtggttgtgccgtcaggcgaggagcagcggtatacttgccatgtgcagcatgaaggattacctgagcccctgacactgcgctgggaaccttcatcccagcccacaattccgatagtcggcatcgtcgccggactggctgttctggcagtcttggccgtgctgggagccgtggtggcagtcgttatgtgccggcgaaaatccagcggccacttcctacccacaggcggtaagggcggatcatgctcccaagccgcaagctccaacagcgcccagggatctgatgaatctctgattgcatgcaaggcatag

SEQ ID NO: 5077 - DNA, 786 bp, Artificial Sequence
  Description of Artificial Sequence: Synthetic coding sequence
tgacgggtgatggcccctcggactttaatcctgctgctcagtggggcactcgcactaaccgaaacatgggcatgcagccatagtatgcggtacttcgacactgccgtttctaggcctggcaggggtgagcccaggttcatatcagtgggctatgtggacgacacacaatttgtccgatttgacagcgatgcagcttcccccagaggagagccacgcgcaccatgggtggagcaggaaggaccggaatattgggaccgtgaaacacagaagtacaagcgacaggctcaagctgacagggttaacttgcgcaagctccgcggttattacaatcagtccgaagatggttcccacacactccagtggatgtatggctgtgacctgggccctgacgggagactcctgcgcggatacgaccagtctgcttatgacggaaaagactacattgctctgaatgaggatctgaggtcatggaccgctgcagataccgctgcccaaatcacccagcggaaatgggaagctgctcgtgaggccgaacagtggcgcgcatatctcgagggtacgtgcgtcgagtggttaaggcggtacttggaaaacggaaaggagacattgcagcgcgctgaacaccccaagacccacgtcacccatcacccagtgtcagaccacgaggcaagtcgcaggtggaatctccccgaagtcgggagttgcggcggagctttttggcgcagagctgagatccacgtcccctgcgcagcacggggtgctgcccgagctcctcaccctgaatag

SEQ ID NO: 5078 - DNA, 1107 bp, Artificial Sequence
  Description of Artificial Sequence: Synthetic coding sequence
atgcgtgtaatggctcctcgtaccctaatcctcttgctatcgggcgcactggctttgaccgagacctgggcctgtagccactctatgcgctacttcgacacagctgtctcccggccaggaagaggtgagccacgcttcatctccgtgggatatgttgatgacacacagttcgtgagattcgatagcgacgctgcttcccctcgaggcgagccaagagccccatgggttgaacaggaagggccagagtactgggatcgggagacccagaagtataagagacaagcacaagctgatcgcgtgaacttgcgaaaattacgcggttactataaccagagcgaagacggatcacacaccctgcaatggatgtatggatgtgacctgggtcccgacggcagactgcttcgtggctacgaccagagtgcttacgacgggaaagactacatcgccttaaacgaagacctgagatcttggactgcggcagatactgccgctcagattacccagcgaaagtgggaagctgctcgggaggcggaacagtggagggcttatctagagggaacttgcgtcgagtggctgcgcaggtatctggaaaatggtaaggagaccttacagcgcgcagaacatccaaagacacacgtaacgcaccacccggtgagcgatcatgaagctaccctacgctgttgggcactgggcttctatcctgcagagatcaccttaacatggcaacgggatggagaagatcaaacacaagacaccgagctcgtggaaacgagacctgcaggcgacggaacttttcagaagtgggcagctgtcgtggtcccttcgggcgaggagcaaaggtacacctgtcatgttcaacacgaaggtctgccggagcctttaacgcttaggtgggagccaagttctcagcctacgatcccaattgtaggaatcgtcgcaggccttgctgtgctagcagtactcgccgtgttgggggcagtgatggcagtggttatgtgtcgcaggaaaagcagcgccgcttgcgttggcctacggtgccgaatctcttcacacctctcttttgtgacttcccgcgcttctgggatatccttctgcaaggggatctag

SEQ ID NO: 5079 - DNA, 786 bp, Artificial Sequence
  Description of Artificial Sequence: Synthetic coding sequence
taaagggtgatggcccctcgagcccttctgcttctccttagcgggggactggcactgaccgagacgtgggcctgctcacacagcatgcggtattttgatactgctgtttctcgtcccggtcggggagaaccaaggttcattagcgtcggctatgtcgacgatactcaattcgtgcgtttcgactccgatgcggcttcgccccgtggagaacctcgcgctccctgggttgaacaggagggaccagaatattgggacagagagacccaaaactacaagagacaggcccaggccgatcgggtttcgcttcgaaacctgagaggatattacaaccagtctgaggatggtagccacaccttgcagcgcatgtacgggtgtgaccttggcccagatgggagactgttgcgtgggtatgaccagtccgcctacgacggtaaggactacattgctctcaatgaagacctacggagttggaccgccgcagataccgccgcacaaatcacacagagaaaactggaagcagcccgtgccgcagaacaattgagagcatacctggaggggacttgtgtggagtggcttaggcggtatttggagaatgggaaggaaaccctgcagcgggctgagccaccaaagacacacgtcactcaccacccccttagcgatcacgaagcatcccgaagatggaatcttcctgaagtgggctcttgcggaggggctttctggactcgcgcagaaatccatgtgccctacgccgcacgcggagccgcaagagcacctcaccccgaatag

SEQ ID NO: 5080 - DNA, 1101 bp, Artificial Sequence
  Description of Artificial Sequence: Synthetic coding sequence
atgagggtcatggctcccaggaccctgatactcctcctgagtggcgcactcgccttaactgagacatgggcgggaagccacagcatgcggtatttctatacagcagtgtcccgccctggcaggggtgagccccatttcatagccgtgggttacgtggacgacacacagtttgtgcggtttgatagcgatgctgccagtcccagaggagaaccacgtgctccatgggtcgaacaagaggggcctgagtattgggacagggaaacgcagaagtacaaaaggcaagcccagaccgacagggtgtcactgcgaaatctgaggggctactataaccagagtgaagcaggttcccatatcatccagcgcatgtacgggtgcgacgttggccctgatggtcgcttactgaggggctacgaccaatacgcctatgatggaaaggactacattgccttaaatgaagatcttcgctcatggaccgctgccgacacagccgcacaaatcacacagcgcaaatgggaggctgcgagggaggccgaacagttacgcgcatacctggaaggactctgtgtagaatggctgaggagatatctgaagaatggaaaggagactctgcagagggcagaacacccaaaaacccacgtgacccatcatccagtgagtgaccacgaagccactttaagatgttgggccttaggattctatccggcagagattacactcacctggcagtgggatggggaagatcaaacgcaggacacagagctcgttgagactcggcctgccggagacggaacctttcagaaatgggctgctgtagttgtgcctagcggtgaggagcagcggtacacgtgtcatgtacagcatgaagggttacccgaacccctgacgctcaggtgggaaccatcaagccagccaaccattcccatcgtcgggattgtggcgggactagctgtcctggccgtcctggctgtgctgggcgctgtggtcgctgtagtgatgtgccggcgaaaatcttcgggtggcaagggcggatcatgctcgcaggccgcatcttctaacagcgctcaagggagcgatgagtccctgatcgcctgcaaggcctag

SEQ ID NO: 5081 - DNA, 1119 bp, Artificial Sequence
  Description of Artificial Sequence: Synthetic coding sequence
atgcgagtcatggcccctagaacactgatattactgctctcgggagcactggcgctaaccgagacctgggcctgctcacatagcatgaggtattttgatacagctgtctctcgccctggtcgtggtgagccacggtttatcagtgttggatatgtagatgatacccagttcgttcggtttgactccgacgctgcatcccccaggggggagcctagggccccatgggtggaacaagaggggcctgagtactgggaccgcgagacccagaagtacaaaaggcaggcccaagccgatagagtgaaccttaggaagctccggggttactataaccagtcggaggatgggtctcatacactgcaatggatgtatgggtgtgacctcggccctgatgggaggctgttacgtggttacgatcagagcgcttacgacggcaaggactatatagcactgaatgaagatctccggagttggacagccgcagacactgcagcccagattactcaacggaagtgggaggcagcccgagaggccgaacaatggcgcgcatatcttgaaggcacatgtgtcgaatggctgcggagatatcttgagaatgggaaagagaccttgcagagggctgagcacccgaaaacccacgtgacccaccatcccgtgtcagaccatgaagctaccttacgatgctgggctctagggttttaccccgcagagataaccttgacctggcagcgggacggggaggaccagacccaagacaccgaactcgtggaaactcggccagcaggtgacggtacgtttcagaaatgggccgctgtagtagtcccttcaggcgaagaacagcgttacacatgccatgtccagcacgaagggctgcctgaaccacttactctgaggtgggaaccaagtagtcagccaacaataccaatcgttggaattgtagcaggcttagcagtgctcgccgtactggctgtgcttggggcagtaatggccgtcgtgatgtgccggagaaagagcagcggtcatttcttacccactggcggaaaggggggatcttgctctcaggcagcctccagcaactctgcccagggctctgatgaaagcttgatagcctgcaaggcctag

SEQ ID NO: 5082 - DNA, 1107 bp, Artificial Sequence
  Description of Artificial Sequence: Synthetic coding sequence
atgcgggtcatggctcctcgaaccttaattctgctcctgtccggcgctctggctttgaccgagacctgggcttgttcccactccatgcggtacttctatacggctgtctctagacccggaaggggagagcccaggttcattgctgtcggttacgttgatgatactcagtttgtgcagttcgactctgacgcagctagtccgaggggtgagcctcgagctccatgggtggagcaggagggtcctgagtattgggaccgagagacccagaaatataagagacaagctcagacggatagagtaaacctccggaaactgcggggatactataaccagtccgaagctggctcccataccctgcagagaatgtacgggtgtgacctaggtcccgacggacgcctactcagggggtacaaccagtttgcatatgatggaaaggattacatcgccttaaatgaggatctaaggagttggactgccgcagacaaggccgcacagataacacagagaaagtgggaagcagcccgagaagctgagcagcgtagagcctatctggaaggcacctgcgtagaatggcttaggagatacctggagaacggaaagaaaacactacagcgagctgaacatccaaaaacccacgtgacacaccatccggtgagcgatcatgaggcaacacttagatgttgggccctgggcttttacccagccgagataactttgacttggcagagagacggcgaagaccagacccaggatacagaactagtggaaacaagacctgcaggagatggcacgttccagaagtgggcagcggtcgttgtgccctctggtgaggagcagcggtacacctgtcacgtccagcatgaggggttgcccgagccactaaccctgcggtggggcccatcctctcagcccacaatccctattgtgggcatagtcgctggcctggccgtgctggccgttcttgctgtcctcggggctgtgatggccgtcgtaatgtgtagacggaaatcgagcgccgcttgcgtgggactgagatgtcgcatcagcagccatctttctttcgttactagcagggccagcggaatttctttttgtaaaggcatctag

SEQ ID NO: 5083 - DNA, 675 bp, Artificial Sequence
  Description of Artificial Sequence: Synthetic coding sequence
atgcgggtgatggcacctcgggcactgctgctcttgctctctggtgggctggccctgactgagacttgggcgtgcagtcactcaatgcggtattttgatacagctgtgtcacgtcctggaaggggggaaccccgtttcatttctgtcgggtacgtagacgatacacaatttgtaagattcgacagtgatgctgcctcacccagaggagagccaagagcaccctgggtagaacaggagggcccagaatattgggaccgcgaaacacagaaatacaaacgacaggcgcaggcagatcgggtctcactgcggaacttacggggatattataaccagagcgaggatggaagtcacacactgcagcgcatgtctggctgcgacctgggacctgacggacgcctgttacggggatatgatcagtcggcctacgatggcaaggactacatcgctctaaacgaggatctcagatcctggacggccgctgacaccgcagcacagattacacaacggaaactcgaagcggcaagagccgctgagcagctgcgagcgtacctagaaggcacttgtgtagaatggctaaggagatacctggaaaatgggaaagagactctgcagcgcgcagggcaggatcaaaagtcattgttcctaccacaaagactagagctctccaacgaatag

SEQ ID NO: 5084 - DNA, 675 bp, Artificial Sequence
  Description of Artificial Sequence: Synthetic coding sequence
atgagggtcatggcccctaggactttgatcctgctgctttccggggcattagcgttaactgagacatgggcctgttcacattccatgcgctatttctataccgctgtgtcccgcccaggaagaggcgagccaagattcatcgccgtcggttacgtggacgatacccaattcgttcagttcgactccgatgccgcatcacctcgtggcgagccaagagctccatgggtggaacaggagggacctgaatactgggaccgggagacccagaagtacaaacgccaggctcagactgatagagtaaacctgcggaagttgagaggatactacaatcaatcagaggccggatcccacactttgcaacgcatgtacggatgcgatctggggcctgacggtagattactacgagggtataaccagttcgcatacgatggcaaggactatattgccctgaatgaggatttgcggtcatggacagcagccgacaaagcagcccagatcacacagcggaagtgggaggccgcacgagaggccgagcagcgcagggcttacttggagggaacttgtgtcgagtggttgaggcgctatctcgaaaatggcaaaaagaccctgcagagagccggtcaggatcaaaagagcttatttctgccacagagacttgagctgagcaatgagtag

SEQ ID NO: 5085 - DNA, 675 bp, Artificial Sequence
  Description of Artificial Sequence: Synthetic coding sequence
atgagagtgatggcccctcgtgctctcctactgctactgagcggcggtctcgctcttacagagacctgggcctgtagccactcaatgcggtactttgacacagccgtctctcggcctggtcgcggagagccgaggttcatctcagtcggctacgtggacgatacacagttcgtccgctttgattcagatgccgcatcacctaggggggagcccagggcgccttgggtggagcaggaaggaccggagtattgggatcgggaaacacaaaactataagcgccaggctcaggctgatcgagtatccctgaggaacttacgaggatactacaaccagtccgaagacggcagtcatacgctgcaaagaatgtatggctgcgatctcggacccgatggccgtctgctaagaggatatgatcagtcggcctacgatgggaaggactatatcgcgttgaacgaagacctgaggtcttggaccgcggctgacactgctgcccagattacgcaacggaaacttgaggcggctagagcagctgagcaactgcgggcttatctggaaggtacttgtgttgaatggctgagacgttacctcgagaacggcaaggaaaccctgcagcgcgctggccaggaccagaaaagtttgtttttaccccaaagactcgagctgtccaatgagtag

SEQ ID NO: 5086 - DNA, 396 bp, Artificial Sequence
  Description of Artificial Sequence: Synthetic coding sequence
atgcgtgtgatggccccaaggacactgatactgcttctcagcggagccctggcactgaccgagacgtgggcttgcagccatagcatgcgttacttctatacagctgtcagtcgtcccggacgcggagagcccaggttcattgctgtaggctatgttgatgacacccagtttgtgcagttcgattctgatgccgcttcaccccgaggcgagccccgagccccatgggtggaacaggagggcccagagtattgggaccgagagacacagaagtacaagcggcaggctcagaccgatcgcgtgaacctgaggaagttacgcggatactacaaccaatctgaagccgaggatgtatggctacgtcccggtgcgagaagagctccacctcctcgcgtatag

SEQ ID NO: 5087 - DNA, 396 bp, Artificial Sequence
  Description of Artificial Sequence: Synthetic coding sequence
atgcgtgtcatggctccacgggctcttttactcctgctctcaggtggactggctctgaccgaaacttgggcctgctctcacagcatgaggtatttcgacactgcagtgtcccggccagggagaggagagcccagattcattagtgtgggatatgtggacgacactcagttcgtaaggttcgatagtgatgctgccagccccagaggagagcctcgggcaccatgggtggaacaggagggacccgagtactgggatagagaaacacaaaattataaacgccaggcccaggcggatagggtcagccttagaaacctgcgtggctattacaaccagtccgaagacgaggatgtatggttaaggcctggagccagaagagctccccctccccgagtgtag

SEQ ID NO: 5088 - DNA, 396 bp, Artificial Sequence
  Description of Artificial Sequence: Synthetic coding sequence
atgagggtgatggccccaagaactctgatactgttgctgtccggtgccttagccctcaccgaaacttgggcatgcagccatagcatgcggtattttgatactgcggtttcacgacctgggaggggtgaaccccgatttatctcggtgggctacgttgatgatactcagttcgtgcggtttgattccgatgccgctagcccaagaggggagccaagggccccttgggtggagcaggaaggacctgaatactgggacagagagacccagaaatataagcgccaggcccaagccgatagagttaacttacggaaactccgaggctattacaaccaaagcgaggacgtcgatgtttggctgcggcctggcgcacgaagggcccctcccccacgcgtgtag

SEQ ID NO: 5089 - DNA, 396 bp, Artificial Sequence
  Description of Artificial Sequence: Synthetic coding sequence
atgagagtgatggcccctcgcactctcattctgctgctatccggcgctctggccctaaccgaaacatgggcttgctcccattctatgcgttacttctacacagctgtatctcgacccggacgcggagaacctcgtttcatcgccgtcgggtatgtcgacgatacgcaattcgttcaattcgattccgacgccgcttctccacgcggtgaacctcgggctccttgggttgaacaggagggcccagaatattgggaccgggagactcagaaatataaaagacaggcccagacagaccgtgtgaacctgcggaagctgagagggtactacaaccagtcggaagctgaggatgtgtggctgaggcctggggctaggagagcgccaccaccccgtgtctag

SEQ ID NO: 5090 - DNA, 396 bp, Artificial Sequence
  Description of Artificial Sequence: Synthetic coding sequence
atgagggtgatggccccacgtaccctgattctgctcctaagcggggctctggccttgacagagacctgggcctgctcacacagcatgcgatacttttacaccgcagtaagtcgcccaggtagaggcgagccaagatttatcgcggtgggctacgtcgacgacacgcagtttgtccgattcgactctgacgccgcttccccgagaggcgagccaagggccccatgggtggagcaagaaggcccagagtattgggacagggaaacacagaaatataagcgtcaagctcagacagatagagtcagccttaggaatctgcgcggttattataatcaaagcgaagccgtggacgtttggttacggccaggtgcccgtagagctccccctccacgtgtttag

SEQ ID NO: 5091 - DNA, 396 bp, Artificial Sequence
  Description of Artificial Sequence: Synthetic coding sequence
atgcgggtaatggctcccagaacacttatactgcttctttccggggcactggccctgaccgagacatgggctggttctcatagtatgcggtatttttacaccgccgtgtctcggccaggtcgcggagaacctcatttcatcgccgtggggtacgtggatgacacgcagttcgtccggttcgattctgatgccgcatcaccacgaggcgaaccgagagccccttgggtggaacaagaaggacccgagtactgggaccgggagacccagaaatacaaacgtcaggcacagacggaccgggttagcttaaggaacctccgaggatactacaaccagtcggaagctgaggacgtgtggcttaggaggggggcacgcagggctcctccacccagggtatag

SEQ ID NO: 5092 - DNA, 1212 bp, Artificial Sequence
  Description of Artificial Sequence: Synthetic coding sequence
atgagggtaatggcgcctcgagccctgcttctgctcttgtccggcggacttgctctaactgaaacgtgggcttgcgagtgtggcgtaggcagggaggccgcatccgccgagaggtccgagggcccaccaggagagccacgtagagaagtgggccgagcaggcctgtcaccaagttctccacccggaagtcactcaatgaggtacttcgacacagccgtgagccgcccaggcagaggggaacctagattcattagcgtgggttacgttgacgatactcagttcgtcagattcgatagcgacgctgcctcaccacgcggtgaaccacgcgctccctgggtggagcaggagggtcccgaatattgggatagggaaactcaaaagtacaagaggcaggcacaagcggacagggtaagcctgcgtaacttgaggggctactacaatcagtcggaagacggttcccacacccttcaacggatgtcaggttgcgatctgggccctgacggcagactgctccggggttacgatcagtccgcttacgacggtaaagattatatcgcattgaacgaagaccttagaagctggacagccgcagacaccgccgcacagatcacacagcgcaagttggaagctgcccgagccgcagagcagctgcgggcttatctcgaagggacctgcgtagagtggctcaggcgttatctggaaaacgggaaggaaaccttgcagcgggctgaacctcccaagacacacgtgacccaccaccctttatcggatcacgaggcaactctgcggtgctgggcactcgggttctatccagcagaaatcactctcacttggcagcgcgatggggaagatcagacccaagacacagaactagtggaaacacggccagctggagatggcacgttccagaagtgggccgctgtggtggtgccttccggacaggagcaacgatacacgtgccatatgcagcatgaagggctgcaggagcccctaacactctcatgggagcctagctcccagccaaccatccctattatggggattgtggccggtctggccgtgctggttgtgctggccgttttgggtgcagtggttaccgcgatgatgtgtaggaggaagtcaagtgggggaaaagggggatcctgtagtcaggcagcatgtagcaattctgcgcagggaagcgacgagtcactgatcacatgcaaggcatag

SEQ ID NO: 5093 - DNA, 1212 bp, Artificial Sequence
  Description of Artificial Sequence: Synthetic coding sequence
atgagggtcatggcacccagggcactactgctgctgctgagcggagggttagccttaacggagacatgggcttgcgaatgcggtgtgggtagggaagccgcatccgccgaacgcagcgagggtccccctggtgaaccgaggcgggaggttgggagagcaggcttgtcaccttcaagccccccagggtcccactctatgaggtattttgacactgccgttagtcgtcctggcaggggggaaccaagattcatcagtgtggggtacgtggatgatacccagtttgtcagatttgatagcgatgccgctagtcctcgaggagaaccccgtgccccatgggtggagcaggaggggcctgagtattgggatcgggaaacacaaaactataaaagacaggcgcaagccgatcgggtctcgctgcgtaacctacggggttattataatcagagcgaggatggaagccacaccctgcaaaggatgtacggctgtgacctgggaccagacggtaggctgctgagaggctacgaccagagtgcgtatgacggaaaggattacattgccctgaacgaagacctaagatcttggactgccgctgatactgcggctcagatcacccagaggaaactggaagcagctagagcggctgaacagctgagagcctacctcgaaggtacttgtgtggaatggctgaggcggtatttagagaatggaaaagagactctgcagagggcggaaccccctaaaacacacgtcacacaccaccctctctctgatcatgaggccacactgcgatgttgggccctaggtttttaccccgctgaaatcacgctgacctggcagcgtgatggggaggatcaaacccaggacacggaactcgtcgagacccgccctgctggcgatgggacattccaaaagtgggccgcagtcgtggtaccctctggacaggagcagcggtatacatgccatatgcaacacgagggactgcaggagcccctgaccttgagctgggagccgtcaagccaaccaacgataccaatcatggggatcgtggccggtctcgccgtgctggttgtgctcgccgtcctgggcgcagtagtgaccgctatgatgtgccgccgtaagtcttctggaggtaagggaggatcttgtagccaggctgcttgctccaattctgctcagggatctgatgagtctctcatcacctgcaaagcttag

SEQ ID NO: 5094 - DNA, 981 bp, Artificial Sequence
  Description of Artificial Sequence: Synthetic coding sequence
atgcgcgtcatggctccacggacgctgattctgcttctctcgggagccctggcattgacagagacttgggcctgcagccactctatgcgttacttttacaccgccgtctctcgtcccggtcggggagaaccacgctttatcgccgtggggtatgtagatgacacgcaattcgtacggttcgatagcgacgccgctagtcctcgaggcgaaccgcgtgcaccctgggtggagcaggaagggcctgaatattgggatcgcgagacacagaagtataagcggcaggcacagactgaccgggtctctctgaggaatctgcggggttactacaaccaatctgaggcgggatctcatacattgcagtggatgtatggctgtgaccttgggcctgacggcaggcttctgagaggttacgaccagtcggcctatgatgggaaggattatatagccctgaatgaagaccttcgctcatggactgccgcagacactgccgctcaaatcactcagcggaagtgggaggcggcaagagccgcagagcagcagagagcttatttggagggaacatgcgtcgaatggctacggcgatatcttgagaacggcaaagaaactctgcagcgcgctgagcatcccaaaacgcacgtgacccaccacctggtcagtgaccatgaggccactttaagatgttgggcactgggcttttaccccgctgaaattacactgacgtggcagcgtgacggggaggatcaaacccaagacacagaacttgtggaaactaggcccgctggagatgggactttccagaagtgggccgctgtcgtggtgccgtctggagaagagcaaagatacacctgtcacgtgcagcatgagggactgcctgagccactgacactacgatggggtggaaagggaggttcctgcagccaggctgccagctcgaattctgcccagggctctgacgaatcactgatcgcctgtaaggcctag

SEQ ID NO: 5095 - DNA, 1041 bp, Artificial Sequence
  Description of Artificial Sequence: Synthetic coding sequence
atggccaggcctcagcgcacacctgcaaggtcaccagacagcatagtagaggtcaaatcaaagtttgatgcagagtttcgtagatttgccctccctagagctagcgtctctgggtttcaggagttttccaggcttttaagggccgtccaccagatacctggactagatgtgctcctgggctatactgatgcccacggcgacctgcttccactaactaatgacgactcactgcaccgggcattagcaagtggcccacccccactcaggttgttggtccagaagagagcagaggcggatagtagcggactcgccttcgcttccaattcactgcagcgtagaaagaagggtctcttgctccgaccagtggcgccactgagaacgagacctcctctgctgattagtctgccccaagacttccgccaggtgtcatccgtgattgacgtggacctacttcctgaaacccatcgacgagtgcgccttcataaacacggtagtgatcgcccattgggattctatatccgggatggaatgtcagtcagagtcgcaccccagggcctggagagagtgccaggaattttcattagccggctcgttagagggggtctggccgagtcgactggtctgctagcagtgtcggacgagatcctggaggtcaacggaatcgaggtcgccggtaagactcttgaccaggtcacagatatgatggtggccaatagtcacaatcttattgtgacagtcaaaccagccaaccagcgcaataacgtggtgagaggcgcatcagggaggctcaccgggcctcctagtgctggacctggacccgcagaacccgactccgatgacgatagttctgatctggttatcgagaaccgacagcccccatcgagcaatgggctgagccagggcccaccttgctgggacctgcaccccggatgtaggcacccgggaaccaggagttccctgccttccctggatgatcaagagcaagcttcctcgggttggggaagccggattaggggtgacggaagcggcttttctctgtag

SEQ ID NO: 5096 - DNA, 1824 bp, Artificial Sequence
  Description of Artificial Sequence: Synthetic coding sequence
atgatcctgcttacattcagcacaggccgacggctggattttgtacaccattccggggtgtttttccttcagaccctactctggatcctttgcgctactgtctgtggtaccgaacagtattttaatgtggaggtctggctgcagaaatatggctatctacccccaacagacccacgcatgtctgtactccgttcagcagagactatgcagagtgcgctggccgcaatgcaacaattctacggcataaatatgacagggaaggtggacaggaacacaatagactggatgaagaaacctaggtgcggagtgcccgatcagacccgtgggagtagcaagttccacatcagacgcaagagatacgccctaacggggcaaaagtggcagcacaagcatattacctactccatcaaaaatgtcactcctaaggttggcgatcccgaaactcggaaggccattcgcagggcgtttgacgtctggcagaatgtgacccccctgacctttgaggaggtgccgtactccgagcttgagaacggtaaaagagatgtcgatatcactattattttcgcaagcgggttccatggggattccagcccattcgatggcgaggggggtttcttggcacacgcctatttccccggtccaggcattggtggcgatacccattttgatagcgatgagccttggacccttggaaatcccaatcacgatgggaacgaccttttcttggtcgcggtacacgaactcggccatgcactgggcctagagcattccaatgatcctaccgctatcatggcccctttctaccaatatatggagaccgacaattttaagttgccaaacgacgacctccagggaatacagaagatctacggccctcctgacaagattcctccaccaacgcgtccgcttcccacagttcccccacacagaagtatcccaccggcagacccgaggaagaatgatcggcctaagccacctcggcctcccacgggacgaccctcctacccgggagccaagcccaacatctgtgacggtaattttaatactcttgctattttgaggcgagaaatgtttgtttttaaagaccagtggttctggagagtgaggaacaaccgggtgatggacggatatccaatgcagatcacatatttttggcgcggactacctcccagcattgatgcagtatatgagaactctgacggtaatttcgtgttctttaagggaaacaaatattgggtgttcaaagatacaacactgcaacccggatacccacatgatttgatcactcttggatcgggcatccctccacacggcatcgatagcgccatatggtgggaggatgtgggtaagacctacttttttaagggggacagatattggcgatacagcgaggagatgaagaccatggatcccggatatcccaagccaatcaccgtttggaaaggtatccctgaatctccccagggcgcatttgtgcataaggagaatggattcacttacttttataagggaaaagagtattggaaattcaacaatcagattcttaaggtggagccgggttatcccagatcaattctcaaagactttatgggatgtgatggaccaactgatagagttaaagagggacattctcctcccgacgatgtggacatcgttataaagcttgataatacagccagtaccgtcaaagccattgccatcgtgattccctgtatactggccctatgcctcctagtcctggtgtacacagttttccagttcaagagaaaggggacacctcgacacattttgtactgtaagaggtccatgcaggagtgggtgtag

SEQ ID NO: 5097 - DNA, 1812 bp, Artificial Sequence
  Description of Artificial Sequence: Synthetic coding sequence
atgcggaggagggcagcaagaggacccggacctcctccacccggacccggactctcacggctgcctctgccgctgctgctgcttctggcgttgggcaccaggggaggatgcgccgcaccggctccggcacccagagcagaggacctgtcactcggcgtggagtggttgagcaggttcgggtacctacctcccgctgatccaacaactggacagcttcagacccaggaagaactgtctaaggctataaccgctatgcagcagtttggagggttagaggccacgggcattctggatgaagcaaccctagcactaatgaaaacgccaagatgcagcctgccagatctgcccgttctcacacaggcaagacggagacgacaggccccagctcctacaaagtggaacaaacgtaatctgtcttggcgtgttcggacgtttccacgggatagccctctgggccacgacactgtgagggcacttatgtactatgcattgaaggtgtggtctgatattgccccactgaattttcatgaggttgcaggaagcgctgctgacatccagatagacttttcaaaggccgatcacaacgatggatacccatttgatgggcctgggggaactgttgcccatgccttcttcccgggacaccatcataccgccggagatacacacttcgatgatgacgaggcttggactttccgctcttctgatgcacatggcatggatttgttcgcagtagcggtgcacgagttcgggcacgccattggcctgtctcacgtggctgccgctcactcaatcatgcgcccatattaccagggaccagtaggcgatccgcttcggtatggactcccgtacgaggacaaagtgagggtctggcagctgtatggcgtgagggagtccgtgagcccaaccgcacagcccgaggagccgccactcctgccagagcccccagataaccgatcctctgcccctccaaggaaggatgtccctcacagatgttcaacacatttcgacgcagtagctcagatcagaggcgaagctttcttttttaaagggaaatatttctggcgactcacgagagaccgccatctagtaagccttcagccagcacaaatgcaccggttctggcggggtcttcccctgcacctcgactctgtggacgcggtctacgagcgcacgagtgaccacaagatcgtctttttcaagggcgatcggtattgggtcttcaaggataataacgttgaggaagggtatcctcgacctgttagcgacttcagtctgccacccggaggaattgacgcagccttctcttgggcccataatgacaggacatacttttttaaagaccagctgtactggaggtatgacgaccacactcgacatatggaccccggatacccggcacagagccccctgtggaggggagtccctagcaccttggacgacgctatgcgctggtccgacggagcatcgtacttcttcaggggtcaagaatactggaaagtccttgatggagagctggaagtggcacccggatatccacaatcaaccgcgcgagactggctggtgtgtggcgatagtcaagctgatggatcagtggctgcaggtgtggatgccgctgaggggcctcgagctcctcctggccagcacgatcagtcacgatcagaagatggctacgaagtgtgtagttgcactagtggcgcttcctctccacctggtgcgcctgggccactcgtggcagcaacgatgctgttactgcttccccctcttagccccggtgccctttggacagccgcacaggcattaacactctag

SEQ ID NO: 5098 - DNA, 1560 bp, Artificial Sequence
  Description of Artificial Sequence: Synthetic coding sequence
atgcagcagtttgggggtctcgaggccacaggcattctggacgaagccactctcgcacttatgaagacaccacgctgtagcttacctgatctccccgtgcttacgcaggcgcgtaggaggcggcaggcaccagcacccacaaaatggaataagagaaatctgtcatggcgggtgagaacatttccgagggactcccccttaggacacgatacagtgcgagccctgatgtattatgccctcaaggtttggagtgacatcgcaccattaaattttcacgaagtggccggaagcgccgctgatatccagatcgacttttcgaaagcagaccataatgatggataccctttcgatgggccaggagggacggtggcccatgccttttttcccggacatcatcacactgctggggacacccatttcgacgatgatgaggcgtggacgtttaggagttcggacgcccatggaatggatctgttcgccgtggccgtgcatgagttcggacacgcgataggactgtcacacgttgctgctgcacatagtataatgagaccttactaccagggccctgtcggcgacccactgcggtatggcctgccatacgaggataaagttagggtgtggcagctatatggagtgagagaatcagtgagtcctaccgctcagcctgaggagcctccattgctccctgagccaccagataaccggtcatctgcaccacctagaaaggatgtgcctcacaggtgttctactcatttcgacgccgtggctcagatccgaggcgaagcgtttttctttaagggcaaatacttttggaggttgactcgggataggcatctggtgtccctccagcctgcccagatgcaccgcttctggagaggccttccactgcatctggactctgtggatgcagtgtacgagagaacatccgaccacaagatcgtcttttttaagggagatcgatattgggtgtttaaagataataatgtggaggagggatatccacgtcctgtgagcgatttctccctgcctcccggaggaattgacgccgcattttcatgggcccacaatgatcgaacctacttctttaaagatcagctttattggcggtatgacgatcatacccggcatatggacccagggtacccggctcaatctcctctctggcggggagtcccatctaccctcgatgatgcgatgaggtggtcagatggagcctcatactttttcagaggccaggagtactggaaagtcctggacggtgaactggaggtcgcccctggataccctcagagcacggcaagggattggcttgtatgtggcgatagccaggcagacggatctgtggcagccggtgtagatgctgcagaggggccaagggcccctccaggacaacacgatcagagtcggagcgaggacggctacgaagtctgttcttgcacatccggggcatcttcgcctcctggagcccctggcccactggttgccgctaccatgcttctccttctcccgcctctaagccccggagccttgtggaccgccgcacaggccctcactctctag

SEQ ID NO: 5099 - DNA, 348 bp, Artificial Sequence
  Description of Artificial Sequence: Synthetic coding sequence
atgcagcagtttggcggattagaggccaccggtattctggacgaggcaacactggcactcatgaagaccccccgatgctcgctgccagatctaccggttctaactcaggctaggaggcgaagacaagcaccagccccaaccaaatggaataagaggaacctatcctggcgtgtccgcacatttcctagagactccccgttaggccacgataccgtccgggcactgatgtactacgccttgaaagtatggagtgacattgccccactgaactttcacgaagttgctgggtcagccgctgatatacagatcgactttagcaaagccgaccataacgatggttatccttag

SEQ ID NO: 5100 - DNA, 1527 bp, Artificial Sequence
  Description of Artificial Sequence: Synthetic coding sequence
atgaactgccagcaactctggttgggatttctgttgcctatgacagtgtcagggagggttcttgggctcgctgaagtcgcaccagttgactacctctcacagtatggataccttcagaaacccctagagggcagcaacaatttcaagcctgaggacataaccgaggcccttagggcgttccaggaagcaagtgaattgccagtatctggccagcttgatgatgctacgagagcaaggatgagacagcccaggtgcggacttgaggacccttttaatcagaagaccctgaagtacttgctgctgggacggtggcgtaaaaaacatctaacctttaggatcctgaatttacctagtaccctgccacctcataccgctagggctgccctacgccaggcattccaggactggtctaacgttgccccactgacttttcaggaggtacaagccggtgccgctgacatcagactttccttccacgggagacagtcttcctattgctccaatacttttgatgggcctggtagagtcctcgcacacgcggacatcccagagctcggtagcgtgcattttgacgaggatgaattttggacggagggcacttataggggggtgaatctgcgcattattgccgctcacgaagtcgggcatgccctggggctcggccacagccggtacagccaggcactgatggcaccggtctatgaagggtataggccccatttcaaacttcatcccgacgacgtggcaggaatccaggccctgtatggcaagaagtccccagtaattagagacgaagaggaggaggagacagaacttcccaccgtgccacctgtgcccacagagccctcgcctatgcctgatccttgctcatccgagctggatgccatgatgctcggcccacggggaaagacctatgccttcaagggagactacgtatggacagtgtcggacagcgggccaggtccactctttagggtttccgccttatgggagggacttcccggtaacttggacgccgctgtgtacagccccaggacacagtggatccactttttcaagggcgataaggtatggcggtatatcaatttcaagatgtctcccggattccccaagaagctcaatagggttgaacctaatcttgacgctgcattatactggcctctaaaccagaaagtcttcctcttcaaaggcagcggttactggcagtgggacgaacttgcacggaccgacttctcatcctatccgaagccaattaagggcctgtttaccggggtgccaaatcagccctcagccgctatgtcatggcaggacggcagggtttacttctttaagggcaaggtttactggcgcctgaaccagcagctgagagttgagaagggataccccaggaacattagccacaactggatgcattgtaggccaaggaccatcgacaccaccccctctgggggaaatactacaccgagtggtacaggaatcacactcgataccaccctctccgcaacggaaaccaccttcgaatattag

SEQ ID NO: 5101 - DNA, 669 bp, Artificial Sequence
  Description of Artificial Sequence: Synthetic coding sequence
atgggagtcacgtgggacttctctatgtccaacggaggaccaagaggaaaaacttacgcttttaaaggcgattacgtgtggacagtatctgattctggcccaggacccttgtttcgcgtgagcgctctgtgggagggtctgcctgggaacctggacgccgctgtatatagtccgaggacccagtggattcacttctttaaaggcgacaaggtgtggcgttatattaacttcaaaatgagtcctggatttcccaagaagctaaaccgcgtcgagcccaacctggacgctgccctctactggccgctcaatcagaaggtgtttttgtttaagggcagcggttactggcagtgggatgagttggccagaacagacttcagctcttacccgaagccaattaagggtttattcactggggttccgaaccagcccagcgccgcaatgagctggcaggatgggagagtttatttctttaaggggaaagtctattggcggctcaaccaacagttgagggtagaaaagggttatccaaggaacataagccataattggatgcattgtagacccagaacgatagacaccactccctccggcggtaacaccaccccatccggtacaggcattacactggataccaccttgtccgcaacggagactacattcgaatattag

SEQ ID NO: 5102 - DNA, 918 bp, Artificial Sequence
  Description of Artificial Sequence: Synthetic coding sequence
atgaactgccagcagttatggttggggttcttactacctatgactgtgtctggacgggttctgggcctcgccgaggtagcacctgtggattatctctcacaatacggatatctccaaaaacctctggagggctctaacaattttaaaccagaggacatcacagaggccctccgggcattccaggaagcttccgaactgcccgtatctggacagctggatgatgccaccagggctcggatgagacagcccaggtgcggtttggaggatccttttaaccaaaaaaccctaaaatacctgctactcggacggtggcggaaaaaacatctgaccttcagaattctgaatcttccctcaacactgcccccacacacggctagagccgctctgcggcaggcattccaggactggtcgaacgtggctccactgaccttccaggaggtgcaggctggtgcggcagacattcgcctttccttccatggacgacagagctcttattgttctaatacttttgatggaccaggtaagaaaagccccgtcatcagggatgaagaggaagaagagacagaattacccactgtcccgcctgtgccaacagaaccgagccctatgcctgacccctgctcctcagagctcgacgcgatgatgctgggagaggcccctccactgcaagccgtcggacggaggtggggacagcccgctgaccccgaggcatggacgaatgggtccgacatgggactgcagcacgagcagtggcgggctccctgggaagatctctgctttcaaggcggtctttgcgtcgactgtatcaggttccgcacagggcctcttgttcccagtgtttgtcccctaggaggtgcccctcgtaaacctgggtgctgttgcctgctggcaagtaataccatggacagtttattgtag

SEQ ID NO: 5103 - DNA, 1452 bp, Artificial Sequence
  Description of Artificial Sequence: Synthetic coding sequence
atgaaagtgctgcccgcttccggcctggccgtgttcctgattatggcactgaagttttccaccgcggctcctagcttagttgctgccagcccgaggacttggagaaacaattaccgcctggcacaggcttacctggacaagtactacacaaacaaggagggccaccagattggagaaatggttgctaggggttcaaacagcatgattcggaagataaaggagctgcaggctttcttcggcctccaggtgacagggaagctggaccagaccaccatgaatgtcattaagaaacctagatgcggtgtaccagacgtcgcaaattatagactctttccaggagaaccaaaatggaaaaaaaacacattaacttaccgtatatcgaagtatacacctagcatgtcgagcgttgaggttgataaggccgtggaaatggccttgcaggcctggagctctgcagttcctctgagtttcgttagaattaattcaggggaagcagatatcatgatcagcttcgagaacggagatcacggggattcttacccttttgacggcccacggggaacactggcgcacgcatttgcacccggagaaggccttgggggtgatacccacttcgacaatgcagaaaagtggactatgggaacaaacggctttaatttgtttactgtcgcagctcatgagtttggccacgccctgggtctcgcccactccaccgacccttcagccctgatgtatcctacatacaagtacaaaaacccatacggattccatctgccgaaagacgacgtcaaaggtatccaggccctgtatggcccaagaaaggttttcctgggaaaacccactttgccgcacgcacctcatcacaagccctccatacccgatctttgtgactcctcctccagtttcgacgcagtcacaatgctcggtaaagaattgttgctgttcaaagacagaattttttggcggaggcaagtccatttacgaacaggcattaggccttccactatcaccagttctttcccacaacttatgtctaacgtggatgccgcatacgaggtcgcagaaagaggtacagcgtacttcttcaaaggaccccactattggataaccagaggtttccagatgcaagggccaccacgaacaatctatgactttgggtttccaagacatgtccagcagatcgacgcagccgtgtacctccgggaaccccagaagaccttattctttgtgggggatgagtactattcatatgatgagagaaaaaggaagatggagaaggactaccctaagaacacagaggaagagtttagtggggtgaacggacaaattgacgccgcagtggagctgaacggctatatctactttttttcaggcccaaagacatacaagtacgacaccgagaaggaggatgtcgtttcagtagtgaagtccagtagctggatagggtgctag

SEQ ID NO: 5104 - DNA, 1710 bp, Artificial Sequence
  Description of Artificial Sequence: Synthetic coding sequence
atgctcgcagctagcatttttagacctacgcttctgttgtgctggcttgcagccccttggcccacccagccagaatcattgttccattctcgagacagatctgacttagagccatctccgttgaggcaggctaagccaattgccgaccttcacgctgcccaaagattcttgagccgctacggttggtctggggtgtgggccgcttggggtccctctccagagggcccaccagaaactccaaaaggcgcagccctggctgaggccgtccgcagattccagcgggctaacgcgcttcccgcaagcggcgagttagacgccgctactttagccgcaatgaatcgaccacggtgtggggttcctgacatgaggccacccccaccctccgccccacccagccctccaggcccaccaccacgtgccaggtcacggaggagtccccgagcgcctttgagtttgtctcgtagaggctggcagccacgcggttatcctgacgggggagctgcccaagccttttccaagaggaccctgagctggaggctactaggtgaagcactgagttcccagttgagcgtggcagatcagcgcaggatagttgcgctggcctttcgtatgtggtcagaggtgacacctctggacttccgtgaggatttagcggcacctggggctgctgtggatataaaattgggctttggcagaggacgccacctcggttgtcccagggcatttgatggttctggccaggaatttgcgcatgcgtggcgtctgggcgatatccattttgatgacgacgagcatttcactccccctacctccgatactggcatttcactcctgaaggtggccgtgcacgaaattgggcacgtcctcggtttgccccatacctacaggaccggttctataatgcagccaaattacatccctcaggagcccgctttcgagctcgactggtcagaccgtaaagccattcaaaaactgtacggcagctgcgaagggtctttcgatacagccttcgactggatccgcaaggagaggaatcagtacggagaggtgatggttcgcttctcaacttattttttccgcaattcttggtattggctctatgagaatcggaacaacaggacccgttacggggatcctattcaaatcctgacaggatggccaggaattcccactcataatatcgatgctttcgtgcacatttggacgtggaagagggacgaacggtacttttttcagggtaaccaatattggagatatgatagtgacaaggatcaggcccttactgaagacgagcaagggaaatcctaccccaagctaataagtgagggattccccggtattcctagcccgctagatacagctttttatgacaggcgacagaagctcatctacttttttaaggaaagcttggtctttgcatttgatgtcaacaggaacagggtgctgaactcctacccaaaaaggataacagaggtattccccgctgtgattccccagaatcatcccttccgcaacatcgactcagcctattattcctacgcttataatagcattttcttcttcaagggaaacgcatactggaaagttgtaaacgataaagataaacagcagaacagctggctgccggctaatggattgttccccaagaaattcatatctgagaagtggtttgatgtttgtgacgtacatatatctaccctgaatatgtag

SEQ ID NO: 5105 - DNA, 1173 bp, Artificial Sequence
  Description of Artificial Sequence: Synthetic coding sequence
atggggagaggtgcacgcgtaccgagcgaggccccaggtgctggcgtggaaagacgctggctcggcgctgcgctcgttgcactgtgccttctgcctgcccttgtgctgctggcgaggttaggcgctcctgccgtgccagcttggagcgccgctcagggcgacgttgccgcattgggattgtcggccgttcctccaactagggtacctgggcctctggcacccaggagaaggagatatacccttacacccgctcgcctccgctgggaccatttcaaccttacctacagaatcctctcctttcctagaaacttactgtctcctagagagaccagacgggctttggccgcagccttcagaatgtggagcgacgtaagtcccttctcctttcgcgaggtggcgcctgagcaaccatcagacttgcgaatcgggttctatcccatcaatcacactgattgcctggtctcagctctgcaccattgtttcgatggtcctaccggcgaattagcacacgcattcttcccgcctcatggtggcatccattttgatgattctgaatattgggttttggggcctacaagatattcatggaagaagggcgtgtggctgactgacttggtccacgtcgccgcacacgaaattggacatgctttgggactgatgcactcccagcatggacgtgcattaatgcacctcaatgcgacgctgagaggctggaaggccctttctcaagatgaactgtggggactgcaccggttgtatggctgcctcgatcggctattcgtttgcgcgtcctgggcgaggaggggattttgcgatgccagacgtcgcctgatgaagcgcctgtgcccttcgtcctgcgacttttgctacgagttccccttccccacagtcgccacaactccccctccaccgcgtacaaaaacccgcctcgtcccagaaggcaggaatgtgactttccgctgtggacagaagatccttcacaaaaaaggcaaggtgtattggtataaggatcaggagcccctggaattcagctacccgggttatctggccttaggagaggcccatctcagtattatcgccaacgctgtgaacgagggcacctacacttgcgtcgtaaggcgtcagcaacgcgtcctgacgacgtactcttggagggtacgggtgcgcggatag

SEQ ID NO: 5106 - DNA, 1161 bp, Artificial Sequence
  Description of Artificial Sequence: Synthetic coding sequence
atgggcagaggggcaagggttccatcggaggccccaggggctggagtggagaggagatggctgggcgctgcgctggtggcgctctgtctgctccccgctctcgtcctgcttgctagacttggtgcccctgctgttcctgcttggtctgccgctcagggcgatgttgccgctctgggcctgtcagctgtgccaccgacccgggttccgggaccgttagcacctcggaggcgtaggtacacgctcacaccggcaagactgcgctgggaccattttaacctcacttataggattctctcatttccacgtaatcttctttctcctagggaaacccggagagccctggccgcagctttccggatgtggtccgacgtttcaccattttccttccgggaagtcgccccagagcagccctccgatttaaggattggcggtcgccctcctccccctcgtcccggaccggctcgacccgcatcacagccacgagctccacccaggctcttgccagatcagcctcacgggctgccgggactgagagccgctcccctgcttagacggccacacggaggtgctggaccacggctgcttccgcctgccagacggcaccctctcagacgccagcgagtcctcggtcccggtccgcacgcactgcagctcgaagaaagaagagtggcacacggtcccggagcacggggaggaccaagggatagaccacgggctggtccagacgccctgacaaccagacctggtgcccacgcccctgagaggcatgctgccaggctcgaaggcgtggtgcctggcagggcagtaggcgctgctccagcgttgcggatgcctagacaggccgttcgggtcagggtattgggcgctgagggcctgttgcgcaggagccccgctgctcatgaagaagcgctgccacagcagctgcgcctcctgcttcgtattcctctgccacacggaggccaccacccaacagcgccacaggatcagaatcaagctggagccaggggccaggaacgcgacctcccactgcgacctgaggatccgcctcaagagagggagagcgtcctggttcaggggcctggagctccaggcgttctccttcccaggctaccaggccctgggcgtggcgcaccagaacatcaccgacagcggagacagtag

SEQ ID NO: 5107 - DNA, 1293 bp, Artificial Sequence
  Description of Artificial Sequence: Synthetic coding sequence
atgggccgtggcgcacgagtgccatctgaggccccaggcgcaggagtcgagaggcgatggctgggagcggcactcgtcgccctgtgtctcctgcctgctctggtcctgcttgctagactaggagcccctgcggttccagcatggtcggccgcacagggagacgtggctgccctcggtctttctgccgtgcctccaactcgggtgcccggacctctggcacctaggcggaggcggtacacgctgacacccgcaagattgcggtgggaccactttaacctgacatatcgtatcctgagctttcctagaaaccttctgagccccagagagactagaagggccctggccgcagccttcaggatgtggtccgacgtctcccccttttcttttagggaggtggccccagaacagccctcggatctgagaattggtttctaccctattaaccatacagactgcttggttagcgcactgcatcactgtttcgatggcccaacaggcgagttggcccatgcctttttcccccctcacggcggaattcactttgatgacagtgaatactgggtgttgggtcctacccggtattcatggaagaaaggagacaggccaggttcatggaggcctctcctgtgtagcaccgtcgggtgcagaggcagggcactgggccaaacggcagggggaacatttcggggaggaggctgtcactggtctctggccggagtttggctgaccgatctggttcacgttgcagcccacgagatcgggcacgctctgggactgatgcacagccagcacggtcgcgcactgatgcacctgaacgccactctccgaggttggaaagcgttgtcgcaagatgagctgtggggactccacagactgtacgggtgcctcgatcgtctgtttgtgtgtgcatcttgggcaagacgcggattctgtgacgccaggcgtcgactgatgaaacgactgtgtccttcatcttgtgatttctgttacgaatttccctttcctacagtagccaccacgcctcctcctcccagaacaaagaccaggctggtcccggaaggacgtaatgtgactttcagatgtggtcaaaaaatcctgcacaagaaaggcaaagtttattggtacaaagatcaggaaccgctggagttctcgtacccagggtacttggcgctgggggaggcacacttaagcattatcgccaatgccgtcaatgagggcacgtatacctgcgtcgtccgacgccagcaacgagtgttaactacttattcttggcgcgttagggtaagaggctag

SEQ ID NO: 5108 - DNA, 717 bp, Artificial Sequence
  Description of Artificial Sequence: Synthetic coding sequence
atgggaagaggagctcgggtgccctctgaagctccgggagctggggtggagcgtcggtggttaggggctgccctcgtcgccctgtgtctgctgccagctctcgtactgctggcacgccttggggctcctgccgtaccagcctggagtgcagcacagggagacgtagcggcactgggtttgtccgctgtccctcccactagagtgccgggacccttagccccacgaaggcgcaggtataccctcactcccgctcggctgcggtgggatcacttcaacctgacctacagaatcctctcattccccaggaatctattatcccctagggagacaaggcgagctctcgccgcagctttcagaatgtggtccgacgtaagtcccttttccttcagggaagttgcccctgagcaacccagcgacctccgaataggattttatcctatcaatcacaccgactgcctggtgtcagccctccatcactgtttcgacggcccaaccggggaactggctcatgccttctttccaccacatggcggtatccactttgacgactccgagtactgggtgctaggccctacaagatactcctggaaaaagggcgacaggcctgggtggccccctggagggctcagctctgccgctcagtgggctgcggctgtcggcctgtgggggaggcggcaggaggggccttcgggcgtcgttgctgcgacaggcgtatag

SEQ ID NO: 5109 - DNA, 1938 bp, Artificial Sequence
  Description of Artificial Sequence: Synthetic coding sequence
atgccgaggagcagaggaggaagagcagcccctggaccccctccaccgcctcctccccctggacaggcgcctaggtggtctagatggcgagtgcctgggagactgttgctcctgcttctccccgctctctgttgtctaccgggagctgccagggccgctgcggctgcggctggggctgggaatcgggctgctgtggccgtggcggtggccagggccgacgaagccgaagcaccctttgctggccagaattggttgaaaagttatggctacctgctgccatatgatagtagggcctccgccctacactcagccaaagctttgcagtccgcagtgtcaaccatgcagcagttttacggcatacctgtgaccggcgtgctagatcagaccactatagaatggatgaagaagcccagatgtggggttcctgaccacccacacctttccaggagacgacgtaacaagagatacgcactgactggccagaagtggcgacagaaacatatcacatattccatccacaattacactcccaaagttggagagctggacacgagaaaagcaataagacaagcctttgacgtgtggcagaaagtgacaccgttaaccttcgaggaagtcccttatcatgagatcaaaagtgatcggaaagaggcagacattatgatcttctttgctagtgggttccatggcgatagtagcccttttgacggcgaaggtggctttctggcccacgcctatttccctggccctggaatcggcggagacacacactttgactccgatgagccttggacgctcggcaacgcgaaccacgacggcaacgacctctttctagtggcagtgcacgagcttggtcatgctcttggtttggagcattctagcgacccgtctgccattatggcgcctttctatcagtacatggaaacccacaacttcaaactgccccaggacgatcttcaaggcattcagaaaatctacggacctccagcggagcccctggaaccgactcggcctctgcctactttgcccgtgcggaggatccattccccgagcgagagaaaacatgagcgccagccaagaccccctcgccctccccttggtgaccgacccagcactccaggtaccaagcctaacatttgtgatggaaactttaacactgtggctttgtttaggggagaaatgtttgtatttaaggaccgatggttttggcgcctccgcaataaccgcgtccaagaaggatatcctatgcaaattgagcagttctggaaaggcctgccggcaagaattgacgcagcttacgaaagagccgacggaagatttgtcttcttcaagggcgacaaatattgggtgttcaaggaggtgaccgtggagcccggatatcctcacagtctcggggagctgggtagctgtctacctcgggagggaatcgatactgcccttagatgggaacctgtgggaaaaacctatttctttaaaggagagcgctattggcggtatagtgaagagcgaagagcgacggaccctgggtaccctaagccgatcacagtctggaagggaataccccaggcaccacagggtgccttcatttctaaggaaggttattacacctacttctacaaaggcagggattattggaagttcgacaatcagaagctgtcagtcgaacctgggtatccacgtaatatcctgagggattggatgggatgtaatcagaaggaagtggaaaggaggaaggagaggcgcttgcctcaagatgacgtggatatcatggtaactatcaatgatgtcccaggtagtgtgaatgccgtggccgttgtaatcccgtgcattctaagcctgtgtattctagtgctggtttataccatcttccagtttaagaacaaaaccggaccccaaccagttacttattacaaacgaccagtccaggagtgggtgtag

SEQ ID NO: 5110 - DNA, 1782 bp, Artificial Sequence
  Description of Artificial Sequence: Synthetic coding sequence
atgcctcggtctcgagggggacgcgctgcccctgggcctcctttggctgtggctcgagccgatgaggctgaggcaccttttgccggtcagaactggctgaagtcttatggctaccttcttccttacgattcacgcgcttctgccctgcatagcgccaaagctcttcagagcgcagtgagcaccatgcagcagttttacggtatacccgtgaccggtgtgcttgatcagacaacaatcgaatggatgaagaagcccagatgtggggttccggaccatcctcatctgtcgcggaggcgcagaaacaagcgttacgcactgactggccaaaaatggcgtcagaagcacatcacttactccattcacaattatacgccaaaggtgggggaattggatacacgcaaggccatcaggcaggcctttgatgtgtggcaaaaggtgactccgctgacgtttgaagaagtgccatatcatgaaataaaaagtgatcggaaggaagccgatatcatgatattttttgcatcaggtttccacggggatagtagccctttcgacggtgaagggggatttctggctcatgcctatttccctggtcccggtatcggcggtgacactcattttgactctgatgagccatggacccttgggaatgcaaatcatgatggtaacgatttgtttctcgttgctgtccacgagttggggcatgcactagggctcgagcacagctctgatccctcggctataatggcccctttttatcagtacatggagacccacaatttcaaactcccacaggacgatctgcagggaatccaaaaaatctacggaccccctgcagaaccgctggagccgacccgcccactgccaaccctgccagtcagaagaatccatagtccatcggagcggaagcatgaaaggcagccgaggcccccacgcccaccattgggcgaccggcctagcacccccggtaccaagcctaatatatgcgatgggaatttcaatacagtggcattgtttcgaggggagatgtttgtcttcaaggaccgttggttctggaggttacgaaataaccgagtgcaagagggttatccgatgcagatcgaacagttttggaagggccttcctgcccgaattgacgccgcatacgagcgcgctgacggcaggtttgttttcttcaagggtgataaatattgggtgttcaaggaagtcactgtggagcccggatatcctcactctctgggcgagctaggctcctgtctccccagagagggcatagatactgctctacgctgggagccagtaggaaaaacctacttcttcaaaggagagcggtattggcgctacagtgaagaacgcagagccacggaccccggttacccaaaacctatcaccgtgtggaaaggtattccgcaggccccacagggcgcttttatctctaaggagggttattacacctatttctacaaaggcagggactattggaagtttgataatcagaagctgagcgtcgaaccaggatatccccgaaatatcctgcgcgattggatgggctgcaaccaaaaagaggttgaacgcaggaaagaacgtagactacctcaagatgatgtggatatcatggtcactatcaacgacgtccccggatccgtaaatgctgtcgctgttgtgattccatgcatccttagcctttgcatcttagtgctcgtctatactattttccagttcaaaaataagacgggtccacagcctgttacgtactataagcgtcccgttcaggaatgggtgtag

SEQ ID NO: 5111 - DNA, 561 bp, Artificial Sequence
  Description of Artificial Sequence: Synthetic coding sequence
atgtcacctgccgatccgggaaccgttgctacaatgcgcaagccccgatgtagtctgcctgacgtgctgggggtcgcgggactggttagacgcagacgccgatatgcactgagcggaagtgtatggaagaaacggactctgacctggcgtgtgagaagctttccacagagttcccagctgtcacaggagacagttagggttctcatgtcttacgccctgatggcctggggcatggagtcgggactgaccttccacgaagttgactcacctcagggccaggagcctgacatattgatcgactttgctagagcattccaccaggactcatatcccttcgatggcctgggaggcacattggctcacgcattcttcccaggcgaacatcctatcagcggtgacactcacttcgacgatgaagagacctggactttcggttccaaagctagccaacagcttgaacaggaattggctggtggctccccagtcgacgaggaacttggcttctcccgcggttggagagtcaaccctctcggccctggcagcccggaaagactgtcctag

SEQ ID NO: 5112 - DNA, 1689 bp, Artificial Sequence
  Description of Artificial Sequence: Synthetic coding sequence
atgcgtctccggttgcggctcctcgctctccttctattgttactcgcccctcccgctcgtgccccaaagcctagcgcccaggacgtttcgctgggcgtcgattggttgacaaggtacggatacctaccacctccacatccagcgcaggcacagctccagagtcctgagaagctaagggatgctatcaaggtgatgcagaggtttgctggtctccctgagacaggcagaatggatcctggcaccgtggctacaatgaggaaaccacggtgctccttgcccgacgtattgggggtggccggattagttagaaggcggaggcgctacgcactgtctggtagtgtatggaagaagagaactttgacttggcgcgtcagatccttcccacagtcctcacagctgtctcaagagactgtgcgtgtcctgatgtcatacgcactgatggcttggggtatggaaagcggactcacgttccacgaggtggactccccccagggacaggagccagacatccttattgattttgcgagggcttttcaccaggacagttatcccttcgatggactggggggtacactggcccatgcctttttcccaggggaacatcccatctccggggacacccattttgacgatgaggagacatggacatttggctctaaggatggcgagggtacggacttgttcgccgttgctgtgcatgaattcggacacgctttaggattgggacactccagcgccccaaatagcatcatgcgccctttttatcaggggcctgtgggggaccctgacaaataccgcctgtcgcaggacgatcgagacggactccagcagctttacggtaaggctccacagaccccctacgataaacccaccagaaagcctctggctccaccgccacagccccctgcttcacccacacactctcctagttttccaatacctgaccgctgcgagggcaatttcgacgccatcgccaacatccgcggagaaacattttttttcaagggtccttggttttggcgactgcagccatcgggccaacttgttagtccaaggcctgcacgccttcataggttctgggagggccttccggctcaggtaagagtcgttcaggccgcttacgctcgccatagggacggtcggattctgttgttctctggtcctcagttctgggtgttccaagaccgccagctggaaggaggggcacggccactcaccgagcttgggctaccccctggagaggaagttgatgccgtctttagctggccacaaaatggcaagacatacttagtccgcggtagacagtactggcgctacgatgaggccgctgccagaccagatcccggatacccacgagacctttccctttgggaaggggcaccaccctccccagacgacgtcacagtatcaaatgctggagacacatatttcttcaaaggggcacattactggaggttccctaaaaacagcatcaagaccgaaccagacgcacctcagcccatgggaccaaactggctcgattgtcccgctcccagtagcggaccgcgagcccctcgacctccgaaggcaacacccgtttccgagacctgcgattgtcagtgtgagctaaaccaggctgctgggagatggccagcacccattcctttgcttctgttacccctgctggtgggcggagttgctagccggtag

SEQ ID NO: 5113 - DNA, 786 bp, Artificial Sequence
  Description of Artificial Sequence: Synthetic coding sequence
atgcagctggtaatactccgtgttacaatatttctgccttggtgctttgctgtgcctgttccacccgcagcggaccacaaaggttgggatttcgtggagggctactttcaccagttttttttgaccaagaaagaatcgccacttctgacccaagaaacgcagacacagcttcttcagcaatttcatcgtaacggcactgatctgctcgatatgcaaatgcatgctctgctgcaccagcctcactgtggagtccccgatggatccgatacctctatcagcccagggagatgcaaatggaataaacacaccctgacataccgtattattaactatccacatgacatgaaaccatcagcagtgaaagattccatttataacgctgtgtctatctggagcaacgtaacacctcttatcttccagcaggttcagaacggtgatgccgatattaaagtgtcgttctggcagtgggcacacgaggatgggtggccatttgacggtcctggtggcatacttggccatgcattcctgcctaactcagggaatcctggtgtagtacactttgacaagaacgagcattggtcagcttcagatacaggttataacctgtttctggtggcaacccatgaaatcgggcatagcctgggtctccagcattccggcaatcagagctcaattatgtatcccacgtattggtatcacgatccaagaacgtttcagctcagcgcagatgatattcagagaatacagcatctgtatggcgagaaatgtagttctgacatcccgtag

SEQ ID NO: 5114 - DNA, 786 bp, Artificial Sequence
  Description of Artificial Sequence: Synthetic coding sequence
atgcaactggtgattctgcgcgttactatttttttaccctggtgctttgctgtcccagtccccccagctgcggatcacaaggggtgggatttcgtggagggttacttccaccagttctttctgactaaaaaggagagccctctgttaacccaagagactcaaacccagctgttacagcagttccaccgcaacggaacagatctgttagacatgcagatgcatgccctgctgcatcagcctcattgcggcgtacctgacggttccgacacttccatctccccaggtaggtgcaaatggaataaacatacactgacctaccggattataaactacccccatgacatgaagccctccgcagtcaaagactcaatctataacgctgtgagcatctggtctaacgtcactcctctgatttttcagcaggtgcagaatggagatgccgacataaaggtgagtttctggcaatgggcccacgaagatgggtggccatttgatggacccggtggaatcctggggcatgcgttcctgcccaattcgggcaatcctggcgttgtgcattttgacaagaacgagcactggagcgcctcagatactggctataatctgttcctggtcgctacgcacgagattggacacagcctcgggcttcaacatagtggcaatcagagcagcataatgtacccaacatattggtaccacgatcccaggaccttccagctgagcgccgatgatattcaaaggatccagcacctgtatggggagaaatgttcctccgatatcccatag

SEQ ID NO: 5115 - DNA, 1542 bp, Artificial Sequence
  Description of Artificial Sequence: Synthetic coding sequence
atgaagcggcttctgctgttattcttattcttcataacttttagctctgctttccctcttgtgagaatgacggagaatgaggaaaacatgcagcttgcccaagcctacctgaatcagttctactccttagaaatcgaggggaatcacctggttcagtccaagaacaggtctctgattgacgacaagatccgcgagatgcaggctttttttggcttgaccgtgacagggaagctggactcaaacacgctcgagatcatgaaaaccccccgttgcggcgtgccggatgtgggccagtacgggtacacactgccagggtggcgtaaatacaatcttacctatcgcatcattaactacacacctgatatggcccgtgcagccgtcgatgaggcaatccaggagggattggaggtgtggtcgaaagtgactccattgaagttcaccaaaatatccaagggaattgcagacattatgattgccttccgcacgagagtgcatggcaggtgcccccgttatttcgacggccctttgggtgtgctcggacacgcattccccccaggcccagggctcggaggggatacccacttcgatgaggacgaaaactggacaaaggacggggcaggcttcaatctatttctcgtcgctgctcacgagttcggacacgcactcggcctgagccacagtaatgaccagaccgcactgatgttccctaactacgttagcttggatccgaggaaataccccctatcccaggatgacataaacggcattcagtcaatctatggcggactgcccaaagaaccggcaaagcctaaggaacctacaatccctcatgcatgcgatccagatttgacctttgatgctatcactacctttcgcagggaagtcatgtttttcaagggacgccatttatggcgaatttattacgacatcaccgatgtggaattcgagttgatcgcttcattttggccaagcttgcccgctgaccttcaagcagcttacgaaaaccctcgggataagattctcgtcttcaaagacgagaatttctggatgattcggggatatgccgtgctccccgattacccgaaatctatccatactctggggtttccaggcagagtcaagaagatagatgccgctgtttgcgataaaactacaagaaagacatacttcttcgtaggaatatggtgttggcgcttcgatgaaatgacccagacaatggacaagggatttccgcagcgcgtagtgaagcacttccctggcatctcgattcgggtcgatgcagcttttcagtataagggtttctttttcttcagcagaggctctaagcagtttgagtacgacatcaagacaaaaaacattacgcgcataatgcgtaccaatacctggttccagtgcaaggaacccaaaaactctagcttcggatttgatatcaacaaagagaaggctcactctggcggtatcaaaatcttgtatcacaaatctctttccctgtttatatttggtatagtgcacctgctgaaaaacacatcaatctaccaatag

SEQ ID NO: 5116 - DNA, 393 bp, Artificial Sequence
  Description of Artificial Sequence: Synthetic coding sequence
atggtggcccgtgtcgggctcctccttcgcgcactgcagctgctgctgtggggccaccttgacgctcagccggcagaacggggtggacaagaactgcgcaaggaggccgaggccttcctggagaagtacggctatcttaacgaacaggtccccaaggccccaacgtccacacgattcagtgacgcaattcgggcttttcagtgggttagtcagctccctgtctcgggagtgctggaccgtgcgacactgcgccaaatgacgagacctagatgtggagtcaccgataccaattcgtatgccgcatgggcagagcggatctccgatctgttcgcaagacatcgcactaagatgcgcaggaaaaagcgtttcgctaaacagggagaacattgctag

SEQ ID NO: 5117 - DNA, 1560 bp, Artificial Sequence
  Description of Artificial Sequence: Synthetic coding sequence
atggtggccagggtcggtctgttgctcagggcgctacagttactgctgtgggggcatctagacgcacagcctgcggaaagaggagggcaggagctacggaaagaagccgaagcattcttagaaaagtacggatatctcaatgagcaagtgcctaaggcgcctacaagtacacgattcagcgacgcaatccgagcctttcagtgggtatcacaactacccgtgtcaggtgtcttggaccgggctacactccgccaaatgactagacccaggtgcggagtgaccgacacaaactcctacgcagcatgggccgagcggatctccgacctgttcgcccgacatagaacgaagatgaggaggaagaagcgatttgctaaacaaggcaataaatggtacaaacaacacctcagctacagattggtgaactggcctgagcatccagagccagcagtaagaggcgctgtgcgcgcagctttccagctgtggagcaacgtctctgccctggagttctgggaggccccagcaacaggccctgcagatatacgcctgacgttcttccagggtgaccacaacgacggtctggggaatgctttcgatggcccaggtggtgctcttgcccacgcttttttgccccgacgaggagaggcgcactttgatcaggatgagcgatggtctcttagccgtcgcaggggccgtaacctatttgtagtactggcacacgagattggccacactcttgggctgactcactctcctgcccctcgagctcttatggcaccttattataagagattagggagggatgctcttctgtcttgggacgatgtgctggctgtgcagagcctctacggcaagccattgggtggttctgtagctgttcagttaccaggaaaactgttcaccgactttgagacttgggactcatacagcccccagggccgtcgaccagagacacagggccctaaatattgccattcctcctttgatgccatcaccgtggatcgtcagcagcagttgtatatcttcaaaggcagtcacttttgggaagttgccgcagatggcaacgtgtccgagcctcggcctttgcaggagcgctgggttgggcttccgcctaatatagaggccgcagctgtgtcactgaacgacggagatttttatttttttaaaggaggacgatgttggagatttcggggaccaaaacctgtctggggactgccacagctctgccgagccggtggcctccccaggcatccagatgcagcactctttttccctccgctgcggcgactaatcctgttcaaaggtgctcgctattacgtcctggctcgaggagggctgcaggtggagccatactaccctcggagtttgcaagactgggggggaatccctgaggaagtgtctggcgctctaccgcgaccagatggctcaattatcttcttcagggacgatcggtattggcgactggatcaggccaagctgcaggcaacaacatctggtagatgggcaactgagctaccctggatgggctgttggcatgcgaactcaggctccgcgctgttttag

SEQ ID NO: 5118 - DNA, 1179 bp, Artificial Sequence
  Description of Artificial Sequence: Synthetic coding sequence
atggttgcacgcgtcggactgctgctgagggctctgcaactgctgctgtggggccacctggacgcccaaccagccgaacgagggggacaagagctgaggaaagaggcagaggcattcctggagaagtacggctaccttaatgaacaggtgcctaaggccccaacttccacaaggttctctgacgcaatccgagcattccagtgggtttcccagcttccagtgtcaggggtactggaccgagctactctgcgacagatgacccgccctcgatgcggggttacagatactaactcttacgccgcatgggcggagcgcatcagcgacctgtttgcaagacaccggacaaagatgcgtcgaaagaagagatttgccaagcaggggaacaagtggtacaaacagcatctatcctacaggctggtgaattggccagagcaccctgaaccagcggttaggggcgctgtgcgcgcagcctttcagttgtggagtaacgtttcagctctggagttctgggaagccccagcaacgggacctgcggacattcggttgaccttctttcaaggggatcataacgacggcttaggaaatgcatttgacgggcctggaggagccctcgcgcatgcttttctccctcgcagaggggaggcccacttcgaccaggacgaacgatggtcactgtcaaggcgaaggggcagaaacctgtttgtggtcctagctcacgagattggacataccctcgggttaacccacagcccagctccgagggccctaatggctccctactataagcgacttgggcgagacgcgctgttgtcctgggacgatgtgcttgctgttcagagtctttacggcaagccgctgggtggctcggtggcagtccagctgcctggcaagttgttcacagactttgagacctgggactcctacagtccacagggcagacggcctgagacccagggtcctaagtactgtcacagcagttttgatgctataactgtggaccgccagcagcagttgtatatcttcaagggatctcatttctgggaagtggccgcagacgggaacgtgtcagaaccaagaccactccaagagcgttgggtgggactgccaccaaatatagaagccgcagcagtgtccctgaacgatggggacttctacttttttaaagttcaaagcgtatag

SEQ ID NO: 5119 - DNA, 678 bp, Artificial Sequence
  Description of Artificial Sequence: Synthetic coding sequence
atggtagccagagtgggcctactgctgagagccctgcagttgctcctctggggacatctggatgcacaaccagccgagagaggcggacaagaactacgtaaagaagcggaggcctttttggaaaagtacggatacctcaatgagcaggtcccgaaggcccctacctcaacaaggttcagtgatgctatcagggctttccagtgggtgtcccagcttcctgtgtcaggggtgctggaccgtgccactttgcggcagatgaccagaccccgatgtggcgtgacagatactaactcttacgctgcctgggctgagcgtatctcggatctgttcgcacgacatagaactaaaatgagacgcaaaaagcgttttgccaagcaggggaacaagtggtataagcagcacctgtcttatcggctagtcaattggcctgagcatctccggagccgccagtttggagcaccatgtgcacctcccagcagttgtggcgctacttcccagcgctggagtagcggcaggccccaaccacaggccccactcaccagtgggtcaccctctagcaaggggaccaccaccatgggctgggctatgcccctgatggctcagggtgcaccctggcggactcccagttgtcctgcggctgctaagcgaacgtcaacgaaaatgagcgccggtccttag

SEQ ID NO: 5120 - DNA, 1404 bp, Artificial Sequence
  Description of Artificial Sequence: Synthetic coding sequence
atgttctccctaaaaactctcccattcttgttgctgctgcacgtgcagatcagtaaagccttccctgtgtcttcaaaggagaagaacacaaagaccgttcaggactacctagagaagttctaccagcttcccagtaatcaatatcagagcacaagaaagaatggcaccaatgttatcgtggagaaattgaaagaaatgcagcgctttttcggactcaacgtcacgggtaaacctaacgaggagaccttggatatgatgaaaaagcccaggtgtggtgtgccagactctggcggatttatgctcacccccggaaaccctaaatgggagaggactaacctgacatatcgcattagaaactacacacctcagctgagtgaggccgaagtcgagcgcgctattaaggacgcatttgagttgtggagcgtggcttctcctctaatcttcactcgtatttctcagggtgaagccgatatcaatatcgctttttaccagagagaccacggcgataatagcccatttgatggaccaaacgggattctagcacatgcctttcagcctggccaaggaatcggtggcgacgcccatttcgacgccgaggagacctggacaaacacctccgcgaactacaacctctttttggttgcagcacatgaatttgggcacagtctagggctggcccacagctctgatcccggtgcacttatgtacccaaattacgcgttcagggaaaccagcaactatagtctgccccaggatgatattgacgggattcaggccatctacggactgtcatccaaccctattcaacccaccggtcccagcacccccaagccgtgtgatcctagtctgacattcgacgcgatcaccactctacgaggcgaaatccttttttttaaggatcgctatttctggcgcagacacccccaactgcagagagtcgaaatgaacttcatcagcctattctggccttccctgccgaccggcatccaggccgcatatgaagattttgatcgggatctaatctttctgtttaaaggcaaccagtattgggcgctgagcgggtacgatatattacagggatatccaaaggacatttctaattatggcttccccagctcggtgcaagctatcgatgcagccgttttctaccggtctaaaacttacttcttcgtgaacgatcagttctggagatatgataaccaacgtcagttcatggagcctggctaccccaagtcaatttcaggtgccttccccggaatcgagagcaaggtggacgccgtcttccagcaggagcacttcttccacgtgttctccggcccacggtactacgcgttcgatctcatcgctcagagggtgacacgagttgcacggggtaataaatggttgaattgtcgatacgggtag

SEQ ID NO: 5121 - DNA, 918 bp, Artificial Sequence
  Description of Artificial Sequence: Synthetic coding sequence
atgcaaaggttctttggcctaaatgtcacaggcaaacctaatgaagaaaccctggatatgatgaagaaacccagatgcggagtaccagattctggcggtttcatgctgacccccggtaaccccaaatgggaaagaacaaatctaacctacaggattcgcaactacaccccccagcttagtgaagcggaagtcgaaagagcaatcaaagatgccttcgaactttggtctgtagcttccccactgattttcaccagaattagtcagggagaggcagacattaacatagcattctaccagagagaccacggagataatagtcccttcgatggacccaacggaatcctggcacacgcctttcagcccggtcaagggattggtggagacgctcactttgacgctgaagagacctggaccaacacctctgccaactacaatctgtttctggtggctgcccatgaattcggacacagcctcggcctcgcccacagttcagatccaggcgctcttatgtacccaaactatgcttttagggaaacgagcaattactctcttccgcaagatgatatcgacgggatacaggctatttatgggctcagctccaaccctattcagcccaccggcccatccaccccgaaaccctgcgacccaagcctgaccttcgacgctatcacaactcttagaggggaaatcttgttcttcaaagatagatacttttggaggcgacatcctcaactgcaacgtgttgagatgaactttatcagcctgttttggccaagtctgcccacaggaattcaggctgcatatgaagactttgatcgggacttgatcttcttgttcaaggacatgatcactaaagataatagctggtcccaggtgatacccaaggcttatcaggtaccatttcggaatagggagtag

SEQ ID NO: 5122 - DNA, 1284 bp, Artificial Sequence
  Description of Artificial Sequence: Synthetic coding sequence
atgcagcagatcccacaagagaagagtatcaatgactatcttgagaaattctaccagctccctagtaaccaataccagtctacgagaaagaatgggacaaacgtcatagtggagaagttgaaggaaatgcaacgctttttcggtctgaacgtaacgggtaaaccaaacgaagagactctagatatgatgaaaaagccacgttgcggcgttcctgactcaggagggttcatgctcaccccgggtaatcccaaatgggagagaacaaacctgacataccggatcaggaactacactccacagctgtcagaggccgaagttgagcgggctattaaggatgcgttcgaactgtggagcgtcgcgtcacctctgatatttaccaggatttcgcaaggagaggcggatattaacatcgctttctaccagagagaccacggtgacaatagtcccttcgatggtcccaacgggatcctcgcacacgcattccagccaggtcaaggaatcggcggagatgcccacttcgacgccgaggagacttggacaaatacctccgcaaactacaatctgtttctagtagccgctcacgagttcggacattcacttggccttgctcacagcagtgacccgggagccctcatgtacccaaactatgcttttcgggagacttcaaattacagtttacctcaagacgatattgatggcatacaggcaatttacggactctcttccaatcccatccagcccactggcccatcaacccccaaaccgtgcgatccttcacttacattcgacgccatcacaacactgcggggagagattctcttcttcaaggaccgctacttctggcgtcgtcatcctcagttgcagcgagtggagatgaatttcatttctttgttttggccctccctacccaccgggatacaggctgcatatgaggacttcgatcgcgatctgatcttcttgttcaaaggaaaccaatactgggcactctccggctatgacatcctccagggctatccgaaggatatttccaattacggctttcctagctccgtacaagccatagatgctgctgtgttttatcgatccaagacatacttcttcgtgaatgaccaattctggcgttacgacaaccagagacaattcatggaacctggttaccccaagtctataagtggagcattcccgggaattgaaagcaaggttgatgctgtgtttcaacaggaacacttcttccatgtcttttcgggacctaggtattacgccttcgatctgatcgcgcaatag

SEQ ID NO: 5123 - DNA, 954 bp, Artificial Sequence
  Description of Artificial Sequence: Synthetic coding sequence
atggcggttcaggggtcccagcggcgtctcctggggagcctcaattctactcctactgccatcccacagctgggactagcagcaaaccagacaggtgctcgctgcctggaggtgtctatctccgacggtttgttcctctctctgggactggtgagcttagtggagaatgcattggtcgtggctacaatcgcaaaaaatcgaaacctccattcccctatgtactgcttcatatgttgtttggcgctgtctgatctgctggtgagcggctcaaatgtgctggagaccgctgtcatccttcttctcgaagccggagccctggtggccagggccgcagtgctgcagcagttggataatgtcattgacgtgataacctgttcgagcatgctgagtagcctgtgcttcctgggagctatagcagtggatcggtatataagtattttttatgcactcagataccacagcatagtcacactgcctcgggctcggagggccgtagcggctatttgggtggctagtgtggtctttagtacactgttcatcgcctactatgatcatgtcgcagtccttctctgtctggttgtgttttttctcgccatgttagtcctgatggcagttctgtacgtgcacatgcttgctcgtgcctgccagcacgcgcagggaatcgcccgtcttcacaagaggcagcggccagtgcaccaaggattcggactcaagggtgctgtgacgctaaccatattgttaggaatctttttcctgtgttgggggccattttttctgcacctcacactgatcgtactttgccctgaacaccccacctgcggatgcatctttaaaaacttcaacctgtttttggccctgattatctgcaatgctataatcgatcccttgatttatgccttccactctcaagaattgagaaggacactgaaagaagtacttacctgtagctggtag

SEQ ID NO: 5124 - DNA, 894 bp, Artificial Sequence
  Description of Artificial Sequence: Synthetic coding sequence
atgaaacacattattaacagctacgagaatatcaataacaccgctcggaacaatagcgattgccctcgggtggtactaccagaagaaatctttttcactatcagtatcgtcggggtgctggagaaccttatcgtgcttctcgcagtctttaaaaacaagaacctgcaggcccctatgtactttttcatctgctccctggctatcagcgatatgcttggatcactatacaagatccttgagaatattctgatcattctgcgtaacatggggtacctgaaacctagaggctccttcgagacgacggcagacgacattatcgacagcctctttgttctgtccctccttggcagcatcttttctctgagcgtgattgccgctgatcggtatatcacaatctttcatgcactgagatatcacagcatagtgacgatgcggcgaaccgttgtggtgctgacagtgatttggacattttgcacaggcaccggaattacgatggtgatcttcagccatcatgtccctaccgtaattacctttacgtccctcttccctctcatgctggtgtttatcctatgcctatacgtgcacatgttcctactcgccaggagccacacgaggaagatcagcactctccccagggctaacatgaagggagcaatcacgctaacgatcctactcggagtttttatcttctgttgggctcctttcgtcttgcacgtgttactgatgacattttgcccttccaatccttactgtgcttgctacatgagcctgtttcaggtcaatggtatgctcatcatgtgcaatgccgtgattgacccttttatttatgccttcaggtcccccgaactgagagatgcatttaaaaagatgattttttgtagtagatactggtag

SEQ ID NO: 5125 - DNA, 894 bp, Artificial Sequence
  Description of Artificial Sequence: Synthetic coding sequence
atgaaacatattataaattcgtatgaaaatatcaacaatacggccaggaataacagcgactgcccgagagtggtgctcccagaggagatttttttcactataagcatcgtgggggtccttgaaaatctgattgtgttgctggcagtctttaaaaacaagaacctgcaggctcccatgtacttctttatctgctcgctcgccatttcagacatgctgggcagtctctataaaatactcgagaatatcctgattatccttcgaaacatgggctacttaaaaccccgtggatcattcgagacgaccgcagatgacatcatcgatagcctttttgtgctgagcttacttggctctatttttagtctatctgttatagccgcagacaggtacattactatttttcatgccctgagatatcacagtatcgtcactatgcggagaaccgtagtcgtgctgaccgtgatctggacgttttgtactggcactggaattaccatggtcatctttagccaccatgtgccaaccgttattacatttacaagtctctttcccctgatgctggttttcattctctgtctgtatgtgcatatgtttctgctagccaggagccatacgcggaagatcagcacactgcccagggccaacatgaagggcgcaatcacactgacaatcctcttgggagtcttcatcttttgctgggctccgttcgtgctgcatgtgctgctaatgaccttttgtcccagcaacccctactgtgcctgttacatgagcctgtttcaggtcaatggcatgctcatcatgtgtaatgcggttatagatccattcatctatgcattccgttcccctgaattgagagatgcgtttaaaaagatgattttctgttcaagatactggtag

SEQ ID NO: 5126 - DNA, 972 bp, Artificial Sequence
  Description of Artificial Sequence: Synthetic coding sequence
atgaatgcatcatgttgtcttccctcagtccagccaacccttcctaacggtagcgagcatctgcaggccccattcttttccaaccagagctctagcgcattctgcgagcaggtcttcatcaaaccagaggtgtttctgtccctaggcatagtgtcactcctggagaacatcttggtaatacttgccgtcgttcgcaacggcaacttgcattctcccatgtacttcttcctctgttccctcgccgtggccgatatgctggtatcagtgagtaacgccctggaaactattatgatcgccatcgtccacagcgattacctgacattcgaagatcagttcattcagcacatggataatatttttgatagcatgatctgtatatctctcgtcgcttctatctgtaaccttttggcgattgctgtcgatagatacgtgaccatcttctatgctttacgttatcactcaatcatgacagtgaggaaggcactgactctgatcgtggccatttgggtatgctgtggtgtgtgcggtgtggtctttatcgtttatagcgaaagcaagatggtcatagtttgtctgattaccatgtttttcgctatgatgttgcttatggggacgctgtatgttcatatgtttttgtttgccaggctgcacgtgaaacggattgccgcactgcctccagccgacggggttgcccctcaacaacactcgtgcatgaaaggcgctgtgaccattacgattcttctcggcgttttcatcttctgttgggccccttttttcctgcatcttgtgttgataattacttgtcccactaacccctattgcatctgctacactgcccacttcaatacctatctggtccttatcatgtgcaatagtgtcatagaccccctcatttacgcctttcgatccttagaactccgaaatacctttcgggagatcctgtgtggctgtaatggcatgaacctcggatag

SEQ ID NO: 5127 - DNA, 999 bp, Artificial Sequence
  Description of Artificial Sequence: Synthetic coding sequence
atggtgaattccacccacaggggtatgcacactagtctgcacttgtggaacaggagtagctaccgcctgcattccaacgctagcgagtctctggggaagggctactccgacggagggtgttatgagcagttgtttgtatcacctgaagtcttcgttactcttggggttatcagtctacttgaaaacattttggttattgtggctatcgctaagaacaagaatctgcactcgcctatgtacttcttcatatgcagtctcgccgtggcagatatgctagtctccgtgtcgaacggctctgagacaatcgtcattacgttgttgaatagtactgatacagatgcgcagtccttcaccgtgaacattgacaatgttattgactcagtgatatgctctagcctgctggccagtatctgcagcttgttgagcatagcagttgatagatattttaccatcttttacgccttgcagtatcataacatcatgaccgttaagcgtgtgggtatcattatctcgtgcatttgggccgcttgtaccgtcagcggcatcctgtttattatatatagtgactcaagtgccgtgatcatatgtttaatcaccatgttttttaccatgctagccctgatggcctcactctatgttcacatgttcctgatggccagattgcatatcaagaggatcgccgtgcttcctgggactggtgctatccgccagggggcaaatatgaagggggctataaccttgaccattttaataggggtgttcgtggtctgttgggcgcctttcttcctgcatcttatcttttacataagttgcccccagaacccatactgtgtttgtttcatgtctcatttcaatctgtatttgatactgataatgtgcaatagcatcattgatcccctcatctatgcgcttcgaagccaggagctcaggaaaaccttcaaggagattatatgctgctaccctcttgggggtttgtgtgaccttagctcacggtactag

SEQ ID NO: 5128 - DNA, 978 bp, Artificial Sequence
  Description of Artificial Sequence: Synthetic coding sequence
atgaactcttccttccacctccatttcctagatctgaatttgaacgccacggagggaaatctgagtggacctaatgtcaagaataaatcatctccctgcgaggacatgggaatcgcggtagaggttttcctcactttgggcgtgattagcctactggagaatatcctggtcatcggcgcaatcgtgaagaataaaaatttgcacagcccgatgtacttctttgtttgctctctagctgtcgccgatatgctggtgagtatgagcagtgcctgggagactatcacaatttacctactgaataacaaacatctcgtaatcgcagacgcttttgtgagacatatcgataatgtgtttgactctatgatctgtatctctgtcgtggcgtcgatgtgttcactcctcgctattgccgtggataggtacgtaactatattctacgctcttaggtaccaccatataatgactgccagacgatctggagctataatcgccggtatctgggccttttgcaccggttgcgggatagtgtttatcctctactccgagtcaacatacgtgattctgtgcctaatcagcatgttcttcgccatgctgtttctattggtcagtctgtacattcacatgtttcttttggccaggacgcacgtcaaaagaatcgctgctctgccaggagctagctcggcaagacaaagaacctctatgcaaggagctgtaactgtcactatgctcctgggcgtgttcactgtctgctgggcaccttttttccttcacctgaccctcatgctctcctgcccccagaacttgtactgctctcgcttcatgtcacattttaacatgtatttgattcttatcatgtgcaactccgttatggatccactgatatacgcttttcgctctcaggagatgagaaaaaccttcaaagaaattatatgctgccgcggatttagaatagcctgcagcttcccacgacgagactag

SEQ ID NO: 5129 - DNA, 1242 bp, Artificial Sequence
  Description of Artificial Sequence: Synthetic coding sequence
atgcttgaaatgttggagtacaatcactatcaagtgcagacacatctggagaatcccacaaaataccatatccaacaggcgcagagacagcaagttaagcagtacctgtctacaacgctggccaataagcacgccaatcaagttcttagcctaccctgccccaaccagccaggggatcacgttatgcctcccgtaccaggctcctcagcgcctaatagccctatggcaatgctcacattgaacagcaattgcgaaaaggaaggcttctacaaatttgaggagcaaaaccgggctgagagtgaatgtccgggaatgaacacccacagccgcgcttcatgtatgcagatggatgatgtgattgacgatattatcagcctggagagtagttataacgaagaaattttgggcttgatggacccggctctgcaaatggcgaatacactgccagtaagcgggaacctcatagacctgtacggcaaccagggattgccccctcctggactgaccatcagcaacagctgcccagccaaccttcctaacatcaaacgggaattaaccgaatccgaggcgagagcactggctaaagaaagacagaaaaaggacaaccacaacctgattgagcgacgcagacggtttaacatcaacgacagaatcaaggaactggggaccctgatacctaagtccaacgatcctgacatgagatggaataagggaacaatcttgaaggcttcagtggattatatccgaaaactgcagcgagagcaacaacgcgctaaggaattagaaaatcgtcagaagaagttggagcatgccaaccggcacctcctcctcaggatccaagaattagagatgcaggcaagagcgcacggtctatccctaattccaagcactgggttgtgttccccggatttggtcaatcgtattatcaaacaagagcccgttcttgaaaactgcagccaagatttgctccaacatcatgccgatctcacctgtaccactactttggatttgaccgacggtacaatcacatttaacaataaccttggtaccgggaccgaagccaaccaggcatacagtgttccgacgaaaatggggtccaagctcgaggacatacttatggatgacaccctttcacctgtcggcgtgactgatccgctacttagctccgtgagcccaggggcttcaaaaacaagttctaggagatcctctatgtctatggaggagaccgagcacacatgctag

SEQ ID NO: 5130 - DNA, 1515 bp, Artificial Sequence
  Description of Artificial Sequence: Synthetic coding sequence
atggaagcacttagagttcagatgtttatgccctgcagcttcgaaagtctgtacctttcatcagccgaacaccccggagcaagtaagccccctatctcttcctcaagcatgacttcccggattctgctgcggcagcagctgatgagagagcagatgcaagaacaggagagaagagaacaacagcagaagctacaggctgcgcagtttatgcagcagcgagtgccagtctcccaaaccccagccatcaatgtgtctgtgcccacaacattgccaagtgcaacccaggttcctatggaggtcctcaaggtccagacccacctggaaaaccctacaaagtatcacatccagcaggctcagaggcaacaggtgaagcagtacttgagcacaaccctggcaaacaaacacgcaaatcaggtgctctccttgccttgcccaaaccaacctggcgaccatgtgatgcctccagtacccggaagttctgctccaaacagtcccatggcgatgcttactctgaattccaactgtgaaaaagagggattctacaaatttgaagagcagaacagggccgaaagtgagtgtcctggcatgaacactcacagtcgggcaagttgtatgcagatggatgatgtcattgatgacattatcagtctggagtcatcttataacgaggagatcctgggactgatggatcccgcactccaaatggccaatacactgccagtaagtggcaatctcattgacttatacggcaaccaagggcttccccctcccggtttgaccatctctaacagttgtcctgcaaacctaccaaatatcaagcgcgagctcacagagtccgaagcccgagcactagcaaaggagcgtcagaagaaggacaaccataaccttatagaaaggcgtaggcggttcaatataaacgacaggatcaaggaactgggtacgcttatcccaaagtctaacgaccccgacatgagatggaacaagggaacgattctgaaggctagtgtggattatataaggaagcttcagagggagcagcagcgggcaaaggagctcgaaaacaggcaaaaaaagcttgaacacgccaatagacacttgctcttgcgcatacaggagttggagatgcaagcacgcgcacacgggttgagcctgattcccagcactgggttgtgttctcccgatcttgttaatagaatcatcaagcaagaacccgtgctcgagaactgttcacaggatctcttgcagcatcacgcggatctaacttgcacaaccacactggacctcactgatggcaccattacattcaacaataacctgggcactggcaccgaggctaaccaagcgtacagcgtgcctacaaagatgggttctaagctagaagacatccttatggatgatactctatcgcccgttggagttacggacccgttgctgtccagcgtttccccaggggcatctaaaacgtcctcgaggcgttcctccatgagcatggaggagaccgagcacacgtgttag

SEQ ID NO: 5131 - DNA, 1560 bp, Artificial Sequence
  Description of Artificial Sequence: Synthetic coding sequence
atgggccacctggaaaatacctcggtcgtatttcctcgggctattttcagcctctgcgagaaggagaccaggaagcttaccctgtgtctgttcagccggtcttcatccgcagaacatcccggtgcttctaagccaccaatatcctccagctccatgacttcccggatactgctgcggcagcagctgatgcgcgagcagatgcaggagcaagaacggcgagagcagcaacagaaacttcaagccgctcagttcatgcagcagcgcgtgcctgtttctcagacgccagccattaatgtaagcgtccccaccactctgccatctgctactcaggtgcccatggaggtgctgaaggtgcagacacatcttgagaatccaactaagtaccacatccagcaggctcagaggcagcaggtaaaacagtatctgagcacaaccttggccaacaaacatgctaaccaggtgctttcccttccctgccctaatcaaccaggcgaccatgtcatgcctcccgtcccgggatcatctgcgcctaacagccctatggctatgctgactctcaattccaattgcgagaaagaagggttctacaagtttgaggaacaaaacagggctgagagcgagtgccctgggatgaacacacacagtcgagcgagctgtatgcagatggacgacgtaatcgatgacatcatttctttggaatcaagctataacgaggagatcctgggactgatggatcctgccttgcagatggcaaacacattgccagtttccggaaaccttatcgacctttacgggaatcagggtctgccaccccctggtctgactatctccaactcatgccccgctaatctccccaacattaagagagagctcaccgagtccgaggcacgcgcactggccaaagagagacaaaagaaggacaatcataatcttatcgaaagacgccgtagatttaacatcaacgaccgcattaaggaactgggtacactgatacccaaaagcaatgaccctgacatgagatggaataaggggaccatcctgaaggcctccgttgactacattaggaagttgcagcgggaacaacagagagccaaggaactggaaaatcgccaaaagaagctcgaacacgccaaccggcatctcctgctcagaatccaggagctggaaatgcaggctcgggcacacggccttagcctgatcccctcgactgggctatgcagccccgatttggttaatagaattattaaacaggagcctgtgctggaaaactgctcccaggacttgctccaacatcacgcggatttgacttgcaccacaactctggatctcactgatggaaccattacctttaataacaaccttggaaccggcacagaagccaaccaggcctactccgttccgaccaagatggggagcaagttggaggatatcctgatggacgacacactgtctccagtgggggtcacagacccactactgagctctgtcagcccaggcgcttctaagacgagcagccgaaggagtagcatgagtatggaggagaccgagcacacatgttag

SEQ ID NO: 5132 - DNA, 1563 bp, Artificial Sequence
  Description of Artificial Sequence: Synthetic coding sequence
atgcaatccgaaagtggaatcgtgcccgacttcgaggtaggcgaggaattccatgaagaaccaaaaacttactatgaactcaaatcacagcctctgaagagcagttcttccgccgaacaccccggtgcaagcaaaccacccattagttcctccagcatgaccagcagaatcctactgaggcagcaactcatgagggaacagatgcaggaacaagagcgtagagaacagcagcaaaagttgcaggctgcccagttcatgcagcaaagggtccccgtcagccagacccccgctataaatgtgagcgtccccacaaccctgccaagcgccacccaggtgccaatggaggtgttgaaggtccaaacccacctcgagaatcctaccaaatatcatatccagcaagcccagaggcagcaagtgaaacaatacctcagcacaacgctcgccaacaagcatgcaaaccaagtactatcactgccttgtccgaatcaaccaggcgaccacgtgatgccgccagtgcccggaagcagcgccccaaattcccccatggcaatgttgaccctcaatagcaactgcgaaaaagaggggttctacaagttcgaggaacagaatcgcgcagagtccgaatgcccgggaatgaacacacattctagagcatcctgcatgcaaatggacgacgtcatcgacgatataatatcgctggagagtagctataatgaggagatattaggactcatggatccggctttacaaatggccaacactctacctgtttctggtaacctcatcgatctgtacggtaatcagggactgccgccacccggtctcactatctccaactcttgccccgctaacttgcctaatattaaacgcgaacttaccgagagtgaagcacgcgcactagccaaagagagacagaaaaaagataaccacaatctgatagagcggaggagaagatttaacatcaacgaccgcatcaaggaactggggacccttatcccgaagagcaatgatcccgatatgcggtggaataaaggcacaatcctgaaggcctctgtagactatatcagaaaactccaaagggagcagcaacgggctaaagaactggagaacagacagaaaaaactcgagcatgctaaccggcatctgctgcttaggatccaggagctcgaaatgcaagctcgggctcatggcctgtcacttatcccctcaactgggctgtgctcacctgatctggttaacaggatcattaagcaagagccagtgctcgagaactgctcacaggacctgctgcagcatcatgccgacttaacatgtaccacaaccctcgacctgacggatggaaccattaccttcaataacaatctgggaactggaaccgaagcgaaccaagcatatagcgtacccactaagatgggctccaaacttgaggatatcttgatggacgatactctgtcacccgtgggtgtgaccgacccattgctgtctagcgtgagtcccggtgcatcgaaaacgagctctaggcgcagctcaatgtctatggaggaaactgagcacacttgctag

SEQ ID NO: 5133 - DNA, 1260 bp, Artificial Sequence
  Description of Artificial Sequence: Synthetic coding sequence
atgctggagatgctggaatacaatcattatcaggtccagacccacctcgaaaatcctacgaagtaccacattcaacaagcccagagacagcaggttaaacagtacctgtccaccaccctcgccaacaagcacgctaatcaggttctctccctcccctgtccaaatcagccaggggaccatgttatgccaccggtaccaggatcttccgcccctaactctcccatggcaatgctaactctcaacagtaattgcgagaaagagggcttttacaaatttgaagagcagaacagagcagagtccgaatgccctgggatgaatacccactcccgggcttcttgcatgcaaatggatgatgtgattgacgacattataagtctggaatcaagttacaacgaagagatcctggggttgatggacccggctctccaaatggccaataccctgcctgttagtggtaatttgatcgatctctacggcaatcaagggttgccacccccaggcctgacaatctccaatagctgtcctgcgaatttacccaacattaagagggagctgacagcctgtatttttcctacagagtccgaggctcgggctttggcaaaggaaagacagaagaaggacaaccacaatctgatagagagaaggcggagattcaacatcaatgacagaattaaggagctggggactcttatacccaaaagtaatgatccagacatgaggtggaacaagggcactatcctaaaagcctcggtcgattacatacggaaactccagagggaacagcaacgcgctaaggagcttgagaacaggcagaagaaattggagcacgctaaccgtcacctactgctgcgcatacaggagctggaaatgcaggcaagagcgcacggactgagccttattccatctaccgggctctgttctcccgatctggttaaccgcattataaaacaggaaccggtgttagagaactgctctcaggacctgttacaacaccatgcagatctcacatgtactaccacgctcgatcttactgacggaaccatcacattcaataataatttaggaacaggcacagaggccaatcaggcctacagtgtgccaaccaagatgggatctaagctggaggatatactcatggacgacactctaagccctgtgggcgtgactgacccactgcttagctctgttagtccgggtgctagtaaaacctccagtagacggagctctatgtccatggaggaaacagaacacacttgctag

SEQ ID NO: 5134 - DNA, 1488 bp, Artificial Sequence
  Description of Artificial Sequence: Synthetic coding sequence
atgctgtatgctttctggttctcccattcctcatccgccgaacatcctggggctagcaagccacctatttcttccagtagcatgaccagccgcatcctgctcagacaacagctgatgagggagcagatgcaggagcaggaacgaagagagcagcagcagaagttacaggctgcccaatttatgcagcagagggttcccgtctcgcaaaccccagctatcaacgtgtcagtgccaacaacacttccgtcggcgacgcaggttcccatggaggtgctgaaagtccagacccatcttgagaatcctacaaagtaccacatccagcaggcccagaggcagcaggtgaagcagtaccttagcacgacattggcgaacaaacacgcaaatcaggtcctgtccctcccctgccccaaccaacctggagaccatgtgatgcccccagttccgggttcttctgcacccaactccccgatggcaatgttaactctgaacagcaattgcgaaaaggagggtttctataagtttgaggagcaaaatcgcgctgaaagtgagtgcccgggtatgaacacgcatagcagggcttcatgtatgcaaatggatgacgtgattgacgacattatttccctggagagtagctacaatgaggaaattctgggattgatggatcccgcactccagatggccaatactctgccagtgagtggaaatctgatagatctgtacggcaatcagggactcccccctcctggactcactatatcaaatagttgtccagccaatctcccaaacatcaaacgggagctgactgaatctgaggctagggccctggctaaggaaagacaaaagaaggacaaccacaaccttatcgagcgtcggagaaggttcaacatcaatgatcgaatcaaagagctagggactctgatacccaagagtaatgatcctgatatgcgatggaataagggaaccatcctcaaagcgagcgttgactatattcgaaagctgcagagagagcagcagcgggctaaggagttggaaaatcggcagaagaagttggaacacgccaacaggcacctccttctccgcatccaagaactcgagatgcaggcacgggcacatggcctgtcactaattccatctacaggactgtgctctccagatctggtgaatcgtatcatcaagcaggagcccgtgctggaaaattgctcccaggacctgctacagcaccatgctgatctgacctgcaccactaccctggacctgacggacggcactataacatttaacaacaatctaggcaccgggacggaggcaaatcaggcttatagcgtaccaaccaagatgggctcaaaattagaggacattctgatggatgacactctgtctcctgtgggagtgaccgatcccctcctttcctcagtgtctcccggagccagcaagacctcttcccgtaggtccagcatgagtatggaagagaccgagcatacctgctag

SEQ ID NO: 5135 - DNA, 1581 bp, Artificial Sequence
  Description of Artificial Sequence: Synthetic coding sequence
atgcagagcgaatcgggcatcgtgcccgacttcgaggtgggagaggaatttcatgaagagcctaagacatattacgaactgaaatcccagccactcaagtcaagctctagcgccgagcaccccggagcatcaaaacccccaatctcctccagctctatgacatcacgaatcttgttaagacagcaacttatgagggagcagatgcaggagcaggagcgcagggagcagcagcagaaactgcaagcagcccaatttatgcaacaaagagtgccggtgtcccaaacccccgcaattaatgtgagcgtcccgactacccttccatcagctactcaggtccccatggaagtcttaaaagtacagacccacctggagaatccaactaagtatcatattcaacaggcccagaggcagcaggtaaagcagtatctctccacaacactggccaacaaacacgccaatcaagttctgtcacttccgtgccctaaccaacctggcgaccacgtgatgccccctgtgcccggaagctcggccccaaatagccctatggcgatgctgacgttgaactctaattgcgagaaggaggggttttataaatttgaggagcagaatagggcagaatcagagtgccccggaatgaatactcactcccgggctagctgcatgcagatggatgacgtgattgacgacatcatcagcctcgagtccagttacaatgaggaaattctgggccttatggaccctgcactgcagatggcgaacacactgcctgtgagtggcaatctcatcgatctttacggaaaccagggactgcctccccctgggctgacgattagcaattcgtgtcccgctaatcttccaaacattaagagagaactcactgcctgtatattcccgactgaatccgaggcgagggcgctggccaaagagagacagaagaaagacaaccacaatctgatcgagaggcggaggcggttcaatatcaatgataggatcaaagaactcggtacactcatacctaagtctaacgatccagatatgcggtggaataagggtactatcttaaaagctagtgtggattatattagaaaactgcaacgggaacagcagagggcaaaagaattagagaatagacaaaaaaaactggagcacgcaaacaggcacctgcttctaaggattcaggaacttgaaatgcaggccagagcccatggccttagcttgattcctagcacaggcctctgctcgcccgaccttgtgaaccgaatcattaaacaggagcctgtcctagagaattgctcacaagacctgttgcagcaccacgccgacctgacttgcaccaccactctggatcttactgacggtactattacatttaataacaatttggggacgggcactgaagccaatcaagcatatagcgtcccaaccaaaatggggagcaaactggaggacatcctcatggacgataccctgagccccgtcggagttacagatcctctcctgtcaagcgtgagcccgggtgcgtccaagacaagctcaaggagaagttcaatgtccatggaggaaactgagcacacatgctag

SEQ ID NO: 5136 - DNA, 1086 bp, Artificial Sequence
  Description of Artificial Sequence: Synthetic coding sequence
atggaggctctccgagtgcagatgtttatgccctgcagcttcgaatccctatatctctcttcggctgagcatcccggtgccagtaagcctccgatcagttcctcctcaatgacaagtagaatcttactgcgtcaacagctaatgagagagcagatgcaggagcaagagaggcgcgaacagcagcagaagttacaggccgctcagtttatgcaacagcgggtccctgtatcacaaacccccgctattaatgtgtctgtacctacgacactccccagtgccacacaggtaccaatggaggtactcaaggtccagacacacctcgagaaccctaccaagtatcatattcagcaggctcaacgacagcaggtaaaacagtacctttctaccaccctggcgaacaaacacgcaaatcaggtgctgtctctgccctgtcccaatcagcctggagatcacgtgatgccgcctgtgcctggatcaagtgccccaaacagtcctatggcgatgctgacccttaacagcaactgcgaaaaagaggggttttataaattcgaggagcagaatcgggctgaatctgaatgcccgggtatgaatacccacagccgcgcatcatgtatgcagatggacgacgttatcgatgacatcatctcactggagtccagctataatgaggagatcctgggccttatggatccggcactgcagatggccaatacgctccctgtgagtggcaatctgatcgatctctacggcaaccaaggcttacccccacctggacttactatctcgaactcgtgccccgctaacctccctaatattaagcgggagctcactgcctgtattttcccaaccgagagcgaggctcgggcactcgccaaagagagacaaaaaaaagataatcataacctcattgaacggagaagacgattcaatatcaacgataggatcaaggagctgggaacacttattcctaagagtaacgaccccgatatgagatggaataagggcactatccttaaggcctccgtcgattatatcagaaaacttcaacgagagcaacagcgcgctaaggagctcgagaacaggtag

SEQ ID NO: 5137 - DNA, 354 bp, Artificial Sequence
  Description of Artificial Sequence: Synthetic coding sequence
atgggacacttggaaaacactagcgtggttttcccccgagcgatcttctcactgtgtgaaaaggagactagaaagttgacattatgcctattttccagatccagcagcgcagaacaccctggagctagcaaaccgccaatctcttccagcagcatgacttccagaatcctgctccggcaacaactcatgcgtgaacagatgcaggaacaggaacgcagggaacagcagcagaagcttcaggcggctcagttcatgcagcagcgcgtccccgtttcacagactcccgcaataaatgtctctgtgccaacaacacttccttctgccacgcaggtacctatggaggtgctgaagtag

SEQ ID NO: 5138 - DNA, 1074 bp, Artificial Sequence
  Description of Artificial Sequence: Synthetic coding sequence
atgctcgagatgctagaatataatcattatcaggtgcagacacatctagaaaaccctacgaagtatcacatccagcaggcccagcggcagcaaggcttttacaaattcgaagagcaaaatagggcagaatccgaatgcccaggaatgaatacacactctcgggctagctgcatgcagatggacgacgtgattgacgatataatcagtctcgagagttcttacaacgaggagatcctgggacttatggaccctgccctgcagatggcaaataccctgcccgtgtccgggaacctgattgatctgtacggtaaccaagggctgcctcctcccggattgacaatatccaactcctgccctgctaacctgcccaacatcaagagggagctgacagaatccgaggctagagccttagcaaaggaaaggcagaaaaaagacaatcacaatctcatcgaacggagacgacgtttcaacatcaacgaccgaattaaagagctgggtaccctgattcctaaatcgaacgatcccgatatgcgctggaacaagggtacaatacttaaagcctcagtggactacattcgcaagcttcagagggagcagcaaagggcaaaggaattggaaaatagacagaagaagctggaacacgcaaatcggcacctccttctgagaattcaagaactggaaatgcaggcgagggcccatggactatctttgattcctagcaccgggctatgctctccagacctagtgaatcggatcatcaaacaggagccagtcctggaaaactgtagtcaggacctgcttcaacaccatgccgacctgacctgcacgactaccctcgacctgaccgatggaacaatcacgtttaataacaacttgggcacgggaactgaagcgaatcaagcttacagtgtcccgacaaaaatgggcagcaaattagaagatatcttgatggatgacacactgtcaccggtgggagtcacggacccactattatcctcagtatcaccaggcgcatctaagacaagtagccgccgaagctcgatgagtatggaggaaactgaacacacatgctag

SEQ ID NO: 5139 - DNA, 1407 bp, Artificial Sequence
  Description of Artificial Sequence: Synthetic coding sequence
atgacctcacgcattctgctgcgtcagcagctgatgagggagcagatgcaggaacaagaaagaagggagcaacagcagaagttgcaggccgcacagttcatgcagcaacgcgtccccgtatctcagacacccgctattaatgtcagcgtaccaaccacactaccctccgccacccaggttcccatggaagtcctaaaagtgcagacacatctggagaacccaaccaaatatcacattcagcaggctcaaagacagcaggtgaagcaatacctaagtacgacgctcgccaataagcatgcaaaccaggtactctctttaccctgtccaaatcaacctggcgaccacgtgatgccacccgtccccggttctagcgctcctaatagccctatggcaatgctgacactgaatagcaactgcgagaaggagggcttctataagtttgaagaacagaaccgggcagaaagtgaatgtcctggcatgaatactcactccagggcctcttgcatgcagatggatgacgtaattgacgatattatcagtttagagtcttcgtacaacgaagaaatactgggcttaatggacccagctctgcagatggcaaatacattaccagtgtcgggcaacctaattgatctctacggaaatcagggcctccctccccctgggctcacgatctcgaactcttgccctgccaatctgccaaacatcaaacgcgagttgaccgagtccgaagcgagggcgctggctaaggagcgtcagaagaaagataaccataacctgattgagaggagacgtcgcttcaacatcaacgacagaatcaaggaactcggcacactgattcccaaatcaaatgaccccgatatgcgttggaataaggggaccattcttaaagcttcagtggattatattagaaagctccagagggagcaacagagggcaaaagagctggaaaatcggcagaagaagctagagcacgcgaacaggcacctgcttctgcgtatccaagaattagagatgcaggcacgggcacacgggctcagtttaattccctccactggcctgtgtagccccgacctggtaaaccgcataattaaacaagagcccgttctggaaaattgctctcaagatctcctccagcatcatgcagatctgacctgcactaccacccttgatctcacagacggtactatcactttcaacaataacttgggcactggcaccgaggccaaccaggcctattcagtgcccactaagatgggctcaaagttagaggatatactcatggacgacacactctctcccgtgggagtaactgatcccctgctatcctcagtgagccccggagcatccaagaccagcagccggagatcctccatgtctatggaggaaaccgaacatacatgttag

SEQ ID NO: 5140 - DNA, 4422 bp, Artificial Sequence
  Description of Artificial Sequence: Synthetic coding sequence
atggccggtggagcctggggccgtcttgcgtgctacctggagtttctgaagaaagaggagctcaaagagtttcaactcctcctggctaataaagcccatagtagaagttcatcgggtgagaccccggcacagcccgagaagacaagcggcatggaggtggctagctaccttgttgcccagtacggagaacagagggcatgggacctagctctgcatacttgggagcagatggggctaaggtcgctttgtgcccaagcccaggagggcgctggccacagccctagtttcccgtacagtccgtctgaaccccacctagggtccccctcacagcccacgagcacagccgtgctgatgccatggatccacgagctccccgctgggtgcacccagggctcagaacgtcgcgtgctccgacagctcccagacacttctggtaggagatggagggagatttctgcgtcactcttatatcaggcgttgccttccagccctgaccacgagtctcctagccaggaatcaccaaatgcaccaacgtccaccgctgtgctcgggtcatggggctcaccacctcagccatcactggcccctagggagcaggaggccccaggaactcagtggccgctcgacgaaacatccggtatatattatacagagatcagagagagggagagggagaagagcgagaaggggagaccgccatgggctgccgtggtgggtacaccgcctcaggcacacacctcactgcaaccacatcaccacccctgggagcccagtgtgcgggaaagcctgtgctctacatggccatggaaaaacgaagatttcaatcagaagttcacacagcttcttcttctccaacgtccgcacccccgttcgcaagatcctctggtgaagcgttcttggcccgattacgtggaagagaacagaggacatcttatcgaaatccgtgatctctttggacccggacttgatactcaggagcctcggattgtcatcctgcagggtgcagctgggatcggcaagagcacactggcacgccaagtaaaggaagcttggggacggggacagctttatggcgacagatttcaacacgtcttctatttcagctgtcgggagttggctcaaagcaaggtcgtcagtctggcagagctcataggcaaggacggtactgcaacaccagcacctattcgacaaatcctgagtcggcctgagcgcctcctgtttattctggacggagttgacgaacctggctgggtacttcaggaaccttcttcagaactgtgtctgcactggagccagccacagcccgcagacgccttgctgggatccctgctgggcaaaaccatcctccccgaggcttccttcttgattaccgccagaaccactgcactgcagaatctaataccgtctctggaacaagccagatgggtggaagtgttggggttttcagaatcctcgcggaaagaatatttctatcggtacttcactgacgagaggcaggccattagagcgtttcgattagtgaagtccaataaagagctctgggcgctgtgtctggtgccctgggtgtcttggttagcatgcacctgcctgatgcagcagatgaagcggaaagagaagctcacactgacatccaaaacaacgacgactttgtgcctgcattatctcgcgcaggccctgcaagcgcagcccctgggccctcagctgcgtgacctgtgctcattagccgcagaaggcatctggcagaagaagacactcttttcacccgacgacctccgcaaacatggtcttgatggtgccattatctctacgttcctgaagatgggcatcttgcaggagcaccctatacccctttcttattcttttatccatctgtgctttcaagaattcttcgccgcaatgtcttatgtgctggaggatgaaaaaggtcgaggaaagcactcaaattgtattattgatctcgagaaaacccttgaagcatatgggatacacggtctgtttggtgctagtacgacgcggtttctacttgggctgctgtcagatgagggtgagagagagatggagaacatctttcactgtagactgtcccagggcaggaacctaatgcagtgggtgccaagtcttcagctgctgctgcagccccacagcctggaatcgcttcattgcttgtacgagactaggaataaaacgttcttgactcaagtcatggcacatttcgaggaaatgggaatgtgtgtggagaccgatatggagcttttagtgtgtaccttctgtataaagtttagtcggcacgtcaagaagctgcagctcatcgaaggcagacagcatcgtagcacctggtctcctacaatggttgtgctgttccggtgggtcccagtaaccgacgcctattggcagatactcttctctgtcctgaaggtcacacggaacctcaaggagttggacctgtccggaaattcactgagccatagtgccgtcaaatccctctgtaagacccttaggagacccagatgtctcctcgagactttgcgcctggccggatgcggcctgacagccgaggactgcaaggacctcgcttttgggctacgtgcaaatcagactttgaccgagcttgacctgtccttcaacgttcttaccgacgccggagcgaaacacctctgccagcgactgcggcagcccagctgtaagctgcaacggctgcagctcgtgtcatgtggtctcacaagtgactgctgtcaagacctcgcaagcgtgctttccgcatccccatccctcaaagagctggaccttcagcaaaataatcttgatgacgttggagtgcggctgctctgtgaaggcctgcgccaccctgcctgcaagctgattaggttgggcttagaccagaccacactgagcgatgagatgcgccaggaattgagagcactagagcaagaaaagccgcagttgttgatcttctcgagaaggaaaccctccgtaatgacgccaacagaaggcctggatacaggagaaatgtcaaattctacctccagccttaaacggcagagacttggttccgaacgggcagcaagccacgtagcacaagctaatttaaagcttcttgatgtatccaagatctttccaatcgcagagatcgccgaggagtcctcccccgaggtagtaccagtggaacttctctgcgtgccaagtccagcgtcccaaggcgacctgcatacaaaaccattagggacagatgatgacttctggggtccaactgggcctgtggcaactgaagtcgtggacaaagagaaaaatttgtatcgagtgcacttccctgtagctggctcttaccgctggcccaacactgggctctgctttgtcatgagggaagccgtgacagtcgagattgagttctgtgtgtgggaccagttcttgggagagatcaacccacaacattcatggatggtagctgggccattgctcgacataaaggcagagccaggcgcagtggaggcagtgcatttacctcattttgtagcacttcagggaggccacgttgacacctcgttattccagatggcccactttaaggaagaaggaatgttgctggaaaagccagctagagttgagctgcaccacatagtgctcgagaacccaagcttcagccctctaggggttttgttgaagatgatccacaatgcactgagattcattcccgttaccagcgtcgtactgctttaccatagggtccatcctgaggaagtcacgttccatctttatcttatccccagtgattgctccattaggaaggcaatcgatgacttggagatgaaattccagtttgtccggatccacaaacccccacccttaactccactgtacatgggctgtagatacaccgttagcggatccggaagcgggatgctggagatcttgcccaaagagcttgaactgtgctatcgtagtccaggtgaggatcagctgttttcggaattttatgtcggtcacttgggcagcgggatacgcctgcaagtaaaagacaagaaggacgaaactctggtttgggaagccttggtcaagcctggggacttgatgcctgcaaccacattgattccgcctgcccgaattgcagtcccctctccgctggacgcaccccagcttttgcacttcgttgaccagtacagggagcagctaatcgcaagggtgacaagtgtcgaggtcgtgctcgacaaattgcacggtcaggttttatcacaggagcaatacgagcgcgtcttagccgagaatacccgccctagccaaatgcggaagctgtttagcctttctcagagttgggatcgcaagtgcaaggatgggctgtatcaggctttgaaggagacccatccacatttgataatggagctctgggagaaagggtctaaaaaaggattgttgcccctctccagctag

SEQ ID NO: 5141 - DNA, 4200 bp, Artificial Sequence
  Description of Artificial Sequence: Synthetic coding sequence
atggccggtggtgcctggggcagactggcctgctacttagagtttcttaagaaggaggagctcaaggagttccaactcctgctggccaataaagcccattccaggtcctctagtggggaaacccctgcccaacctgaaaagaccagcggtatggaagtggcctcatatctggtcgcccagtatggggagcagagagcatgggatctggccctgcacacatgggagcaaatgggcctgaggtccctgtgtgcccaggcccaggaaggcgcaggacatagccctagtttcccctatagcccctccgaacctcacctgggctcaccttcacagccaacaagcacggccgtgcttatgccatggatccacgaacttcccgcagggtgcactcaaggcagcgaacggagagtgctgcggcagctgcctgatacaagtggcaggcggtggcgagaaatttccgcatccctgctctatcaagcgctgcctagttctccagaccacgaatcaccctcccaggagtcccctaatgcacccaccagtaccgccgtcctgggttcctggggtagtcctccacagccctcccttgctcctagagagcaagaggccccaggaacccagtggcctctcgatgagacatcaggtatttactacaccgagattcgtgaacgagagcgtgaaaagtcagaaaaaggcaggcccccttgggccgctgtcgtcggcacacctccgcaagcacacacctctctccagcctcaccaccatccatgggagccgagcgtgcgggagagcctctgttcaacctggccatggaaaaacgaggactttaaccagaagtttacacagttactcctactgcagcgcccacatccacgctcgcaggatcctctggtaaagcggagttggccagactacgtagaagagaaccgaggccacctgattgaaattcgcgacctgtttggccctgggctagatacccaggagccaaggatcgtgattcttcagggggcagcaggcattgggaagtccaccctggctcggcaagtgaaggaggcttgggggcgaggccagctgtatggcgatcggtttcagcacgtcttctactttagttgcagagagcttgcccaaagcaaggtagtaagcttggctgagcttattggaaaagatgggacagctacaccggcacccattcgccagatcttgtcccgacctgagagactcctgttcattctcgacggtgtcgacgagcccggatgggttctccaagagccctcctcagaactgtgcctgcactggagtcagccccagcccgctgatgcactgctcggaagcctgctggggaaaaccatcctgcccgaagcatccttcctgattacagcaagaacaacggcccttcagaatctgatcccaagtttggagcaagccagatgggtcgaggtgctggggttttcggaatcctcacgaaaagaatacttctacagatactttacagacgagcgtcaggcaatcagggctttccggttggtgaaatccaataaggagttgtgggcgctatgtcttgtgccttgggttagctggttggcatgcacctgtcttatgcagcagatgaaaagaaaggagaagctaacactgacttctaagacaacaacgacgctctgtctgcattatttggcacaagcactgcaagcacagccacttggccctcagctgagagacctttgttccttagccgcagagggcatttggcagaagaaaacactctttagccccgatgacctcagaaaacatggcctcgacggcgctattatttcaactttcctgaagatggggatactgcaggaacaccctatccccctgtcatactccttcattcacttatgtttccaggaattcttcgcggcaatgtcatatgtcctcgaagatgagaaagggagaggcaagcattcaaactgcatcattgacctggagaagactctcgaagcttacgggattcatggactttttggagcttcaaccacccgtttccttctgggcttgctatccgacgagggggagagggaaatggagaatatcttccactgccggctctctcagggaaggaacctgatgcagtgggtgccatcattacagctgctccttcagccgcactccctcgagtccctacattgcctctacgaaacacgtaacaagacattcctaactcaggttatggcccacttcgaggagatgggaatgtgcgtggaaactgacatggaactgttggtgtgcactttttgcattaaattttctagacatgtgaagaaactgcagctcatcgaaggcagacagcatcgatcaacatggtcccccacaatggtggtattatttcgatgggtgcccgttacagacgcgtactggcagattttgttttccgtactgaaggtgacacggaacctcaaagagctggacctgtctggcaatagcctatcccatagcgcggttaagagcttgtgtaaaacactgcgacgaccaaggtgtcttctggaaacgctgagactggcaggctgtggactgacggccgaagattgcaaggacctggcgtttggtctgagggccaaccaaactttgacagaactggatctgtcgttcaacgttttgacagacgctggcgctaagcatctgtgtcagcgccttaggcagccatcctgcaaactgcaaaggctgcagctagtgagctgcggactgacgagcgactgctgccaggatttggcaagcgtgctgagcgcatctccctcgctgaaggagctagatctgcagcagaataacttggacgacgtgggtgtgcggctactctgtgaaggtctacgccaccccgcatgcaagctgattcgactggggaaaccgtccgtgatgacgccaaccgaagggcttgacactggagagatgagcaacagcacaagctcgcttaagcgacagagactgggatctgaaagggctgcctcccatgttgcccaggctaatctaaagctgctggacgtttccaagatttttcctattgcggagatcgccgaggagagtagccccgaggttgtccctgtggaactactgtgcgtcccatcaccagccagccagggggacctccacaccaagccactcgggacggacgacgatttctgggggccaacagggcctgtcgcaacagaggtcgtagataaagagaagaacctttacagggttcacttcccagtggcgggatcataccgctggcctaacactgggctgtgcttcgtgatgagggaggctgtcaccgtcgaaatcgagttttgtgtgtgggaccagttcctgggggagatcaatcctcaacatagttggatggtggctggccctttgctggatatcaaagcagaacccggtgctgtggaagctgtgcacctgcctcacttcgtggcactccaaggagggcacgtcgacacctccctgttccagatggcacattttaaggaggagggcatgttattagagaaacctgccagggtagaactgcaccacattgtcctggaaaatccttcttttagtccactaggcgtgttactgaaaatgattcataacgcactgcgattcatccccgtaacgtccgtggtcttgctttaccaccgagtccatccagaggaagtaacattccacctctacctgataccttccgattgctcaatccgaaaagagctggaactctgctataggtcacccggagaggaccagttattcagtgagttctacgtcggacatctgggttccggtatcaggctgcaggtaaaagataagaaggatgaaaccctcgtgtgggaggccctagtaaagcctggcgacctgatgcctgccacaaccttaatccccccagccaggatcgcagtaccctcacccctggacgctcctcagctgcttcacttcgtggatcagtaccgagaacagttaatcgctcgcgtaaccagtgtggaggtagtgctggacaaattgcatggccaggtcctgtcgcaggagcagtacgaacgcgtgctggccgaaaatacacggccaagccagatgcgcaaactgttttctttgtcccaaagctgggacaggaaatgtaaggacggtctgtaccaggccctcaaggaaacgcaccctcacctgattatggagttatgggagaaaggcagcaagaagggcctgctgcccctgtcttcatag

SEQ ID NO: 5142 - DNA, 4128 bp, Artificial Sequence
  Description of Artificial Sequence: Synthetic coding sequence
atggctggcggtgcttggggacggctggcctgctacctagaatttcttaagaaagaggaactgaaagagttccagctacttctggctaacaaagctcatagccgcagcagctccggtgaaacccctgcccagccagagaaaaccagcggcatggaagtggcctcatacctggtggcacagtatggagaacagcgcgcttgggatctggctctgcatacctgggagcagatgggactgcgctctctctgcgctcaggcgcaggagggcgctggtcatagcccctcttttccgtattcaccgagcgaaccacatctgggctcgccaagtcagcccacttcgactgccgttctgatgccttggatccatgaactcccggctgggtgtacccaggggtctgagcgcagagtgttaagacagctgcccgatacttcagggcgtcgctggagagagatcagtgccagcctcctatatcaggcactgccgtcaagccctgaccatgagtctccgagccaggagtctcccaacgccccaacaagcactgcagtcctgggctcatggggcagtcctcctcagccctctctcgcaccccgtgagcaggaggccccaggcacccagtggccactggacgagacctccggcatctactacactgaaatcagagaacgggaacgcgagaaaagtgagaagggcaggcctccatgggccgctgttgtgggcacaccacctcaggcccacactagcctacaaccccatcaccatccgtgggaaccctctgtgagggaaagcttgtgttcaacctggccatggaaaaacgaagatttcaaccaaaaatttacacagctgcttcttctacagcgcccacaccctaggtctcaggatcccctggtgaagagaagctggcccgattatgtggaggaaaaccgtggccatctcatcgaaatcagggacctgtttggtcctgggctggacacgcaggaaccgaggatcgtgattctccagggtgctgctggcattgggaagtcaacactggcaagacaggtgaaggaggcgtggggtaggggccagctttacggtgacagatttcagcatgtgttttattttagctgtagggagctggcacagagcaaagtggtgtccctcgcagagctgatcggtaaggacggaacggccaccccagcacctattcgccaaattttatctcgccctgaacggctgcttttcatactggacggggtcgatgagccagggtgggttctccaggagccttctagcgagctgtgcctccactggtcgcagccacagcccgctgacgctctgctgggatcactcctaggaaagacaatcttaccagaggccagtttcctaattacggcaagaacaaccgcactacagaatttgattccatcactagaacaggcacggtgggttgaagtgttgggcttttctgagagctcacgtaaggaatatttttatcgatacttcaccgacgaacgacaggctatcagagcattcagacttgtgaagtccaacaaagagctatgggcactctgcctagtaccatgggtgtcatggctggcttgcacctgcttaatgcagcagatgaagcgcaaggagaagctcactttgactagtaaaacaaccaccaccctgtgtcttcattatcttgcacaggcattacaggcccagcccctcggccctcaattacgggatttatgcagtctggccgctgagggcatctggcagaagaagacactgttttcccctgatgatctgcgcaagcatgggctggatggagctattatcagtacctttctgaaaatgggcattctgcaagagcacccgattcctctgtcctactcctttattcacctgtgttttcaggagttcttcgccgcaatgagctacgttctcgaggatgagaaaggacgaggaaaacatagcaattgcattatcgatctcgaaaagactctggaggcatatggcattcacggcctcttcggcgctagcaccactaggtttctcttgggtctgctcagcgacgaaggcgagcgagaaatggagaacatattccattgtcgactcagccagggacggaacctgatgcagtgggtgcccagcttgcagctactcctccagcctcattcactggaatccttgcattgcctctacgagactcggaataagacgtttcttacccaggtgatggcccattttgaggaaatgggtatgtgcgtggagacggatatggaactgctggtatgcactttctgcataaagttctcccgccatgtcaagaagctgcagctgattgagggaagacagcatagatctacatggtcacccactatggtggtactcttccgctgggttccagtgacggacgcttattggcagattttatttagcgtactgaaggtgactaggaatctgaaggagcttgacctgtcaggtaattcgctctctcattccgcagtgaaatccctctgcaagaccttaagacgccctcggtgcctccttgagactttaagattagctgggtgcggtctcacagccgaggactgcaaagatctcgcgttcggtttacgagccaatcagacactgaccgaactcgatctgtcctttaacgttctcacggatgctggagcgaagcatctctgccagagactccgccagccatcttgtaagttgcaaaggttgcagttggtctcctgtggattgacgtctgattgttgtcaggatctggcctctgtgttatcagcatcaccatccctgaaggaattggatctccagcaaaacaacctcgacgatgtgggagttcgactcctgtgcgagggactgagacatcctgcctgtaagcttatccgcctcggattggatcagaccacattgagtgacgagatgagacaggagctccgcgctctggagcaagaaaagccccagctcctcatattttccaggagaaaaccctctgtgatgactccaacagaaggcctggacacaggagagatgagcaacagcacatcttcactcaaacgtcagaggttggggtctgaaagggcagcgagccacgttgcccaagccaacctgaaattgctggatgtcagtaaaatttttcctatcgccgaaatcgcagggaagagccatgaggagagctctcccgaggtcgttcccgtggagctcctgtgcgtaccttcccccgcttcacagggtgacctgcataccaagcccctaggaaccgatgacgatttctggggaccaactggaccagtcgcaactgaggtcgtagacaaggaaaaaaacctgtaccgggtccactttccggtggcaggaagctatagatggccaaatacaggactgtgctttgtgatgcgtgaagcggtcactgtggagattgaattttgcgtgtgggatcagttcctcggggaaataaaccctcagcattcctggatggtggccggaccactccttgatatcaaggcagagcccggagccgtagaagcggtacacctgccccacttcgtggcgcttcaggggggtcatgtggacacatcactgttccagatggcccatttcaaggaggagggcatgcttttagaaaagccagccagggtggagcttcatcacatcgtgctagagaatccaagtttttctcccctgggggtcctgttgaaaatgatccacaacgccctacggtttatacctgtgaccagcgtggtgctcctgtatcatcgcgtacatccagaagaggtgacattccatttgtatctcatcccatctgactgtagcatacgtaaggcaatcgacgacttggaaatgaagttccagttcgttcgcatacataagcccccaccccttacccccttgtatatggggtgcaggtatactgtgtctggttcaggatcaggcatgttggagattctccctaaagaactggagctctgttacaggtcgcctggcgaggaccaactatttagtgagttttatgttggacaccttggcagcggaatacgcttacaggtgaaggacaaaaaagacgagactctcgtttgggaggcactagtcaaaccagggagaaatacgagtcagccctggaatctacgttgcaatcgggacgccagaaggtactag

SEQ ID NO: 5143 - DNA, 4422 bp, Artificial Sequence
  Description of Artificial Sequence: Synthetic coding sequence
atggctgggggagcgtggggccgactggcttgctacttggagttcctcaaaaaagaagaactgaaagaatttcaactcctgttagctaacaaagctcattcccgctctagttccggtgagacacccgctcagcccgagaaaacttctggaatggaggttgcgagctatctggtggctcagtacggcgaacagagagcatgggatctagcacttcatacctgggagcaaatggggttgcgcagcctctgcgctcaagctcaggagggggctggccactctcccagctttccatattctcccagcgaaccccatctgggcagccctagccagcctacctcaacagctgtgctgatgccctggatccacgaacttcctgctgggtgcacacagggaagtgagagacgagtcctccggcaactgccagataccagcggcagaaggtggcgggaaatcagcgcctccctgctgtaccaggctctgccgtccagcccagatcatgagtccccaagtcaggaatccccaaatgcacccacctcaacagcggtgctgggcagttggggttcgcctccacagccttcccttgcaccacgggagcaggaggcccctggaacgcagtggccacttgatgaaacttcaggcatttactacactgaaatcagggagagagaaagagagaaatccgagaagggtaggccaccttgggccgctgtagtgggcacaccccctcaggcacacacctccctccagccacaccaccatccctgggaacctagtgtgagagagtccctgtgttctacgtggccatggaagaatgaagactttaatcaaaaatttacgcagctgctgctccttcaacgcccacatccacggagtcaggatccccttgttaagcgatcctggccagactacgtggaagagaatcggggacatctgatcgagatacgggatctgtttggcccaggtctggatactcaggaacccaggattgtgattcttcagggcgctgctgggatcggtaagagcacattagcccgtcaggtcaaagaggcctggggcaggggccaactctacggggaccggttccaacatgtgttctacttctcctgtagggaactcgctcagagcaaagtggtgagtcttgctgaacttattggcaaagacggtaccgcgaccccagcaccaattcggcagattctttcgcgcccagaaagacttctgtttattctggacggggtcgacgaacccggatgggtcttgcaagagccttcatccgagttgtgtcttcactggtcccagccacagcctgcagatgctctgctcggctccttactgggaaagacaatcctgcccgaagctagctttctgatcacagcaaggacaaccgcgcttcagaatcttattccctcactggaacaggccaggtgggttgaggtactggggtttagtgaaagtagccgaaaagagtacttctatagatatttcaccgatgaacgccaggccatcagggccttccggttggtgaaatcaaacaaagaattgtgggcactgtgcctagtaccatgggtatcatggttagcatgtacatgtttgatgcaacagatgaagagaaaagagaaattgaccctgacaagcaagaccaccacgaccctttgcctccactacctggcccaggcactgcaggcgcagcccttaggcccacagctcagggatctgtgcagtttagccgctgaaggaatctggcagaagaagacactgttctcaccagacgacctgaggaaacacggactggatggggcaatcattagtaccttccttaaaatgggcatcctgcaggagcacccaattccactgtcttactcatttatccacctttgtttccaggagttcttcgcagccatgagttacgtcctcgaagatgaaaagggcagaggtaagcatagcaactgtatcattgatctggaaaaaacactcgaggcttacggaattcacgggctgtttggagcatccacaactaggtttctccttggcctattatccgatgagggcgaacgggaaatggagaacattttccattgtcgtctgagccagggccgaaacctgatgcagtgggtgcctagtctgcagttattgctgcaaccacactcgttagagtctcttcactgcctctacgagacacggaacaagaccttcctcactcaagtcatggcccacttcgaggaaatggggatgtgcgtggagaccgatatggaactgctggtttgcaccttctgtattaagttttccaggcacgttaagaagcttcagctgatcgaaggccgacagcataggtcaacttggtcacccactatggtggtgttgtttcggtgggttccagtgaccgacgcttactggcagattttgttctccgttctgaaagtgacacgtaatctgaaagagctcgacctgtccggcaactctctctcacactccgcagtgaaatctctgtgtaagaccttgcgaaggccgcgttgtttgctggagactctgcgtctggcagggtgcggacttactgcggaagattgtaaggatctcgccttcgggctgcgtgctaaccagactctgaccgagcttgatctgagtttcaacgttctcacagatgctggagccaagcatctttgccaaagactccggcagccatcgtgcaaactccagcgccttcagctggtttcctgtggcctgacaagcgattgctgccaggatctagcctccgtccttagcgcaagcccatcccttaaggagctggatctccagcagaacaacctagacgatgtgggagtcaggctcctttgtgagggtctacgacaccccgcttgcaaactaatacgattgggcctggatcagactacgctatcggacgaaatgcgtcaggagctgcgggcactggagcaagagaagccccagttattgatcttttcgaggaggaaaccctcagtgatgactccaactgagggcttagatacaggagagatgtcaaatagcacgagttcattgaagcggcagcgcttgggaagtgaacgagccgcaagccacgtggcccaggccaatttaaagctcctggacgtgtctaagattttccccatcgccgagattgccgaggaaagctcccccgaagtcgtacccgtggagcttctctgtgtcccttccccagctagtcagggtgacctccacaccaaacccctgggtactgacgatgacttctggggtccgaccggccctgtggccaccgaagtggtggacaaagaaaagaacctataccgtgtacacttccccgtcgccggttcctaccgatggcccaacacaggcttgtgctttgtcatgagagaggcggtcacagtggagatcgaattctgtgtgtgggatcaatttctgggcgaaataaaccctcaacatagttggatggttgctggacctttgttggatatcaaggccgagcccggagctgtggaggccgtgcatctcccacatttcgttgctctgcaaggcggacatgtcgataccagcctgtttcagatggcgcatttcaaggaagaaggcatgctgctggaaaaacccgctagggtggaactgcaccatatcgttctggaaaacccatctttttctccactgggtgtgttactgaagatgatccataatgcactgagatttatccctgtgaccagtgtggttctgctttatcatcgagtccacccagaggaagtgacgttccacctgtatctaattccttcagactgcagcatccgcaaagcaattgacgaccttgagatgaagttccaatttgtgagaattcacaaaccacctcccctcacaccattgtacatgggctgccgctataccgtgtccggatctgggagtggaatgttagaaattcttccgaaagagctcgaactgtgttataggagtcccggtgaggaccaacttttcagtgagttctacgttggccaccttgggagtgggataagactccaagttaaagacaagaaagacgagactctggtgtgggaggccttggttaagcccggtgatctgatgcccgcaacaaccttgatcccacccgctcggatagccgtaccttcacctttggatgctcctcagttgcttcacttcgtagaccagtacagagagcagctgatcgctagggtgacgtcagtggaggttgtattagacaagttgcacgggcaggttttatcccaagagcaatacgaacgcgtccttgccgaaaacacacggccttctcaaatgcgaaagttattctcccttagccagtcgtgggatagaaagtgcaaggacggtctctaccaggcgcttaaggaaacccatccacacctgatcatggaactctgggagaagggctcaaagaaagggctgttgccactttcctcatag

SEQ ID NO: 5144 - DNA, 4290 bp, Artificial Sequence
  Description of Artificial Sequence: Synthetic coding sequence
atggccggaggcgcttgggggcgactagcgtgttatctggagttccttaaaaaggaggagcttaaggagtttcaactgctactcgccaataaggctcatagcagatcctccagcggcgagacacctgctcaacccgagaagactagtggaatggaggttgcctcttaccttgtggctcagtatggggaacagagagcatgggatctggcgctgcatacctgggagcaaatggggctgaggagcctttgcgcacaggcccaagaaggggcaggtcattccccctcatttccctattcaccctcggaaccccatctcgggtccccttctcagcccacttctaccgctgttttgatgccatggatacacgagcttcccgctggatgtacccagggaagcgagaggagagttcttcgccagctcccggacacgagcggcaggaggtggcgcgagatcagcgcatccctgttataccaggcattgccgtccagtcccgaccacgagtcaccgagccaggagtctcccaacgccccaacgtcaacagccgtgcttgggtcttgggggtcacctccgcagccctcgctggcacccagggaacaagaagcacctgggacccaatggcctttagatgagacgtcgggcatctattacaccgagatccgggaacgggagcgcgagaaatccgagaaaggcagaccaccgtgggcggctgtggtgggcaccccaccccaggcccacacatccttgcagccgcaccatcacccatgggaaccaagtgttcgggaatccctgtgttctacgtggccctggaagaacgaagattttaaccagaagttcacccaactgctcctattgcagcgccctcacccccgttctcaggatccactggtaaagcggagctggccagactacgtcgaggagaatcgcggtcacctcatcgaaattagagatctgttcggacccggtctggatacccaagagcctaggatcgtcatcttgcagggtgcagccggtattggcaaatccacattagccagacaagttaaggaagcttggggtcgaggccagctgtatggagataggttccagcacgtgttttatttctcctgccgcgagttggcccagtccaaagtcgtatccctggccgaactcattggcaaagatggcactgccactcctgccccaatacgccagatcctttctaggccggaacgcttgctgttcattctggacggcgtcgacgaacccggttgggtcctgcaggaaccatcaagtgaactgtgcttgcactggagccaacctcaaccagccgacgcccttttggggagccttctgggcaagacaatcttacctgaggccagttttttgattaccgccagaaccacagcattgcagaatctgattccttccttggagcaggccaggtgggttgaagttctgggattcagcgagtcgtcccggaaggagtacttttatcggtatttcacagatgagcgccaggccatccgagctttccgtctcgtgaagagtaacaaggaactgtgggcactgtgcctggttccatgggtaagttggttagcctgcacttgcctgatgcagcagatgaaaagaaaagagaaactgacactaacaagcaagaccaccacaaccctgtgcttgcactacctcgcccaggcgctccaggctcaacctcttggccctcagctcagggatctgtgctctctggctgcagagggcatctggcagaagaaaacactgtttagtccggatgatttaaggaaacatggcctcgacggggcaattatctccacattcttaaaaatgggtatcctccaggagcatccaatacccctgagctatagtttcatccacctttgtttccaagagttcttcgccgcaatgtcttatgtgctagaagacgagaagggccgtggcaagcactccaattgcatcattgacctggagaagacccttgaggcctatggaattcacggcttgtttggtgccagtactaccaggttcttactgggcctgctatccgacgaaggtgagcgggagatggagaatatctttcactgtcgactgtcacaggggaggaatttgatgcagtgggtaccaagcctgcaactccttctccagcctcactcactggaatcattgcactgcctgtatgaaactaggaataaaacgtttctcacccaggtcatggcccactttgaagagatgggtatgtgtgtagagactgacatggaattgttagtgtgcacattttgtattaagttctctaggcatgtgaaaaagctgcagttgatcgagggaaggcaacacagatctacatggtcacccactatggtggtgctcttccgctgggtgccagtgaccgacgcatactggcagattctcttcagcgtgctcaaggttactaggaacctgaaagagctggatcttagcgggaattccttgtcacactccgcagtgaagtcactgtgcaaaacattgagacgccctcgctgcctgctggagacattgcggctggcaggatgcgggttgaccgcagaagactgcaaggacttggctttcggacttcgcgctaaccaaactctaaccgagctggatttatcctttaatgtgctgacagatgccggtgctaaacatctgtgccagaggctcagacagcctagttgcaaactacagagactccagctggtatcctgcggtttgacgtcagactgctgccaggatctggcctcagtcctatcagcttctccttctcttaaagaactcgacctgcagcagaataacctcgacgatgtgggagtccggcttctatgtgagggcttaagacatcccgcatgcaagctgatcagattagggttggatcagacaaccctgagcgatgaaatgagacaggagttaagagctctggaacaggaaaagccccagctgttaattttttcccggagaaagccatccgtcatgacccccactgaaggcctagatactggggaaatgtcaaatagtactagcagtttgaagaggcagcgcctggggtctgagcgtgctgcttcccatgtggcccaggcgaatctgaagctgctcgacgtcagcaagatctttcccatcgctgagatcgccgaagaaagctcaccagaggtagtgcccgtggaactcctgtgcgttccctccccagccagccagggcgacctacatacaaaacccctgggtactgatgacgatttttggggacctaccgggccagtcgctaccgaggttgttgacaaagagaaaaacctgtaccgtgttcacttcccggtggcaggatcctaccgatggcctaacacagggctttgctttgttatgcgagaggcggtcactgtggagattgagttctgcgtctgggaccagtttctgggagagatcaatccccagcattcttggatggtggctggccctctgcttgatatcaaggccgaacctggcgctgtagaagctgttcatcttcctcattttgtcgctctacaggggggtcatgtggatactagtctattccaaatggcccatttcaaggaggagggaatgctactcgagaagcctgccagggtcgagctgcaccacatcgtgctggaaaaccctagcttctcacccctaggggtgttacttaaaatgatccataacgctctgaggtttatccctgttaccagcgttgtccttctgtaccatagggtacatccagaggaggttactttccacttatatttgatccccagcgattgtagcatccgcaaagagcttgaactatgttacaggtctcctggcgaagatcagttgttttctgaattttatgtcggtcacctcggcagcgggattagactacaggttaaagacaagaaggatgaaactctcgtgtgggaggcgttagtgaagccaggtgacctgatgcccgctacaacgttgatcccaccagcaagaatcgccgtcccttctcctcttgatgcaccacagctgcttcacttcgtagaccagtaccgagagcaattaatagccagagtaacttcagtggaggtcgtcctagacaagctccacggccaagtcctaagccaggagcagtatgaaagagtgttggccgaaaacacacgcccttcacagatgcgaaagctgttttctctaagccagtcatgggaccgtaaatgtaaggacggtctgtaccaggccctgaaagaaacccatcctcacctgataatggaactttgggagaagggaagcaaaaagggtctgctcccactctccagctag

SEQ ID NO: 5145 - DNA, 4332 bp, Artificial Sequence
  Description of Artificial Sequence: Synthetic coding sequence
atggccggtggcgcatgggggcgtttagcttgctacctggaattcctgaagaaagaggagttgaaggagtttcaactgctgcttgctaacaaagctcactcccgcagtagttccggagagacaccagcgcagccggagaagacatctggcatggaggtggcctcctacctagtggctcagtacggcgagcagcgtgcttgggacctcgcgctgcacacatgggaacagatgggactcagatcactctgtgcccaggcccaggagggtgctggtcactccccgtctttcccatactccccatccgagccccatctcggttcaccctctcaacccacctccaccgcagtactaatgccgtggatccacgagctcccggctggatgcacacaaggctccgagcgcagagttctcagacagcttcctgacacttccggcagaagatggcgtgagattagcgcctccctgctgtaccaagctctaccgagttcccctgaccacgagtccccctcgcaggaatccccaaacgctcccactagcacggctgtcctgggctcctgggggagtccccctcagcctagcttggctccacgagaacaggaagccccaggaacgcagtggccattagacgaaaccagtggcatctactatacggaaatacgcgagcgcgagagagagaaatccgagaaaggcagacccccatgggcagccgtggtggggacaccccctcaggctcacacatctcttcagccacaccaccacccctgggaaccctccgtcagagaaagtttatgtagcacttggccctggaagaacgaagactttaatcagaagtttacccagctcctgctgctacagcgaccccatcccagatcccaggaccctctcgtcaagcgaagctggccagactacgttgaagagaacagggggcatctcatcgaaattagagacctgttcggcccaggactggacactcaggagccacgaatagtgatattgcagggagcagccggaatcggcaagagtaccctggccaggcaggttaaggaagcttggggtcgaggccagctgtacggagaccgcttccagcacgtcttttatttcagctgcagggagctagcccaatccaaggtggtgtctctcgccgaactcatcggcaaagacggaacagcaacgcctgctccgattcgtcagatcctgtcccggcctgaacgactgctcttcatactggatggggtggacgaacccggatgggtgttacaggaaccctcaagcgagttgtgtcttcactggtcacaaccccaacctgccgacgcacttttgggcagtctgctgggaaagaccattctgccggaggcctcatttctgattactgcacggaccacagcccttcagaatctcattccatctcttgagcaggccagatgggtcgaggtccttggctttagcgaatcgtcccgcaaggaatacttttacagatattttacagatgaaaggcaggccatcagggccttcagactcgtgaagtctaataaagaactgtgggcattgtgtctggtgccatgggtaagctggctggcttgcacatgtttgatgcagcaaatgaagcgtaaggagaaattgacactcacatctaagacaactacgactttatgtttgcactacctcgcccaagccctgcaggcgcaacccttagggccacagctccgagatctctgcagcctggccgctgaggggatctggcagaaaaaaacgctcttctctccggacgacctgaggaagcatggcctggatggagctatcatctccactttcctcaaaatgggcatcctgcaggaacaccccatccctctgtcttacagttttattcatttatgttttcaggagttttttgcagctatgagttatgtcctggaggatgagaagggcagagggaagcactcaaattgcattatcgacttggagaaaaccctcgaagcttacggtatccatgggctgtttggggcttcgaccactagattccttctcgggctgctctccgatgagggcgaacgcgaaatggaaaacatttttcactgtcggctgagccagggcaggaacctgatgcagtgggtccccagcctgcagcttctgctgcagcctcacagcctggaaagccttcattgtctgtacgagacccggaataagactttcctgacacaggtgatggctcattttgaagaaatgggaatgtgcgtcgaaactgacatggagcttctggtctgtaccttttgcatcaagttcagccggcacgtgaagaagctgcagctgatcgaaggtcgtcaacatagatcaacatggagcccaactatggtagtcctgttcagatgggtgccggtcaccgacgcttattggcaaatcctcttctccgtgctgaaggtcaccagaaacctcaaagagctggatctttccgggaatagcttatctcattctgccgtcaaaagcctctgcaaaaccctcagaagacctagatgtctcctggaaactctgaggctcgctgggtgtggactgactgccgaggattgcaaggatctcgctttcgggctacgcgctaaccagacgctgacggaactggacttaagcttcaacgtcctcacagacgccggtgctaagcacctgtgtcagcggttacgtcagccatcctgtaagctccagcggctgcagctcgttagttgcgggcttacatctgactgctgccaagatctggcatccgtgctgtctgcttctccatcattgaaggaactggatcttcaacaaaacaacctggacgatgtcggagtccgcttgctgtgtgaaggacttcgccatccagcctgcaaactcattcgattaggaaagccttctgtcatgactcctactgaaggactggataccggagaaatgagtaatagtactagctctctaaaacgtcagaggctgggttccgagcgcgcagcctcccatgttgcacaagccaaccttaaactcctagacgtctccaagattttccctatcgccgaaatcgcggaagaatccagcccggaggtagtccctgttgagcttctctgcgtgccatcacccgcatctcaaggtgatttgcatacaaagccattggggaccgacgacgatttctggggcccaacagggccagtggccactgaagtggttgacaaagagaaaaatctgtatcgcgtccactttcccgttgcgggatcataccgatggcctaacactgggttgtgctttgtcatgagggaggccgtgacggtagagatagagttctgtgtttgggaccagtttcttggcgaaataaatccccagcacagctggatggtggcagggcctctgttggacattaaagcggaaccgggagcagttgaagcggtccacctgccccactttgtcgccctgcaagggggtcacgttgatacgagtctctttcagatggctcactttaaagaagagggcatgcttctggaaaagccggctcgtgtggaactacaccacatcgtcctggagaatccgtcgttctcgcctctgggagtacttctcaagatgattcacaacgctttgcgcttcattcccgttacttccgtggtcctcctctaccaccgggtgcaccctgaagaggtgacattccacttgtacctgatcccaagcgattgttccatccgcaaagcaattgatgatctcgaaatgaagttccagttcgtgcgtatacataagccgcctcccctcacccccctctacatgggatgtagatataccgtgtccggttccgggtcagggatgttggagatcctgcccaaagagctagagctgtgctaccgtagtccaggggaagatcagctgttttcagaattctacgtgggccatctgggatctgggattcggctccaggttaaggacaaaaaggatgagactctcgtgtgggaggcacttgtgaagccaggagacctcatgccggcaacaacattgataccacctgcccgaatcgctgtgcccagccccctggacgcaccccagctgctgcacttcgtggaccagtatcgcgaacagctgattgcccgagtgactagcgtagaagtggttctggataagcttcacggccaggtgctctcacaggagcagtacgaaagagtgttggcagagaacacgaggccttcccagatgaggaaactctttagcctgtcccagtcctgggacaggaagtgcaaagacggcctctaccaggctcttaaggaaactcatccgcacctgatcatggagctctgggagaaaggttcaaagaagggcctccttcctcttagcagttag

SEQ ID NO: 5146 - DNA, 1527 bp, Artificial Sequence
  Description of Artificial Sequence: Synthetic coding sequence
atggcacatttcgaggaaatgggcatgtgtgtggagacagacatggagttacttgtttgtaccttttgcatcaaattttctcggcacgtgaaaaagctgcaacttattgagggcaggcagcatcgaagtacatggagcccaactatggtggtgctctttaggtgggttcccgtgactgatgcttactggcagattttattctcagtcctgaaggtgactcggaatctaaaggagctggatctgtcaggtaatagccttagtcattcagctgtgaagtcactctgtaaaactctccgccgaccccgttgcctgctggagacattgaggctggcaggatgcgggttaactgctgaggactgtaaggatctggccttcggactgcgtgcgaaccaaaccctgactgagctggacctgagtttcaatgtgctcaccgatgctggagccaagcacctctgtcaaagactaaggcagcctagctgcaaactgcagcggctccagctagtttcctgcggtctcactagcgactgctgtcaggatttagctagcgtcttatcagcgtctccttccctgaaggaactggacttgcagcagaataatctggacgatgtgggagtgcgcctactttgcgagggtctccgacatcccgcttgtaaactgatacgactggggctcgaccagacaacacttagcgacgaaatgcgtcaggaactcagggccctggagcaggagaaacctcagctactgatcttctccaggcgaaagcctagtgtcatgacaccaaccgagggcctggacacaggagaaatgtctaactccacatcgtcactgaagcgacagcgcctagggtctgagcgtgctgccagtcacgtagcccaggccaacttgaaacttttggacgttagcaaaatcttccccattgctgaaatcgccgaagagagttccccagaagtcgtgcccgtcgagctactttgtgtcccctctcctgcgagccaaggtgacctccatacaaagccactaggcacggatgatgacttttggggacccaccggtcccgtggccactgaggtggtggataaagaaaagaacctctacagagtccacttcccagtcgcaggaagttatcgctggcctaataccggcttgtgttttgtcatgagggaggccgttaccgtggagatagagttttgtgtgtgggaccagttcctcggtgaaattaaccctcaacactcatggatggtcgcaggacccctgctcgacattaaagcagagccaggcgctgtcgaggcggtccatctgccacactttgtcgctttgcagggagggcacgttgacacgagtctctttcagatggcacattttaaagaggaaggtatgctcctagaaaagccagccagggtcgagttgcatcatattgtcctggaaaaccctagcttttcgcctctgggcgtgttactgaagatgattcacaacgctctgaggttcatacccgtcacatcagttgtactgctgtaccatagaccaagctag

SEQ ID NO: 5147 - DNA, 4128 bp, Artificial Sequence
  Description of Artificial Sequence: Synthetic coding sequence
atggcagggggagcttggggccgtttagcgtgctacctggaattcctgaaaaaagaggagctcaaagaatttcagcttctgctggcgaacaaagcccactcaagaagctctagtggagaaacaccggcacagcccgaaaagacgtcaggcatggaggtcgcttcttatcttgtggcacagtacggcgagcagagagcctgggacctagcactccacacttgggaacaaatgggactccgttctttgtgtgctcaggcccaagagggggcaggccatagtccatcttttccttatagccccagcgagcctcacttgggctctccttcccaaccgacatccacagctgtactcatgccctggatccacgagctgcctgccggatgcacacaggggtctgagagacgggtgctcaggcagttacccgacacatcggggagacgctggcgcgagattagcgcctcactgttataccaggcccttccttcatcccctgatcacgaatctccttctcaggaaagccccaacgctccaacatccactgcggtattaggctcttggggcagccctccacagcccagtcttgcacctcgtgagcaggaggcgcctgggacccagtggcctttggacgagacatctggcatctactacactgaaatacgcgagcgcgagcgggagaagtctgagaaggggaggccaccatgggccgcagttgtgggaacaccgcctcaggcccatacctcactgcagcctcaccatcacccctgggaacccagtgttagagagagcctgtgctccacctggccatggaagaatgaggattttaatcagaagttcacacagttgttgctccttcagaggccgcatcccagaagccaagaccctttggttaagaggagttggccggattatgttgaagagaaccgtggccatcttattgagattcgtgatctgtttggccctggactggatacccaagaaccaaggatagtcatcctacaaggagcagcaggcatcgggaaaagcacgctggccaggcaagtcaaggaggcttggggacggggacaactgtacggtgatcgcttccagcacgtgttctatttttcgtgtagggagctagctcagtctaaagtcgtctcacttgcagaattaatagggaaagatggaaccgccacccctgcaccaatccggcaaattttaagcaggcctgaacggctgctcttcatcctcgacggcgtagacgagccaggatgggtcctccaggagccgtctagcgagctgtgtttgcactggtcacaaccccagccggctgatgccctgctggggtctttactgggaaagaccatactcccagaagcatcatttttaatcaccgcacggaccacagcgctacaaaaccttattccctctctggaacaagctaggtgggtcgaagttctggggtttagcgagtcaagccggaaggagtacttctatagatattttactgacgaaaggcaggcaatccgcgctttccgcctggttaagtctaataaggaactatgggctttgtgcctcgtcccttgggtgtcctggcttgcttgcacctgcctaatgcagcaaatgaaaagaaaggagaaactgactttaactagcaaaacaacaaccaccctctgtctccactatttggcccaagctcttcaggcgcagcccctgggccctcagctgcgagacttatgctccctcgccgcagagggtatttggcagaagaaaactcttttctctcctgatgatcttagaaagcacggactggacggcgctatcatttctacattcctgaagatgggaattctgcaggaacacccaatccccctcagttactcttttattcacctgtgctttcaggagttctttgcagccatgagctatgtgctggaggatgagaaaggacgcggtaagcacagtaattgtattatagatctagagaaaacactcgaggcttacgggatacatggcctctttggtgctagcaccacgagattcctcttagggttgttgtccgacgaaggcgagagggagatggaaaacatcttccactgtaggctctctcagggaagaaacctcatgcagtgggtgccctctctccaacttcttcttcaaccccattcactggaaagcttgcactgtctgtacgaaactcgaaacaagactttcttgacccaagtaatggcgcatttcgaagagatgggtatgtgtgttgagaccgacatggagttgcttgtgtgcactttctgcatcaagtttagtcggcatgtgaaaaaacttcagctgatcgagggtcgacaacatcgcagcacatggagtccaaccatggtggttctgttcaggtgggtgccagtcaccgatgcctattggcaaattttattctccgtgttgaaggttactaggaacctgaaggaattagacttatccggcaatagccttagtcattccgcagttaaatccctgtgcaaaactttgcggagaccacgttgcctgctggagaccctgcgcctagcagggtgcggccttactgcagaggattgcaaggatctcgccttcggcttgcgcgcaaatcagacacttaccgagttggatttgtcctttaacgtgctaaccgatgccggtgccaagcacttgtgccagaggctgagacagccgagttgcaagctgcaaagactccagctggtgagctgcggtctgacatcagactgttgtcaggacctggcatctgtgctgtccgcatcgcctagccttaaggaactcgatctgcagcagaacaatctagatgacgtgggagtacggttactctgcgaaggtcttcgacaccccgcttgcaagctgattcggcttggcctcgatcagacaacattaagcgatgaaatgaggcaggaactgagggctctggagcaggagaagcctcagctgctgatattctcaaggcgtaaacccagcgtgatgaccccaactgaggggctggataccggggaaatgtccaattccacatcctcgctgaaaagacagcggctgggctcagaaagggccgcatctcacgttgcgcaggcaaacctgaagctcctggatgtgtccaaaatcttcccaatcgcggagatcgcgggaaagtcacacgaagaatctagcccagaagtggtcccagttgagttgctctgtgtcccttctccagcttctcaaggggatctgcatactaagcccctgggaacagatgacgacttttggggtcccaccggccctgtggctacagaagtggtggataaggagaaaaacctgtatcgggtgcacttccctgtggcaggaagctaccgttggccgaacactgggctgtgttttgttatgcgggaggccgtgacagtggaaatcgagttctgcgtgtgggatcagtttcttggggagatcaacccgcaacattcctggatggtggcaggacctcttctggatattaaagccgaaccgggtgcagtcgaagcagtacacctgcctcactttgtagcactccaggggggtcatgtagacacaagtctctttcagatggcccactttaaggaagaagggatgttgctggagaaacccgctcgagtcgaactgcatcacatcgtgctggagaacccaagttttagccccttaggagtcctcctgaaaatgatacacaatgctctgaggttcatccccgttacaagcgtcgtgctactctatcacagagttcaccccgaggaggtgacttttcacctatatctgatcccatccgactgctccatcaggaaggccatcgatgacctagaaatgaagtttcagtttgttagaattcacaagccaccaccacttacacccctgtatatgggctgtcggtataccgttagtgggtccggctccggcatgctggagatcctgcctaaggagcttgaactgtgttatagatccccaggtgaggaccagctgttttccgagttctatgtgggtcacctgggcagcggcattaggctccaggttaaagacaaaaaggacgagaccttagtttgggaggccctggttaagcccggacggaacacatctcagccatggaatctgcgctgtaacagagacgctagacgctattag

SEQ ID NO: 5148 - DNA, 2703 bp, Artificial Sequence
  Description of Artificial Sequence: Synthetic coding sequence
atggagtcctgttacaaccccggtttggatggaattatcgagtatgacgacttcaaactcaactcatcaattgtggaaccaaaggagcctgccccagagaccgccgatggaccctatcttgtgattgtcgagcagcccaagcagcggggatttcgtttccgttacgggtgcgagggcccatcccatgggggtcttcccggagcctcctcggaaaaaggacgcaagacatatcccacggtgaaaatctgcaactatgagggtcctgctaaaattgaagtggatcttgttacccactcagacccacccagagctcatgcacatagtctggtgggcaaacaatgctcggaactggggatctgtgcagtctccgtggggccaaaggacatgaccgcgcagttcaacaacctcggggtactccatgtgactaagaaaaacatgatgggaacaatgattcagaaactgcaaaggcagcgccttcgatcccggccacagggccttaccgaggcagaacagcgagaactcgaacaggaggctaaggagctgaagaaggttatggacttaagtatcgttcgtttacgtttcagtgccttcctgcgcgctagtgatggatcttttagcctacctttgaagcctgtcataagccaacccatccatgactccaagtcaccaggagcctctaatcttaagatctcacgcatggacaagaccgccggatctgtgcggggtggagatgaggtgtacctgctgtgtgataaggtccaaaaggacgacatcgaggtgcgcttctatgaggatgatgagaacggctggcaagcctttggcgacttcagcccaaccgatgtgcacaagcagtacgctatcgtattccggacacccccataccataaaatgaagattgaaagaccagtgactgtgtttttgcaacttaaacgcaaaagaggaggcgacgtgtctgattcgaaacaattcacatactacccgctggtggaggataaggaagaagtgcagagaaaaagacgcaaggcgcttcccactttttcacagccctttgggggtggaagtcatatggggggtgggtccggcggagccgctggaggttacggaggtgccggtgggggaggatcgttgggtttctttcctagtagcctggcatatagtccgtaccagtcaggcgctggacccatgggatgttaccccggaggcggaggaggcgcacagatggctgcgaccgttcccagccgagacagcggagaggaggcagctgaaccttcagctcccagtcgcactccacagtgcgagcctcaagcgccagaaatgttgcagcgggctagagaatataacgcccgtctgttcggactcgcccagcgtagcgccagagccttattagactacggtgtcacagctgatgctcgagcgctcttggcagggcaacggcaccttcttaccgcccaggatgagaatggcgacaccccgcttcacctggccatcatccatgggcaaactagcgtgatcgaacagatcgtatatgtgatccaccacgcacaggacctcggcgttgtaaacctaaccaaccatttacaccagacacctttacacctggcggtgataaccggacagaccagcgtggttagttttctgctgcgcgtgggggcagacccagcccttctcgaccggcacggtgactccgctatgcatctcgccttgagggcaggcgcaggtgctcccgagctcctccgagctcttctgcagtccggagcccctgccgtgcctcagctcctgcacatgcccgatttcgaggggctctatccagtgcatctggcggtcagagcaaggtcgcccgaatgcttggacttattagtggactccggcgcagaggttgaggccactgaacgacaaggaggacgcacggccctccacctggccaccgaaatggaggagctaggtctggtaacccacctagtcaccaaactccgagccaatgtgaatgcgcgaacttttgctgggaacaccccactgcatttagcggcaggccttggataccccacccttacaagactgcttctgaaggctggagctgacatccacgcagagaatgaggaaccactgtgtcccctccctagccctcctactagcgactccgactccgatagcgaagggccagagaaggacacaaggtcatcctttcggggacatactcccctagacctcacttgttccacaaaggtgaagaccttgctgcttaatgcagctcaaaataccatggagccaccccttacccccccaagccctgcgggtcccggactctccctcggtgacactgctctgcagaatcttgaacaattgctcgacggtcccgaggcccagggctcctgggcggaactggctgagcgcctgggtttgagatccttggttgatacctacagacaaaccacatctccttccggaagtctcctcagatcttacgaactggctggcggagacttggcgggtcttctagaggccctgtcggatatggggctagaagaaggtgtccgcctccttcggggacctgaaacaagagataagctaccaagtacggccgaagtcaaagaggactccgcatatgggagccagtctgtagagcaggaggctgagaaactcggcccacccccagagccccctggcggtctgtgccacggacacccccaaccccaagtacactag

SEQ ID NO: 5149 - DNA, 2700 bp, Artificial Sequence
  Description of Artificial Sequence: Synthetic coding sequence
atggaatcatgttataacccaggtttagatgggattatcgaatacgacgattttaaactgaattcctccatcgtcgagcccaaggaacccgctcccgagacggcagacggtccttatcttgtgatagtagaacagccgaagcagcgtggctttaggttcaggtacgggtgcgagggacctagccacggcggactgcccggtgcttcaagcgagaaaggccgtaagacctaccctacagtgaagatctgcaactacgagggaccagccaagatcgaggtggatttggtgacccactctgatccacccagggcccacgcccattccctcgtgggaaagcagtgctccgaactgggcatctgcgcagtgtctgtggggccaaaggacatgacagctcagttcaacaatctcggggtgctccatgtcactaaaaagaatatgatgggaaccatgatccagaaactccagcgtcagcgactccgatctaggccccagggtctcaccgaagctgaacagcgggaactcgagcaagaggccaaggagcttaagaaggttatggatctttcaatcgttcggttaagattcagcgctttcctgagagcttcagacggcagctttagtctccctcttaagccggtgatttctcaacctattcacgattccaaatcccccggtgcaagcaacctgaagatatcccgtatggacaagacagccggtagtgtccggggtggagatgaggtgtacttactctgtgataaggtgcagaaggatgacatcgaggtgcggttttacgaagacgacgaaaacggttggcaagcttttggggacttttcccccaccgacgttcataaacagtatgccatcgtgtttaggacacccccatatcataagatgaagattgagcgtccagtgactgtattcttgcagctgaaacgcaagagaggcggtgacgtgtcggattctaaacagttcacttattacccactcgtcgaggacaaggaagaagtgcagagaaaacgacgcaaggcactccccactttcagccaacctttcggtggcggtagccacatgggcggaggttctggaggagcggcaggaggatacggaggcgctggaggcggaggctccttaggattcttcccttcctctctggcttatagtccataccagagcggcgctgggccaatggggtgttaccccggaggcggaggcggagcacagatggctgcgactgttccgtcacgggacagtggagaggaagctgccgagccctccgcgccttctcgcacgcctcagtgcgaaccacaggcccctgagatgctgcaaagggcgagggagtacaatgctcggcttttcggcctggcccagcgatccgcaagagcattactcgactatggagtgactgctgacgcccgagccttactcgccggacagaggcacctgctgacagcccaagatgaaaatggcgatactcctctacacctagctattattcacgggcagacttcggtgatcgaacagatcgtgtatgtaattcaccacgcccaggatctgggcgtggtcaacctcaccaatcatcttcaccagactcccctgcacttagccgtaattaccggacagacgtcagtggtaagctttctgctgagggtaggagcagaccccgctctccttgaccgtcatggcgattctgccatgcaccttgccctcagagccggagccggagcaccagagttgctgagagcgctactccagtctggagctcctgctgtgccacagctgttgcacatgccagacttcgaaggactgtaccccgtccacctggccgtgagagccaggtctccagagtgcctggatctgctcgttgacagcggggcagaggtagaagcaaccgagcgtcaggggggtaggaccgctttgcatctggctaccgaaatggaagaactgggtctagtgacacacctggtgaccaaactgcgggctaatgttaatgccaggacatttgccggtaacacccctctccatttagcggctggcctggggtaccctacactcacccgactgcttctgaaagccggtgcggacattcacgctgagaatgaggagcccctgtgcccattaccaagcccgccaacatccgattccgattctgacagtgagggtccagaaaaggacaccaggtcatccttccgcggacacaccccacttgacctcacatgtagcaccaaggtaaaaacactcctattgaacgctgctcagaatacaatggagcctccgctgacaccgccatctccagcaggacccggactcagcctgggcgacacagcacttcaaaatctagagcagttgttggacggcccagaggcacagggctcgtgggccgagctggctgaacgcctcggcctgcgtagccttgtggacacctaccgccaaaccacctctcccagtggaagcctactgaggtcttatgagctggctggaggcgaccttgccggtcttcttgaggccttgtccgacatgggcctggaagagggcgtgcgattgctccgagggccagagactcgcgataagttgccctcgactgaagtgaaagaagatagtgcatacggcagccagtccgtggaacaggaagcagaaaagctgggccctccccctgagcctcccggtggcctctgtcacggccacccgcagccccaggtccattag

SEQ ID NO: 5150 - DNA, 2703 bp, Artificial Sequence
  Description of Artificial Sequence: Synthetic coding sequence
atggagagttgttacaaccccggactggatggaatcatcgaatacgatgattttaagctaaattcctctatcgtggaacccaaggagccagcccctgagacagctgacggcccatacctagtcatagttgagcagccgaagcaacggggatttcggtttcgttacgggtgcgagggaccaagccatggaggcctgcccggtgcaagtagcgagaaaggccgaaaaacctaccctactgtaaagatttgtaattatgaaggtcccgcaaagatcgaggttgacctagtcacccatagcgatccgcctcgggctcacgcccacagcctcgttggcaagcagtgtagcgagcttggtatctgtgccgtgtctgttgggccaaaagacatgactgcgcagttcaataacttgggggtgctccatgtgacgaagaagaatatgatgggtaccatgatccaaaaactgcagagacaacgactccgctcacggcctcagggattgaccgaggctgagcaaagggagctagagcaagaagctaaagaattgaagaaagtaatggatctgtcaatcgtaagactccgtttttcagcctttctgagagcaagcgacggtagcttctcactcccactgaagccggtgatttcccagccaattcatgactctaagagtcccggagcatcaaatttaaagatctccagaatggataagaccgccggttctgtccgaggtggggatgaagtctacctgctgtgcgacaaagtccagaaagacgacatcgaagtgcggttctatgaagacgatgaaaacggatggcaggccttcggcgatttctcgcccaccgacgttcacaaacagtatgccatagtattccgcaccccgccataccacaagatgaagattgaaaggcccgtcacggtgttcctgcaacttaagaggaaacggggaggcgacgtctccgactctaaacagttcacctactacccccttgtcgaggataaggaggaggtgcagaggaagcgcaggaaagccctcccaacattctctcagccattcggtgggggaagtcacatgggagggggatctgggggtgcggcaggcggatatggaggggcaggagggggtggcagcttaggatttttcccctcctccctggcgtattctccttatcaaagtggggctggccctatggggtgctaccctggcggaggaggcggtgcacagatggctgctaccgtacctagcagagactctggggaagaggctgcagagcccagtgccccttcccgtaccccgcagtgcgagccccaggcccctgaaatgctgcagcgagctagagagtataacgcgaggctgtttgggttagcccaacgaagcgccagggccctcctggattatggcgttacggctgacgctcgcgctctcctggcagggcaacggcaccttttgaccgcacaggacgagaatggagacactccactgcacctggccattatccacgggcagacctccgtaatcgaacaaatcgtgtacgtgatacaccatgctcaagacctcggtgtggtgaatctgaccaaccacctgcaccaaacacctctacatttagcggttatcactggtcaaacctctgtggtgagcttcctgctccgagtgggagcggaccctgcactcctggatagacatggcgacagcgccatgcacctggcattgagggccggagctggcgctccggagcttctaagagctctgctacagtcgggcgcacccgcagtccctcagttgcttcatatgcctgatttcgagggtctgtaccccgtgcaccttgccgttagggccagaagccccgagtgcctcgacctcctggtggactcaggcgcagaagtggaggctactgaaaggcaggggggacgaacagctttgcatctggctactgagatggaagagctgggactagtaacacatttggtgactaagcttcgagcgaacgtgaatgcacgtacctttgctggcaacaccccactccacttggcagccggactcggttacccgacactgaccagactgctcctcaaagctggcgcagacattcacgccgagaacgaagagccgctttgtcccctgccatcccctcccacgagcgacagcgactccgactcggaaggaccagagaaggataccaggtcttctttcagaggacacacgcccctggacctaacctgcagcactaaggtgaaaactctactcctcaacgccgcacaaaacactatggagccaccccttacccctccttctcccgcaggacctggcctcagcctgggtgacacggctctacagaacttagagcagctgctggatggtcctgaggcccaggggagctgggccgagttagctgaaaggctaggactgagatcattagttgacacctatagacagaccacaagtccgtcagggtcacttcttaggagctatgagctggctgggggtgatctggcaggtcttctcgaagccttaagcgacatggggctggaggagggtgtaagattgctgcgcggaccagagacaagggataagctgcctagcaccgctgaggtgaaggaagactctgcttatggttctcagtcggttgagcaagaggctgaaaaattgggaccccctcctgagccccctggcggtctatgccacggccatccccagcctcaagtgcactag

SEQ ID NO: 5151 - DNA, 2700 bp, Artificial Sequence
  Description of Artificial Sequence: Synthetic coding sequence
atggagtcatgctacaaccctggactggatggcatcatcgagtacgacgacttcaagttgaactcatcgatagtcgagcctaaagagccggctccggaaaccgccgacggcccttacctggtgatcgttgagcaacccaagcagcggggattccgctttcggtacggctgcgagggcccttcacacggcggactgcctggagcatcctccgagaaaggtcgcaaaacatatcccacagtgaagatctgtaattatgagggccctgcgaagatcgaggtggatttggtcacccactccgaccccccaagggcacacgcccactcgcttgtgggtaagcagtgttcagaactcggcatctgcgccgtatctgtcggccctaaagacatgaccgctcaatttaacaacctcggtgtcctacatgttactaaaaaaaacatgatgggcaccatgatccagaagttgcagcgacagcgactgcgctcaaggccacaaggactgacagaagccgaacagcgggagctggaacaggaggccaaagaacttaagaaagtcatggatctctctattgtgaggctgagattttccgctttcctacgtgcttccgatggcagcttttcactccctttaaaaccagtcatttctcagcctatccacgattccaagagtcccggagcaagcaatctaaagatttctcggatggataagactgcaggctctgtgcggggtggtgatgaagtctacctcttgtgcgacaaagttcaaaaggatgatattgaggtgcgtttctacgaggatgatgagaatggatggcaggcattcggcgactttagccccactgacgtgcataaacagtatgctatagtgtttaggactcccccttaccacaagatgaagatcgagcggcctgttaccgtgttcttacagctgaagaggaagagaggtggggatgtgagtgattctaagcagtttacttactaccccctggtggaagacaaggaagaagtgcagaggaaacgaaggaaagctcttcccactttctcacagcccttcgggggaggttctcatatggggggaggcagcggcggagctgccggaggctatgggggagcaggcggtggaggtagtctgggcttctttccctcttccctggcctacagcccatatcagagcggtgccggtccaatgggctgctatccaggcggtggaggaggagcccagatggctgcgacagtcccttcccgcgacagtggtgaggaagccgctgaacccagcgccccttctcggaccccccagtgtgagcctcaggctcctgagatgctgcagcgggctagagagtacaatgctcggctgttcggactcgcgcagcggtccgctagggcgctcctggattatggagtgacggcggatgcacgggcattgctggcaggccagcgacacctgttgactgcacaggacgagaacggagacacaccactgcaccttgccattattcacgggcaaacctcagtgattgaacagatcgtttatgtgatccaccatgcacaagaccttggggtggtgaatcttaccaatcacctccatcaaacacccctgcacctggccgtaattaccggacaaacctccgtagtgtccttccttctaagagtcggggctgatcctgccctcctcgacagacacggggattccgcaatgcacctcgctctacgagctggagctggagccccagaactgctgcgagccttgctgcagagtggcgcacctgcagtgcctcaactgttacacatgccagacttcgaaggtctgtatcccgtgcatctggcagttagggccagatcccccgaatgcctggatctgctcgtggatagcggagcggaggtggaagccaccgaaagacaggggggtcgaactgctctgcacctggctaccgagatggaggaactcggattggtgacccatctggtgactaagctccgtgccaatgtgaatgctagaactttcgccggaaacacgccactgcatctcgctgccggattaggctaccccaccttgacacgtctgttgctgaaggctggtgcagacatccacgcagagaacgaggagcctctctgcccactgcccagtcctccgacctcagattcagattcggactctgagggcccagagaaagacacgcgaagctcttttcgcggacataccccgctagacctcacctgttccactaaggtgaaaactctgcttctgaacgcagctcagaataccatggagcccccacttacacctccatctcccgctgggcctggactatctctgggtgacacagcgctccaaaatttagaacaacttttagatggtccagaggcccaggggtcatgggctgaactcgccgagaggcttggcctccggtcattggtggatacctatcgccagaccaccagcccgtccggctctctgctccggtcatatgagctcgccggtggggatctcgccggtttgttagaggcactgagcgacatggggttggaggaaggtgttcgcttattgcgaggtccagaaacgagagataagctgccctccactgaggtgaaagaagattccgcttacgggtcccagtctgtggaacaagaggccgagaagctgggaccaccaccggagccacctggcggtctgtgtcatggtcacccccagccacaggtccattag

SEQ ID NO: 5152 - DNA, 804 bp, Artificial Sequence
  Description of Artificial Sequence: Synthetic coding sequence
atgccacgagcatttctggtaaaaaagccctgcgtttctacttgcaagcgtaactggagtgagctgccagacgaagaacgcggtgagatctatgtgccggtttctcttggcttctgtcctcctcagccctatcgggagcccgaaccgtcagtagcagagcctccctcctgtcctcttgccctgaatatgagtctgcgcgactcatcctactctatggcccctggcccttgcgtggtggcacaacttccaagcgaggatatggggcacctgacagatcctcaatctagggatcacggtttcctgcggacgaaaatgaaggtgacccttggagatagtcccagcggcgatttgttcacttgcagggtgtgtcagaaggcctttacttaccagcggatgctgaaccggcatatgaaatgccataatgacgtgaaacgacatctgtgcacttactgcggcaagggattcaatgacaccttcgatctgaagcgccacgttaggacgcatacaggggttagaccatacaaatgcagtctctgcgataaggcctttacccagaggtgcagtctggagagtcatctgaagaaaattcacggagtgcagcaaaagtacgcctataaggaacgccgagccaaactctatgtttgcgaggaatgtgggtgcacgtccgaatctcaagaggggcacgtattgcacctcaaggaacatcatcccgattcccccctgttacgcaagacttcaaaaaaggtcgctgtggctctacagaatacagtgacgtctctcttacagggtagcccacatctgtag

SEQ ID NO: 5153 - DNA, 1095 bp, Artificial Sequence
  Description of Artificial Sequence: Synthetic coding sequence
atgcatcgcttaatttttgtttacacacttatttgtgcgaatttttgtagttgtagggacacatccgctacccctcagtcagcgagcatcaaggcactccgcaacgccaatctccggagggacgacctgtaccgcagagatgaaacgatacaggttaagggtaacggttacgtgcagtccccccgattcccaaactcataccccagaaacctcctactgacgtggaggctgcattctcaggaaaatacacggatccagctcgtcttcgataaccagttcgggcttgaggaagctgaaaatgatatctgccgctacgatttcgtcgaggttgaagacatttctgagacgtccactattatcagagggcgatggtgtggccacaaagaagttccaccacgtataaaaagccggacaaatcagattaaaattacgtttaagtccgacgattacttcgtggccaagcccggatttaagatttattatagcctgctggaggacttccaacctgccgcagcttctgagactaactgggaaagtgtgacaagcagcatctcaggcgtgtcttacaacagcccctccgttactgatccaaccctgatcgctgatgccttggataagaagattgccgagtttgataccgtggaggacctcctgaagtatttcaacccagagtcatggcaggaagacctggagaacatgtacctggacactccacgctaccgtggtcgcagttaccatgatcggaagagcaaggtggacctcgatcggttgaatgacgacgccaagaggtactcttgcacccccagaaactattctgtcaatattcgggaggagttgaagctcgcgaatgtggtgtttttcccaagatgtctcctggtgcagcgctgtggcggtaactgcgggtgcggaacagtaaattggagaagctgcacctgcaactccggaaaaaccgttaagaagtaccacgaggtgttgcaatttgaaccgggacacattaaacggaggggccgagctaaaacgatggctttagttgacatacagttggaccatcacgaaaggtgtgactgtatatgctctagcagaccccctagatag

SEQ ID NO: 5154 - DNA, 1113 bp, Artificial Sequence
  Description of Artificial Sequence: Synthetic coding sequence
atgcacagactcattttcgtctataccctgatctgcgccaacttctgcagctgccgagacacaagcgccaccccacagtctgcctcgataaaggcactcaggaacgcgaacctgagacgggatgaatctaatcacctcactgacctgtacagacgcgatgagactatacaggtgaaggggaacgggtacgtgcagtccccaaggtttcccaacagctaccctcgcaacctattgttgacctggcgcctgcacagccaggaaaatacgagaattcaactcgtcttcgacaaccagtttgggctcgaggaggcagaaaacgatatttgccgctatgacttcgtagaagtggaggacataagcgagacctccacaattatcaggggacggtggtgtgggcacaaggaagtcccccctagaatcaagtccagaactaatcagatcaagatcacattcaagtctgatgattacttcgtcgcgaagccaggatttaagatctattactcgctgctcgaagattttcagccagccgctgccagtgagacaaactgggaatcagtgacctcctctattagcggagtatcttacaacagcccaagtgtgactgatccgaccctcattgctgacgctctggataagaagattgccgaattcgatacagtcgaggatcttctgaagtattttaaccctgaatcttggcaggaggacctggagaacatgtatttggacactccgagatacagaggcaggagctaccatgacagaaagagcaaagtggatctcgaccggctgaacgacgacgccaaaaggtacagttgcactccacggaactattcggtgaatatccgggaagagctgaaactggctaatgtcgtattcttccccaggtgtctactggttcagcggtgtggcggtaactgtgggtgtggaacagtcaactggcgctcctgcacctgtaacagcgggaaaacggtgaaaaagtaccatgaggtgctgcagtttgagcctggccacattaagagacggggtagagcaaagacgatggcgctggtcgatatacagctggatcaccatgagcggtgtgattgcatttgcagctcgcgcccaccccgttag

SEQ ID NO: 5155 - DNA, 726 bp, Artificial Sequence
  Description of Artificial Sequence: Synthetic coding sequence
atgaataggtgttgggctttatttctgtccctttgctgttaccttaggctcgtatccgccgaaggagacccaatccccgaagagctatacgagatgttgagtgatcactctattcggtccttcgatgatttacaaaggctgctgcacggcgacccaggcgaggaggacggggcagagctagatctcaacatgactcggtcacattctgggggagagttagagtcactggctcgaggcagaagaagcctaggaagtctgactatagccgagccagctatgattgccgaatgtaaaacccgaacagaggtgttcgagatcagtagaaggctaatcgatcggacgaatgctaacttccttgtctggcctccctgcgtggaagttcagagatgtagcgggtgctgcaataataggaatgtacagtgccggcctacacaggtccagctgcgccctgtgcaggttcgaaagatagaaattgtgagaaagaaacccatcttcaaaaaggccactgtcactctggaggaccacctggcttgcaagtgcgagacggtggcagcagcccgtcctgtcacgcgcagccccggaggatctcaggagcaacgggctaagactccccagacacgcgtaacaattcgcacggtcagggtgaggcggcctcctaagggcaaacatcggaaatttaagcatacacacgataagaccgcgctcaaagagactttgggcgcttag

SEQ ID NO: 5156 - DNA, 681 bp, Artificial Sequence
  Description of Artificial Sequence: Synthetic coding sequence
atgtttatcatgggtctgggtgatccaatcccagaggagttgtacgagatgctgtcggatcattccattcggtcctttgacgatttgcaaagactgctccatggagatcccggagaagaagatggggctgagctggacctaaatatgaccagaagccatagtgggggtgagctggagtcactcgcacgaggcaggagatccctgggatccctcactattgctgagccagcaatgattgcggagtgcaagactagaactgaggtgttcgagatcagccggaggctgatagaccggacaaacgcgaattttctggtgtggccaccttgcgtggaggtgcagcgctgctctgggtgttgtaacaatcgaaatgtgcagtgtagacccactcaggtgcaactcagaccagttcaagttaggaagatcgaaatcgtgagaaaaaagccaatctttaagaaggctacagtaacgttagaggatcaccttgcatgcaagtgcgagacagtcgcagccgcacggcctgtcactcgaagccctggtggctcacaggaacagcgagctaagacaccacagactcgtgttaccatccgaaccgtgcgcgtaaggaggccgcctaagggcaagcatagaaagtttaagcacacccacgataagacagcactgaaagaaacccttggggcatag

SEQ ID NO: 5157 - DNA, 411 bp, Artificial Sequence
  Description of Artificial Sequence: Synthetic coding sequence
atgttgagcgaccacagcatcaggtctttcgacgacctgcagagattgctgcacggcgaccccggtgaggaagatggggctgagctggacctcaatatgactaggagtcatagtgggggtgaacttgagagtctagcccgagggagacggtctctggggagcctgaccatcgctgagcctgccatgattgctgaatgcaagacccgtaccgaggtgttcgaaatatctaggcggctcatcgaccgaactaatgcaaattttctcgtctggccaccatgtgtcgaggtgcaaagatgtagtggctgctgtaataaccgcaatgtgcaatgtcgacctactcaagttcagctccgccctgtgcaggtgcgcaagatagaaatcgtgcgaaagaagccgattttcaaaaagtag

SEQ ID NO: 5158 - DNA, 435 bp, Artificial Sequence
  Description of Artificial Sequence: Synthetic coding sequence
atgctgtcagaccactcaattcgtagctttgatgatctccagaggctgttacacggagaccccggagaggaagatggggctgagctggatctaaacatgacccgaagccactctggaggagaattagaatccttggcccgagggagaaggtcattggggtctttaacaatagctgagcccgcaatgatcgccgaatgcaaaaccaggacagaagtttttgagatatcaaggagattaattgaccgaactaatgcaaactttcttgtttggccgccatgtgtggaggtgcaacgatgttccgggtgctgtaataataggaacgtccagtgccgccctacacaagtgcagctgaggcccgtgcaggtccgtaagatagagatcgtgcgaaaaaagccaattttcaagaaagccaccgtcaccctggaggaccactag

SEQ ID NO: 5159 - DNA, 804 bp, Artificial Sequence
  Description of Artificial Sequence: Synthetic coding sequence
atgcccaggtcctgttgtagccggtccggggcactcctgctggcactgctgctccaggcaagtatggaagtgcgaggttggtgcctcgagagttctcaatgccaggacttaaccaccgagtcaaacttgctggagtgcatccgggcttgcaagccagatctgagtgcagagaccccaatgtttcctggcaatggtgatgaacaaccattaaccgaaaatcctcggaagtatgtgatggggcatttcaggtgggatcgcttcggcaggcggaacagttcatcttccggctcttcaggcgctggtcagaaaagagaagatgtgagtgccggtgaagattgtggaccgctgccagaggggggaccagagcccaggagcgacggagcgaagccaggtcctcgcgaggggaaacgcagctattcaatggaacacttccgttgggggaaaccagtgggtaagaagcgcaggccagtgaaggtctacccaaatggagccgaggacgagtccgcagaggcgtttccattggagtttaagcgtgaactgaccggtcagcgactgcgggagggggatggccctgatggcccagctgacgacggggcaggcgctcaagccgaccttgagcactcgctgctggtagctgccgagaaaaaagatgaagggccatatcgaatggaacacttcagatggggctctcctcccaaagacaagcgttacgggggattcatgacgtccgagaagagccagacccccttagtcacgctttttaaaaatgccattataaagaatgcatacaagaaaggtgagtag

SEQ ID NO: 5160 - DNA, 804 bp, Artificial Sequence
  Description of Artificial Sequence: Synthetic coding sequence
atgcctaggtcctgctgttctcgcagcggcgcattgctgttggcacttctcttgcaggcttcaatggaggtcaggggttggtgcctggagtcatctcagtgccaggacctcacaacagaaagcaatcttctcgaatgtattcgggcttgtaagccagacctgagtgcagaaactccgatgtttccaggaaacggagacgagcagcccctgacggaaaatccccgtaagtacgtgatgggccacttccggtgggaccgcttcggaagacgaaatagttcttcctcaggcagcagcggtgccggtcagaagcgggaggacgtcagcgccggtgaagactgcggaccgctgcctgagggaggccctgaacctcggagtgacggcgctaagcccggaccaagagaaggtaaacgatcatattctatggaacactttcgctggggtaagccggttggcaaaaagagacgcccagttaaagtttatcccaatggggctgaggatgagtcggccgaagccttccctttagaattcaagcgggaactaacaggccagaggttacgcgaaggcgatgggcctgatggtcccgctgatgacggagcaggcgctcaagcagatttggaacactcactgcttgtggctgcggaaaaaaaagatgagggaccttatcgaatggaacacttcaggtgggggagccccccaaaagacaagaggtacggcggtttcatgacaagcgaaaagagccagactccacttgttaccctgttcaagaacgccataatcaagaacgcatataagaaaggcgagtag

SEQ ID NO: 5161 - DNA, 804 bp, Artificial Sequence
  Description of Artificial Sequence: Synthetic coding sequence
atgccaaggtcatgttgttctaggagcggcgcactgctcctcgcacttttgctgcaggcctctatggaggtgaggggttggtgtttggagtccagccagtgtcaggacttaactacggagtcgaacttactggaatgcatcagagcgtgcaagcccgatctttctgccgaaacccctatgttccctggcaatggcgacgagcagcccctcaccgaaaatcccagaaaatacgtcatgggacattttaggtgggacagattcgggcgtagaaactcatcttcttccggctcatctggagccggtcagaaaagggaggatgtgtccgccggagaagactgtgggccattgccagagggtgggcctgagcctcgctcggatggagccaaacctggtccacgtgagggcaaacgttcttacagcatggaacactttcggtggggtaagccagttggtaagaaacgacgacctgtcaaggtctacccaaatggagccgaggacgaatccgcagaagcgtttccactagagtttaaacgtgaacttacagggcagcgcctgagggaaggcgacgggcctgacgggcctgccgatgatggagctggggctcaggccgatctggagcattccctgttggttgccgctgaaaaaaaggatgagggtccttataggatggaacatttcaggtgggggagccctccgaaggacaagagatacggaggattcatgacttctgaaaagtcacagactcccctggttaccctctttaaaaatgccattatcaagaatgcctacaagaagggcgagtag

SEQ ID NO: 5162 - DNA, 804 bp, Artificial Sequence
  Description of Artificial Sequence: Synthetic coding sequence
atgcctcggagctgttgtagtcgatcaggggcactgctgctcgcactcctgctccaagcatcgatggaggttcgaggttggtgtctggagagcagccagtgtcaggatcttaccaccgaatcgaatctgctcgaatgtattagagcctgtaaacctgatctaagcgcggaaacacctatgtttccaggtaacggggatgagcaacctctcaccgaaaacccacgcaaatatgtaatgggtcacttcaggtgggaccgattcggcagacgcaattcaagctcctccggctcctctggagccggtcaaaagagagaggacgtgagcgctggtgaggactgtggtccactgccagagggcggacctgagcctcggtcagatggagctaagcccggaccccgtgagggaaaaagatcgtatagcatggagcactttcggtggggaaaacctgttggtaagaagagaagaccggtcaaggtgtaccccaatggtgccgaggacgagtccgccgaagcttttccattagaatttaagagagagctgactgggcaaagattaagagagggagatggcccagatggacccgctgatgacggcgctggcgcacaagccgacttggagcactccctgctcgtagccgcagaaaagaaagacgaggggccatacaggatggagcacttccggtggggttcacctcctaaggataagaggtacggcggatttatgacgtcagaaaagtcccagactcctcttgtaacccttttcaagaacgcaattattaaaaacgcatataaaaagggcgagtag

SEQ ID NO: 5163 - DNA, 741 bp, Artificial Sequence
  Description of Artificial Sequence: Synthetic coding sequence
atgccccgatcctgttgtagtcggtcgggcgctctgctattagctctactgttacaggcctccatggaggtgaggggctggtgtttggagtcttcccagtgccaggacctgacaaccgagtccaatctgctggaatgcatccgcgcatgcaagcccgacctctccgctgaaaccccgatgttccccggaaacggagatgagcagcccctcacagaaaatccacggaaatacgtgatgggccactttcggtgggatcgttttggaagaagaaactccagcagttccgggagttcaggggcagggcagaaacgcgaggacgtttctgctggggaggactgtggccctcttccagaaggaggaccggagccgcgatctgacggagccaagcctggtcctagagaggggaagagaagttactctatggaacattttcggtgggggaagcccgttggcaagaagaggcgcccagttaaagtttacccaaatggagctgaagatgagtcggccgaggctttcccacttgaatttaagcgcgagctgacaggacagagattgcgcgaaggggacggccctgacggtcccgctgatgacggtgcaggcgcacaggcggatctggaacattctcttctcgtggccgctgaaaaaaaggatgaagggccttatcgcatggaacacttccgctggggctcccctccaaaggacaaacgctacggcggttttatgacttccgaaaaatcatag

SEQ ID NO: 5164 - DNA, 459 bp, Artificial Sequence
  Description of Artificial Sequence: Synthetic coding sequence
atgacctgtaccgatcagaagtcccacagtcagcgggcattaggcacacaaacacctgcccttcaaggccctcagttacttaatactgatccaagcagtgaggagacacgtccaccccacgttaatcccgaccgcctgtgtcacatggaaccagctaaccatttctggcatgcaggggacctccaagctatgatctccaaagagttccaccttgctgccactcaggacgattgtaggaaggggaggactcaggaggacattttggtcccttcttcgcatccagagctgtttgcatctgtgctgcccatggctccagaagaggccgctaggctgcagcagccgcagcccctgccccctccaagcgggatccatttgtccgcctctagaacactggcacccaccctgctctatagttctcctccatctcactctcctttcggcctgagctccctgatctag

SEQ ID NO: 5165 - DNA, 315 bp, Artificial Sequence
  Description of Artificial Sequence: Synthetic coding sequence
atggaaccagcgaaccacttctggcatgcaggagacctccaggctatgatctctaaggagttccacttggccgctacgcaggacgattgcagaaagggtcggactcaggaggatatactcgtgccctcctctcatccagagctgttcgcctcagtgcttcccatggcccctgaggaggctgctcggttgcagcagccacagccactgccaccccctagcggcatccatctaagtgcctccaggacactggcccttaccttattgtactctagccccccaagccactcaccgttcggactgtcatccctcatttag

SEQ ID NO: 5166 - DNA, 459 bp, Artificial Sequence
  Description of Artificial Sequence: Synthetic coding sequence
atgacatgcactgaccagaaaagccatagtcagcgagccctcggcacgcagacaccagccctccaaggccctcagttgttaaataccgatccgagctcagaggaaacacgcccaccccatgtgaatcctgacagactttgtcatatggaacccgcaaaccatttttggcatgccggtgacctacaggctatgatctcgaaagaatttcatcttgcagctactcaggatgattgccgtaagggccgtacacaagaggacatactggtcccctcatcacatcctgagctgttcgccagcgtgcttcctatggctcctgaggaggcagcacgtctgcaacaaccccagccccttcctccacccagtgggatccatctttctgctagtcgcacgttggcgcctactctgctttatagcagcccacccagccactctccctttgggctctcatctctaatctag

SEQ ID NO: 5167 - DNA, 459 bp, Artificial Sequence
  Description of Artificial Sequence: Synthetic coding sequence
atgacttgtaccgatcagaaatcacatagtcagcgggctctcggcactcaaacgcccgctctccagggtccacaactactcaacactgacccctcgagtaaagaaacccggccaccacacgtgaatccagatcggctatgtcacatggagcctgcgaaccacttctggcacgcaggcgacttgcaggcgatgatcagcaaggaattccacctggcagctacacaggacgactgcaggaaaggcagaacacaggaagatatcctcgtccccagctctcatcctgagctattcgcgtcagttcttcctatggctcccgaagaggctgcccgtctgcagcagcctcagccgctccccccaccaagcggcattcacctgagcgcgtcgagaactttggcccctaccctgctctactcctccccaccctctcattcgccatttgggctgagctctctcatttag

SEQ ID NO: 5168 - DNA, 459 bp, Artificial Sequence
  Description of Artificial Sequence: Synthetic coding sequence
atgacttgtactgaccagaagtcccatagtcagcgtgctcttgggacacagacaccagccttacaagggccacaacttctgaataccgacccaagctcggaggagaccaggccgcctcacgttaatcccgacagactgtgccacatggaaccagccaaccatttttggcatgcgggtgaccttcaggccatgatatcaaaagagttccacctcgccgctacccaggacgattgtcgcaaaggcagaacgcaggaggacatattggtaccctctagccaccccgagctcttcgctagtgtgctccccatggcaccggaggaagcagctcgactccagcagccgcaacctctgcctccaccgtctggaatccacctcagcgcctcacgaacactcgctcccaccctcctgtactctagtcccccttcccattcgccctttggtttatcctctctaatctag

SEQ ID NO: 5169 - DNA, 459 bp, Artificial Sequence
  Description of Artificial Sequence: Synthetic coding sequence
atgacatgtaccgaccagaagagccactcccagagggccttgggcactcagacccccgctcttcagggtccccaactgctgaacaccgatccctcaagcgaggaaactcgacccccacacgtcaaccctgatcgtctttgtcacatggaacccgcaaaccatttctggcatgctggcgacctccaggccatgattagcaaggaatttcatctggcagcaactcaagatgattgtaggaaaggaaggacacaggaggacatccttgtaccgagctctcatcccgaactgttcgcttcagtccttcctatggcacctgaagaagcagctcggctacaacagccccaaccactgcctcctccaagcgggatacacctgagcgcttctcgcaccctggctcccacacttctgtattcttcccctccttcacattcaccgttcgggctctcatcgctgatatag

SEQ ID NO: 5170 - DNA, 453 bp, Artificial Sequence
  Description of Artificial Sequence: Synthetic coding sequence
cctcagacagatcagaaatcccactcccaaagggcccttggaactcaaacacctgccttgcagggacctcagttactgaacaccgatccctcctcagaagagacacatccacatgtgaatcccgatcgcctgtgccacatggagcctgctaatcatttctggcatgccggagatctgcaggcgatgatctctaaggaatttcatctcgccgcaactcaggatgactgtcgaaagggccgaacacaggaggacattcttgtgcctagttctcaccctgagctgttcgcatccgtgctacctatggcacctgaggaggccgcaaggctgcagcagccacaaccactccccccaccatccggcatccacctgtctgcttcccggaccctggctcttaccctgctttactcaagccctcctagccattcaccattcgggctgtctagcctgatttag

SEQ ID NO: 5171 - DNA, 411 bp, Artificial Sequence
  Description of Artificial Sequence: Synthetic coding sequence
atgatactcaattggaaactgttaggtatcctagttttgtgcctccacaccagagggatctccggcagcgaaggtcaccccagccacccacccgcagaagacagagaggaggcaggctcccccacccttcctcaggggccacctgtaccaggggacccttggcccggtgccccacctctgttcgaagacccacctccaacacggcctagtaggccttggcgcgacctgccggagactggtgtatggctccccgagcctcccaggaccgacccgccacagcccccacgtcctgacgacccatggcctgccggacctcagcctcccgaaaacccctggccgccagcacccgaggtggacaatcggccacaagaagagcccgatctggatcccccacgggaagaatacaggtag

SEQ ID NO: 5172 - DNA, 411 bp, Artificial Sequence
  Description of Artificial Sequence: Synthetic coding sequence
atgatactgaattggaaactgctagggatcctggtgttgtgtctgcacactcgtggaatctctggatcagagggccatcccagccaccctccagccgaggaccgggaggaagccggatcacccacccttcctcagggtccccctgtgccaggtgacccctggcctggggctccccctctgtttgaagaccccccaccgaccaggccaagcagaccttggagggacctcccagagactggagtttggccccctgagccccctcgaacggatcctccacagccaccacgacctgatgacccatggcctgccggtcctcagcccccagagaatccctggccaccagcccctgaggtggacaacaggccccaggaggaacccgacttagatccgcctcgggaagagtaccgttag

SEQ ID NO: 5173 - DNA, 411 bp, Artificial Sequence
  Description of Artificial Sequence: Synthetic coding sequence
atgatattgaactggaagctcttgggcatcctggtcctctgtctccatacgaggggaatcagcggcagtgaaggccaccctagtcacccccctgcagaagacagagaagaggctgggtctccgaccctgccacagggacccccagtgccgggagacccctggccaggggctccccctttgtttgaggatccaccccctaccagaccctctcgcccatggagagacctgccggaaactggcgtctggccccctgaacctccaagaactgatccccctcagcctcctcgaccagacgacccctggcctgcaggaccccagccccctgagaatccttggcctcccgctcctgaagtggacaatcggcctcaggaggagcccgacctggacccacccagagaggaataccgctag

SEQ ID NO: 5174 - DNA, 411 bp, Artificial Sequence
  Description of Artificial Sequence: Synthetic coding sequence
atgattcttaattggaagctcttagggattttggtgctgtgcctccacacacgcggtatttccggtagcgagggccacccttcgcacccccctgccgaggaccgcgaggaggctgggtcacccaccttaccccagggcccacctgtacctggagacccctggccaggcgctcccccactcttcgaagatcctccacccacacgccctagcagaccttggcgcgatctcccagagaccggggtttggccaccagagcctccacgaactgatcctcctcagcccccacgcccagatgacccatggccagctggccctcagccacctgagaacccgtggccccctgccccagaggttgacaacaggcctcaggaggaacccgacctggaccctccaagagaggaataccgttag

SEQ ID NO: 5175 - DNA, 411 bp, Artificial Sequence
  Description of Artificial Sequence: Synthetic coding sequence
atgattctcaactggaaactcctggggatcttggttctgtgtctgcacactcggggtatcagtggctcagagggtcatccatcccatccacctgcagaggaccgagaggaagctggctctccgactctgcctcagggccctccagtgccaggcgatccctggcccggagcaccccctctttttgaggaccctcctccaacacgcccttcacggccttggagagatctcccagagacgggagtgtggcctcctgaaccccctcggactgaccctcctcagccaccacgtccagacgatccctggcctgccggtccacaaccacccgaaaatccctggcctccagctccggaggtcgacaatagaccccaggaagagcctgacctggatcctcccagagaagagtacagatag

SEQ ID NO: 5176 - DNA, 411 bp, Artificial Sequence
  Description of Artificial Sequence: Synthetic coding sequence
atgattcttaactggaaattgctgggtattctggtcctgtgtttacatacaagggggatctctggatccgaaggccatccatcacatccacccgcagaggatcgggaggaagcaggctcaccaacactcccccagggccctccagtgccaggcgacccttggcccggagcacctccactcttcgaggatcctcctcctacacgtccatccaggccctggagggacctgcctgaaaccggggtctggcccccagaaccacctcggaccgatcccccacagcctccaaggccagacgatccatggccagccggaccccagcctccggaaaatccgtggccccctgctcccgaagtggataataggccgcaagaagaacccgatctcgatccaccacgggaggaataccgctag

SEQ ID NO: 5177 - DNA, 753 bp, Artificial Sequence
  Description of Artificial Sequence: Synthetic coding sequence
gcattactgcttgctgtgatacaaggcagaccaggcgctcagcatgatgtcgaggcgctcggcggactgtgctgggctctgggtttcgagacaactgttagaaccgatccgacggcccaagctttccaagaggaactggcacagttccgcgagcagttggacacatgccggggtccagttagttgcgctctggtcgcgctgatggcccacgggggacctcgcggtcaactgcttggagctgatgggcaagaggtgcaacccgaggctctgatgcaggagctatctcggtgccaagttttgcagggtagacctaaaatttttcttctccaagcctgtcggggaggaaaccgggacgccggtgtcgggcctaccgccctcccatggtactggtcatggctaagagccccaccatcagtcccttctcacgccgacgtcctgcaaatctacgctgaagcgcagggatcatcctgccggggtactcccccaggctcctcagatcaggccgatattttaactgtctattctgcagctgaggggtatgtggcatacagagacgacaaaggctccgatttcatacagacccttgtcgaggttttgcgagcaaatcctggaagggaccttctggaactgctcactgaggttaacagacgcgtgtgcgaacaggaagtgctcgggccagactgcgacgagctgcggaaggcctgcttggagataagaagcagtttaagacggcgtctttgtctgcaggcttag

SEQ ID NO: 5178 - DNA, 3165 bp, Artificial Sequence
  Description of Artificial Sequence: Synthetic coding sequence
atgacatcctatagggaaagaagcgcagacttggccaggttctataccgtgacagagccacagcgacatcccagaggctatacagtctataaagtaactgcaaggataattgtgtggaagcggtactctgatttcaaaaaactacacaaggaactctggcagatccacaagaatctgttccgccactcagagctctttccacctttcgctaagggtatcgtgtttggcagattcgacgagactgtgatcgaagagcgcaggcagtgcgccgaggacctactgcaattctctgcgaacatccccgctctttataattccaaacagctagaagacttcttcaaaggtggaatcataaacgatagcagcgagctcattggcccagctgaggcccacagtgactccctgatcgacacctttccggagtgttctacagagggcttctctagcgacagcgacctggtttcgctcactgtggatgtggactccctcgcagagttagacgatggcatggcctcaaaccagaacagccctatcagaacgttcggactcaacctgtcatcagactcatccgccttgggggctgtagccagcgactccgaacagtccaaaacggaagaggagagggaatcgaggtccctattcccagggtccctgaaaccaaaactcggaaaaagggactacttggaaaaggcgggagagctcattaagctggccctgaaaaaggaggaggaagacgattatgaagctgcctcagatttttataggaaaggcgttgacttattgctcgagggagtccagggagagtcatctcctacccggagggaagcagtgaaacggaggaccgcagaataccttatgcgggcagagtccatcagcagtttatatgggaagccccagctcgatgatgtgtcccaacccccaggctctctgtcaagtagaccactgtggaatttgcggtcacccgcagaagagctgaaggctttcagagtcctgggcgtcatcgacaaggtgctgcttgttatggacaccaggacggaacaaacatttatcctgaagggtctgcgaaagagctcagagtactctaggaatagaaaaacgatcataccaaggtgcgtgcctaatatggtgtgtctccataaatatataatatccgaagagtctgtgttcctggttttgcagcacgcagagggcggaaaattgtggtcctacatatctaagtttttgaatcggagccctgaggaatccttcgatattaaggaagtcaagaaaccaaccctcgcgaaggtccacctccagcagcccacgagctctccgcaggattcaagttcattcgagtccaggggctcagatggcggtagcatgctgaaagcactgcctctgaaatccagtctcacaccttcctcacaggatgactccaaccaggaggacgatggacaggatagcagtccaaagtggcccgattcaggctccagcagtgaagaggagtgtacgacgtcatacctgaccttgtgcaatgagtatggtcaagagaaaatcgagcctggatccctcaacgaggagcccttcatgaaaaccgaagggaacggtgtagataccaaagcgatcaaatccttcccggctcatcttgccgctgactccgactctcccagcactcagcttcgggcacacgaacttaagtttttccctaatgatgaccctgaggcagtgagcagcccacgaacctcagatagtcttagtcgctccaaaaactcccctatggaatttttcagaattgactctaaggattcagcaagtgaattgctcgggcttgatttcggtgagaagctgtattctcttaagagtgagcctctaaagcctttcttcaccctgccggacggagactcagcctccagaagtttcaatacatccgaaagcaaagtggagttcaaggctcaggacacgatcagtcgcggatcagacgattctgttcctgttatttcattcaaagatgctgcattcgatgatgtgtccggaaccgacgaaggtcgcccagatctcctggtgaacctccctggtgagctcgaatccacacgggaggccgctgctatggggccaaccaaattcacacaaaccaatatcggcatcattgagaacaagttgcttgaggccccagatgtcttgtgccttaggttaagcactgagcagtgccaggcccacgaagagaagggcatagaagagctctccgacccctccggccctaagtcatactcaattacagagaagcactatgcccaggaggacccaaggatgctgttcgtggccgcagttgatcactcatcgtcaggtgacatgagcctgttaccttccagcgatccaaagtttcagggtctgggcgtcgttgaaagcgccgttacggcaaataacacagaggagtcactgtttagaatatgttcccccctgtccggcgctaatgaatacatcgcgagcacagacactctcaaaacggaagaggttctactgttcactgaccagaccgatgacttagccaaagaagagcccacttctttattccagcgcgactcagagaccaagggagagagcggtctggtgttagaaggcgataaagagatccaccagatttttgaggaccttgataagaagctcgctctcgcctctagattttatattcctgagggctgcatccaaagatgggctgcagaaatggtggtcgcacttgacgcactgcaccgcgagggcattgtatgccgagacctgaatccaaataatattcttctgaatgaccgcggtcacattcagctgacgtatttcagtcgatggagcgaggtggaagactcctgcgacagtgacgcaattgaacggatgtattgcgcgccagaggttggggctataacggaggagacggaggcatgtgattggtggagcctcggagcagtactgttcgaactgctgacaggaaagactctggtggagtgccatcccgctggaatcaatactcacactacccttaacatgccagagtgcgtgtccgaggaagcgagaagtttgatccagcagctattacagtttaaccccctcgagagattgggcgcaggggtcgccggtgtggaggacatcaagtcacatcccttcttcaccccagttgactgggccgaactcatgagatag

SEQ ID NO: 5179 - DNA, 3201 bp, Artificial Sequence
  Description of Artificial Sequence: Synthetic coding sequence
atgacatcttaccgcgaaagatccgcagatctcgcccgattctacacagtgacagagcctcagcgccatccaagaggttacactgtatataaggtaacagcaagggtggttagccgtcgcaatccagaagatgtccaggagatcatagtctggaagagatactctgatttcaaaaaactgcacaaggagctgtggcagattcataaaaacctatttagacactctgagctgttcccgcctttcgctaaagggattgtatttggaagatttgacgagaccgtgattgaggaacggaggcagtgcgccgaggacctgctgcagttctctgctaacattccggcactgtacaattccaagcaactcgaggatttcttcaagggcggaattattaatgattctagcgagctgataggacccgctgaagcacactctgacagcctaattgacaccttcccagagtgcagtacagagggcttcagcagtgatagtgatctcgtgtcattgacagtggatgtagatagcttagccgagttagacgacgggatggcgagcaaccagaactcccctattaggacatttggactcaatctgtcgagcgacagctcagctctgggcgcagtggcctctgattctgaacaatcgaaaaccgaggaggaaagggagtcacgatctctgtttcccggatcactgaagccaaaactcggcaagcgagactacctagagaaggccggagaacttatcaagcttgcactcaaaaaagaagaagaggacgactatgaagctgccagtgacttttaccgcaaaggagtggatctcttgctcgagggcgtccaaggtgaaagcagtcccacacggagggaggctgtcaagcgccgaacggccgagtacctgatgagagcggagtctattagttcactctacggtaaaccacaattggatgacgtgagccagccccctggctctctgagcagtagaccactctggaatttgaggtcccccgctgaagaacttaaggctttcagggtgttgggtgtgatcgataaagtgctgttagtgatggataccaggacggagcagactttcattttaaaaggcctacggaagtccagcgagtattcacggaacaggaagacaatcatcccgaggtgcgtccccaacatggtgtgtctccacaagtacatcatctctgaagagagcgtgtttctggtcttgcagcacgccgaaggagggaagttgtggtcatatataagtaagtttttgaaccggagcccagaggaaagcttcgacatcaaggaagtaaagaagcccaccctggctaaagtgcatttgcagcaaccaactagttctccccaagactcgtcaagcttcgagtcccggggttcggatgggggtagcatgttgaaagccctccccctgaagagcagcctgacccctagtagccaggatgattctaatcaggaggacgacggacaggattctagtcctaagtggcccgattccggatccagttccgaagaggagtgcacaacctcctacctcacactatgtaatgaatatggacaggagaagatcgaacccggaagcctgaacgaggaaccttttatgaaaaccgagggaaacggcgtagacaccaaggccatcaagagtttccctgcccatctggccgcagattctgacagtccctctactcagttgcgcgcacacgaactgaagttcttccctaacgacgatccagaagcggtgagttctcctaggacctcggactcactctcccggagtaaaaatagccctatggagtttttcaggattgattctaaagatagtgcttccgagctgcttggactggacttcggcgaaaaactgtattcattaaagagtgagcccttaaaaccttttttcacattacccgatggcgacagcgcatcaaggagctttaacacatccgaaagtaaggtggagttcaaagcccaagacaccatctctcgagggtcggatgatagcgtgcccgtcatatcttttaaggacgcagcattcgatgacgtcagcggtaccgacgagggcagaccagatctgctggtaaacttacctggtgagctggaaagtacacgcgaggcagctgctatgggacctaccaagttcacccagacgaatataggaattatagagaataaactgctcgaggcccctgatgtcctatgccttcgtttgtccacagagcagtgtcaagctcacgaagagaaaggcatagaggaactgtctgacccaagtggacccaaatcttattccatcaccgaaaaacactatgcccaggaggatcccaggatgctgttcgtcgctgcagtggaccactctagctccggcgatatgagtctgttgccgagctcagatcccaaattccagggattgggcgtggtagaatccgctgttacagcgaacaacacggaagaaagtttgttccgaatctgctcccccctttctggagccaacgagtatatcgcctccactgataccctgaaaacagaggaggtgctcctctttaccgaccagacagatgacctggcgaaggaagaacccacatctctgttccagcgcgactcagaaactaaaggagaatctggtcttgtgcttgagggggacaaggagattcaccagatatttgaagaccttgataagaaacttgccctggcttccagattttatatccctgaagggtgtatccagagatgggctgccgagatggttgttgcactcgatgcactgcacagggaagggatcgtgtgccgagacctgaacccaaacaacattcttctcaatgatcggggtcatattcagctaacatactttagcagatggagcgaggttgaggattcctgtgatagcgatgccatagaacggatgtattgcgcaccggaggtgggtgctattacagaggagacagaagcctgcgactggtggagcctcggcgcagtgctcttcgaactgctcacaggtaaaaccctggtcgagtgtcatcccgctggcatcaatactcataccacactgaacatgccagagtgtgtatccgaggaggccaggtcactcatacagcagctgctgcagttcaaccccctggagaggctgggcgcaggtgtggccggagtggaagatataaagagtcacccattttttactccagtggactgggctgaactaatgaggtag

SEQ ID NO: 5180 - DNA, 1983 bp, Artificial Sequence
  Description of Artificial Sequence: Synthetic coding sequence
atgcgagccgagtctatctcctcgctgtatggcaagccacagctggacgatgtgtctcaaccgcctggctcactttcttcccgacccctttggaatttgcgcagtccagcagaagagctcaaagcctttcgcgtgctgggggtgatagataaggtcctgctggttatggacacacggactgagcagacatttatcttaaaagggctgcgcaagagcagcgaatactccagaaaccggaaaactatcattcccagatgcgttcccaacatggtgtgtctgcacaagtatataattagcgaagagagcgtgttcctggtgttgcaacatgcagaagggggaaagctgtggtcctatattagcaaatttctgaatagaagtcctgaagaaagcttcgatattaaagaggtgaagaaacccaccctggctaaggtgcatctgcagcagcctacttcatccccacaggattcatcgtctttcgaatcccgcggatcagatgggggtagcatgctgaaggcgttgcctctcaaaagtagccttacacccagctcacaggatgactcaaatcaggaggatgacgggcaagatagctctccaaagtggccggattcgggcagttcaagtgaagaggagtgcactacgtcatacctcacgctatgcaacgagtacggtcaagagaagatagagcctggctcattaaacgaagagccgtttatgaagaccgaaggtaacggcgtcgacacaaaggccatcaagtcatttcccgcacacctcgcggcagacagcgactccccctcaacccagctgcgcgctcacgagctgaaatttttcccaaatgacgatccggaggcagtctcaagtccccgaacttctgactcactctctagatccaagaacagcccaatggaattcttccgaatcgactccaaagactccgccagtgaactgctgggactggactttggggaaaaattgtattctctgaaatcggaaccgctcaagccattctttacattgcctgatggagattcagcctctcgcagttttaacactagcgagagtaaagtcgaatttaaggcccaggatacaattagtcggggatctgacgattcagtccccgtcatatcctttaaagacgccgcatttgatgatgtgtcggggacagacgaaggaaggcccgacctgctggtcaatctgccaggtgagctcgagagcactcgcgaggcggctgccatggggcctactaagttcacccaaactaacatcggcatcatcgaaaacaagctgctagaagcccctgatgtcctatgccttaggctttccaccgagcagtgccaggctcacgaagagaaaggaatcgaagagctcagcgatcctagtggaccgaaatcttactctatcactgaaaaacattatgcccaggaggatcctagaatgttatttgtggcagcagtcgatcacagttcctcaggtgacatgtctttactgccaagctcagatcctaagttccagggtctgggcgtcgtggaatctgcagtaactgccaacaataccgaggagtccctgttccgcatctgttcacctctctcaggggcaaacgaatacattgcctcaaccgatactcttaagacagaggaggtgttgctgttcactgatcagactgatgacctggctaaagaagagcccaccagcctgtttcagcgggattccgagacaaagggagaaagcggtctggtcctagagggcgataaggaaatccatcagatatttgaggatctggataagaaactggccctggcttctcgcttttacattcctgagggctgcattcagagatgggcagcagaaatggttgttgcactagacgccctccatcgggaaggcattgtttgccgcgatctaaatcccaacaatattctactgaatgatagggggcaggaacttctgcagatgcacttcttccttttcgccgtggcctcaaattag

SEQ ID NO: 5181 - DNA, 2565 bp, Artificial Sequence
  Description of Artificial Sequence: Synthetic coding sequence
atggctagcaatcagaactcccccataaggacctttggcctcaatttatcaagtgactcaagtgccttgggagccgtggcttcagactctgaacagtcgaagacggaagaggaacgcgaatctcgaagtctgtttcctgggtctctgaagccgaaactgggaaagagagattaccttgagaaagcaggggaactgatcaagttggccttgaaaaaggaagaggaggatgattatgaagccgcaagcgatttctacagaaaaggcgtagaccttctgctggagggggtacaaggggaaagctcgccgacaagacgagaagcagtaaagcgccgaacggcagagtatctgatgcgcgctgagtctatctcctccctctacggtaagccacagctagacgacgtctcccaggttttgttagtgatggataccagaaccgagcaaacctttattctcaagggccttcggaaaagctccgaatatagcaggaatcgcaagacaatcataccgcgatgcgtcccaaatatggtgtgtctgcacaagtacataatatcagaggagtccgtctttctggtcctccagcatgccgagggaggcaagttatggtcctacatctcaaagttcctgaacagatcccctgaagaatccttcgacatcaaggaagtgaaaaagcccaccctggctaaggtgcacctgcagcagccaacatcaagcccacaggactcatcatcttttgaatcgcgcggaagcgacgggggtagcatgttgaaagcgctccccctgaagtcttctcttacgccctcttctcaagacgactctaatcaggaagacgacgggcaagactcttcccccaaatggcccgattcgggcagctcgtccgaagaagaatgcactacctcttacttgacactatgcaacgaatatggccaggagaaaatcgagcccggatccctgaacgaagaaccgttcatgaaaaccgaggggaacggagtggacaccaaagcgattaaaagcttccctgcacacctggcggctgatagcgactcccccagtacacagctgcgagcccatgagttgaagtttttccctaacgatgaccccgaagccgtcagtagccccagaacctccgactcactatcaaggtctaagaattcccctatggagttcttcaggattgatagcaaagatagcgctagtgagctgctgggactcgacttcggagaaaagctgtattccctgaagtcggaaccactgaagcctttcttcacattaccagatggggattcagctagtagatcctttaacacaagcgaatcaaaagtagaattcaaggcccaggataccatttctcgaggctccgatgactctgtgcctgtgattagctttaaggacgctgccttcgacgatgtttccggtactgatgaaggcagacctgatctccttgtgaatcttcctggcgagcttgaatccacacgcgaggctgccgctatgggtcctaccaagtttacacagacaaatatcggtattatagagaataaattgctggaggccccagatgtcctttgccttcggctcagcaccgagcagtgccaggcccatgaggagaagggcatcgaggaactctcagacccttccggcccaaaatcttacagtatcaccgaaaaacactacgcccaagaggacccacgcatgctttttgtggctgccgtcgaccattcttcatcgggcgatatgagtctcttaccaagctccgatcccaagttccaaggcctgggagtggtcgagtcggccgtcacagccaataatactgaagagagcctatttcggatctgctcacctctgtcgggagccaacgagtatatagcatccaccgatacgcttaaaaccgaggaagttctgctgttcactgaccagactgacgatctggctaaagaggaacctacctcgctttttcagcgggacagtgagaccaagggggaatctgggctagtcctcgaaggagacaaagagatccatcagatttttgaggatctggacaagaaactggccctggcgtctcgcttttacatccccgagggatgcatccagcgatgggccgcagaaatggtcgttgcactcgacgcgctccaccgcgaaggaatagtgtgccgcgatctcaatcccaacaatattctgttgaacgaccggggacatatccagttgacctactttagccgttggtcagaagtcgaagactcttgtgactccgatgcaattgagcggatgtactgcgctcctgaagtcggggctattactgaggaaacggaggcatgcgactggtggtcacttggggctgttttgtttgaattactgaccggaaaaacactggtcgaatgtcatccagcagggattaacacccatacaacacttaatatgcctgaatgtgtctccgaggaggcccgaagcctgattcaacaactgctgcagttcaatcctctggagagactgggggctggagtggcaggggtggaagatattaaatctcacccctttttcacaccagtcgattgggctgaactcatgagatag

SEQ ID NO: 5182 - DNA, 1449 bp, Artificial Sequence
  Description of Artificial Sequence: Synthetic coding sequence
atggctgctgtattcgatcttgacttggagaccgaggagggtagcgagggtgaaggcgagccagaattgtctccagcagatgcatgcccacttgccgaactcagggccgcaggattggagccagtgggtcactacgaggaggtggaactcacagaaacgagtgtgaacgttggccctgagcgcattgggccacactgcttcgagctcctacgggtactcggcaagggcggatacggcaaggtgtttcaagtacggaaagtgcaaggcacgaatctgggcaagatctacgcgatgaaggttttgaggaaagccaaaatcgtgagaaatgccaaggacactgcccacacgcgcgcagagcgtaacattctggagtcagtaaaacatcccttcattgtggagctggcatacgcgttccaaactggtggaaaactgtacctgatcctcgagtgcctaagtggcggtgaactctttacacacctcgagagagaggggatctttttagaggacaccgcctgtttctacctagcggagattaccctagcactcgggcatctgcactcacagggaatcatataccgcgacctcaaacctgagaacataatgctgtcaagccaaggtcacatcaagctgaccgatttcggcctttgcaaggagagcattcacgaaggcgctgtgacccataccttctgcggtactattgaatacatggctccagagatactcgtgaggtctggccacaatcgcgctgtagactggtggagcctgggtgccctcatgtacgacatgttgactggctctccgccattcaccgctgaaaatcggaaaaaaacaatggacaagattataagaggaaaactggccctcccaccttacttgacccctgacgccagagatctggttaagaagtttctgaagaggaatccttcacaaaggatcggcggtggtccaggagatgccgctgacgtgcaaagacaccccttcttcagacacatgaattgggacgacctcctggcctggagggtagaccctcccttccgcccatgtctgcagtctgaagaagacgtctcccagttcgacacccgctttacacggcagaccccagtggactcccccgatgacacagcactgagcgagagcgccaatcaggccttccttggcttcacatacgtggcaccttctgtacttgattcgattaaggagggcttcagctttcagcctaagctgcggagcccacgacgcctcaactcctccccccgtgcacctgtaagtcccctcaagttctctccttttgaaggctttaggccttcgcctagcctgccagaacccacagaattacctttgcctcccctactccctcctcccccaccttctacaactgcacccctccccatcaggccaccctctggcaccaagaaatcaaagagaggacggggtagaccaggcaggtag

SEQ ID NO: 5183 - DNA, 465 bp, Artificial Sequence
  Description of Artificial Sequence: Synthetic coding sequence
atggccgcagtatttgatttggatctggaaacagaagaaggctccgagggagagggagaacctgaacttagccccgcagacgcctgccccctcgcagagctcagagccgcagggctcgagcctgttggtcattacgaggaagttgagctgacagaaacctctgtcaatgtcgggccagagcgtattgggccacactgtttcgagctactgcgtgttttagggaagggtggatatgggaaggtatttcaggtccggaaggtgcaaggcacaaacttaggaaagatttatgcaatgaaagtgctgcgcaaagccaaaatcgtaagaaacgccaaggacacagctcatacacgagctgagcggaatatcctggagagtgtgaagcacccctttatcgtggaactggcctatgccttccagaccggcggtaaactgtatctgatcttagaatgtctgagtgtcgactag

SEQ ID NO: 5184 - DNA, 465 bp, Artificial Sequence
  Description of Artificial Sequence: Synthetic coding sequence
atggcagcggtgtttgacctcgacctggaaacagaggagggatctgagggggaaggtgagcccgagctctcacccgcagacgcctgcccacttgccgagctcagagctgcgggacttgagccagtcggtcattacgaagaggtggaactcactgagacatctgtcaacgtgggccctgaaaggatcgggccacactgtttcgagctgttacgcgtgctcggcaaaggcggttatggaaaggtcttccaagtgcgcaaggtgcagggcacaaacctgggcaaaatttacgctatgaaagttctaagaaaggccaagatcgtccgtaatgcaaaagacaccgctcacactcgggctgaacgcaacattctggagagcgtgaagcatcctttcatcgtcgagttggcttacgccttccagacaggcggaaaactctatctgatcctcgaatgtctgtcggtggactag

SEQ ID NO: 5185 - DNA, 2133 bp, Artificial Sequence
  Description of Artificial Sequence: Synthetic coding sequence
atgtttaagtttctgagttttcgtgtgagatctatacaagaggaagtgtccattaaagagatcgccatcacccatcacgtgaaggagggacacgaaaaagccgatccttcacagttcgagctgcttaaagttctggggcagggttcgtttggcaaagtttttcttgtcaagaagatctcaggatcagatgccagacagctctacgctatgaaagtgcttaaaaaggccacccttaaagttcgcgatcgggtgagaacgaagatggagagggacattttagtggaagtaaaccacccgtttatagtgaaattgcattatgcgtttcagaccgagggtaagctgtacttgatcctagactttctacgcggaggcgacctttttacacgactttctaaggaagtgatgttcacggaggaggacgtgaaattctatctggctgagctggccctggcactggaccacctacatagcctgggcataatctatagggatcttaaacccgagaacatccttttggacgaggaaggccacatcaaactgacagattttggtctatccaaggaaagtattgaccacgagaaaaaggcctattccttttgtggcaccgtagagtatatggcacccgaggtggtgaatagacggggacacacacagagtgcggattggtggtcttttggggtgttgatgtttgaaatgcttaccggtacgcttcccttccagggaaaagacaggaaagagacgatgacaatgatcctgaaagcaaagctggggatgcctcaattcctctcccctgaggcacagtccttgctgcgaatgttatttaaaaggaatcccgctaatagactgggcgcaggtcctgacggagtggaagagattaaacgtcactcttttttctctactattgattggaacaaactgtaccggagagaaattcatccacctttcaaacctgctaccggcagacctgaggacaccttttacttcgacccagaattcaccgcaaagacccccaaggactcaccgggtattccaccctcagcaaacgcccaccaactgtttagaggtttctcctttgtagccatcacttcagacgacgagagtcaggctatgcaaacagtgggggtgcactccatcgtgcagcttcaccggaattctattcaattcacagatggctacgaggttaaagaggatatcggagtgggttcctatagcgtgtgcaagcgatgcatccataaagcaacgaacatggaattcgcggtcaaaatcatcgataagagcaagagggaccctaccgaggagatcgaaatcctgctgcgatacggtcagcacccaaatattatcaccctcaaggacgtttacgatgacgggaagtatgtgtatgtggtgactgaactgatgaaagggggagagttgctggataagatcctgcgtcagaagttcttttctgagcgcgaggcctcagccgtgctgttcacaataaccaagactgtggaatacttgcacgctcaaggcgttgtccacagggacctgaagccttctaacatcctttacgtggatgaatcaggcaatcccgaaagcatccgcatctgcgatttcggatttgccaagcaactgcgggcagaaaacggcctgctgatgaccccctgttacactgctaatttcgtggcacctgaagtgctcaagcgccaaggttacgatgccgcttgtgacatctggtcactgggcgttctgctttatactatgctgactggctataccccctttgccaatggcccagacgacacaccggaggaaatccttgctaggatcggatctggcaaattctcgctgagcggcggatattggaatagcgtcagtgatacggcaaaagacctggtgtccaaaatgctgcacgtcgatcctcaccaacgcctcacagcggcactggtcctccgacacccctggatcgtgcactgggaccaactgccgcagtatcagcttaacagacaggatgctccccacctggtgaaaggggcaatggcagcgacgtactccgctctcaatagaaatcagagccccgtgctagaaccagtaggcaggtcaacactggcgcaacgtaggggcattaaaaagatcacgagcaccgctctctag

SEQ ID NO: 5186 - DNA, 2223 bp, Artificial Sequence
  Description of Artificial Sequence: Synthetic coding sequence
atgcctttagctcagttggcagatccgtggcagaaaatggccgtcgaaagcccttctgacagtgccgagaatgggcagcaaatcatggatgagcccatgggtgaggaggagataaaccctcaaacagaagaagtttcgattaaggaaattgcaattacacaccacgtgaaagaagggcatgaaaaggcggatccttcacagtttgaactcctaaaggttctcgggcagggcagcttcggcaaggtattcctggtcaaaaagatttcaggaagtgatgcaaggcagctgtacgcaatgaaggtgttgaagaaggctactctgaaggtcagagatagagtgcgtaccaagatggagagagacattttggtggaagtcaaccacccttttatcgtgaagctccactacgcattccaaaccgagggcaaactctacctgatcctagacttcctgaggggtggcgacctgttcacccgattatctaaggaagtaatgtttactgaggaggacgtcaaattctacctggccgagttagctctggcactggatcacttgcactctcttgggattatctatcgagacttaaagccggagaatatcctcctcgatgaagaaggtcacatcaagcttacggacttcgggttatcgaaagagagcattgatcatgagaaaaaggcttattcgttttgcgggactgttgagtacatggcgccagaagtggtcaatcggaggggacatactcagagcgccgactggtggagctttggagtcctgatgtttgagatgcttacggggaccctgccatttcagggcaaggacaggaaggaaacaatgacgatgattcttaaagccaaactggggatgccccagtttttgagccctgaggcccagagccttctcaggatgcttttcaaaaggaaccccgcaaatcgactcggggctgggcctgacggggtggaggagattaagagacacagctttttctccacgattgattggaacaaactataccgacgggagatccaccccccattcaagcccgctactggccgtcccgaagatacattttactttgaccctgaatttactgctaagacgcctaaggattctcccggtattcccccatcggccaatgcccaccagcttttccgcggattctccttcgtggccatcaccagtgacgatgaatctcaagccatgcagaccgtcggcgttcactcaatcgttcagcagttgcatcggaacagcattcaattcaccgatggatatgaggtcaaggaggacataggagtgggcagttatagcgtatgtaaaagatgcatccataaagccacaaatatggagttcgccgtcaaaattatcgacaaatcaaaacgagacccaacagaagaaattgagatattactccgctacgggcagcatccaaacataattactctcaaagacgtgtatgacgacggaaaatacgtttacgtcgtgacagagctcatgaaggggggagagctcctggataagattctaagacagaagtttttttctgagagagaggccagtgccgtcttgtttactattacaaaaactgtggagtacctgcacgcccaaggcgtagtacatcgggacctcaagcctagtaacatcctctatgtggacgagtcaggcaatccagagtctatccgcatttgtgactttggctttgctaagcagctgcgcgctgaaaacggactgctcatgacaccgtgctatacagccaatttcgtggctccagaggtgctcaagcggcaagggtacgacgccgcttgcgatatctggtcgctaggggtgctgctttataccatgctaaccggatatacaccctttgcgaatggcccagacgatactccagaagaaattctggccagaatcggttcaggtaagttttctctaagcggcggttattggaattctgtgagcgacaccgccaaggacctagtatctaaaatgctacacgtggatccacatcagaggctgacggccgcactggtgttaaggcatccctggattgtgcattgggaccagcttccacaatatcagttaaacaggcaagatgctcctcacctggtgaaaggggctatggcggctacctattcggcgctaaacagaaatcagtcgccagtgcttgaacctgtgggccgtagcacattagctcagcgcagaggaattaaaaagatcaccagcaccgcactttag

SEQ ID NO: 5187 - DNA, 402 bp, Artificial Sequence
  Description of Artificial Sequence: Synthetic coding sequence
atggatgaaccaatgggggaggaggagataaatccccaaacagaggaagtatcgatcaaggaaattgctattacacatcatgtgaaggagggccacgagaaggccgatccctcccagtttgaactgctcaaagtgcttggacagggaagctttggaaaagtcttcctcgtgaagaagatctccggctccgatgcccgacagttgtacgctatgaaagtgctgaagaaggccaccctgaaagtccgcgaccgcgtgaggaccaagatggaaagagacattcttgttgaggttaaccaccctttcatagtgaaacttcactacgccttccagacggagggtaagctctacctgatcctggatttcctgcgtggtggcgatctttttaccaggttatccaagtag

SEQ ID NO: 5188 - DNA, 684 bp, Artificial Sequence
  Description of Artificial Sequence: Synthetic coding sequence
atgttcaagtttctgagcttccgggttagaagcattcaggaagaagtgtcaatcaaagaaatagctattacacaccacgtcaaggagggccacgagaaggccgatccctcacaattcgagctcctgaaagtgctgggtcaaggctcattcggcaaagtctttctcgttaagaagattagcggtagcgatgcacgtcagctgtacgccatgaaggtccttaaaaaagccacgctgaaggtgcgtgaccgcgtcaggaccaagatggaacgggatatacttgtggaagtgaatcacccgttcatagtgaaattacactacgctttccaaaccgagggaaagctatatctaattctggacttcctgcgaggcggtgatttgtttacacgcctgtccaaggaagtgatgttcactgaggaggatgtaaaattctatctggccgagctcgccttggctctcgatcacctgcactcccttggcataatttaccgagacctgaagccggagaacatcctactggacgaggagggccacattaagctcaccgatttcggcttgtcaaaggagtcgatcgaccatgaaaagaaggcctactccttctgcgggaccgttgaatacatggctcctgaagtggtgaacagaagaggtcatacgcagtctgccgactggtggagtttcggcgtgtag

SEQ ID NO: 5189 - DNA, 2136 bp, Artificial Sequence
  Description of Artificial Sequence: Synthetic coding sequence
atggacgaacccatgggcgaagaggagattaacccacaaaccgaggaggtgagcatcaaggaaatcgctatcacccaccacgtcaaggagggccacgaaaaggccgatcctagtcagtttgaactgctgaaggtgcttggccagggatcgttcggaaaagtgttcctggtcaagaaaatcagtgggagtgatgcaaggcaactctatgcaatgaaggtgctgaagaaggcaacgctgaaagtgagggaccgggtcaggacgaagatggagcgggatatccttgtggaggtcaaccacccttttatcgtgaagctgcactatgctttccagactgaaggcaaactctacctcatccttgatttcttacgcggaggagatctcttcacccgcctcagtaaagaagttatgttcacggaggaagatgtgaaattctacctagctgaacttgctcttgccctggatcacctccactcactgggcatcatctacagggatctaaaacccgaaaatatccttctggatgaggagggccacatcaaactaacggatttcggcttatcaaaagagtccatcgaccatgaaaagaaggcatacagtttttgcggcacagtggaatatatggccccagaggtcgtcaatcgcagagggcacacccagagtgctgattggtggtccttcggggttttgatgttcgaaatgctgacagggactttgccgttccagggaaaggataggaaggaaactatgacgatgattctgaaagccaaactgggcatgccccagtttctgagccccgaggcccaatcccttcttcgaatgctttttaaacgaaatcctgccaaccggctaggagccggtcccgatggagtcgaagaaatcaaacgccactcttttttttcgaccattgattggaacaagctataccggagggaaatccaccccccttttaaacctgccacagggaggcctgaggatacattttatttcgatcctgagttcaccgcaaagaccccaaaagattcccccggaattcctccctcggcgaatgcacaccagctgttcagaggattctcctttgtggccatcacttctgacgacgaaagccaagctatgcagacagtcggcgttcactccatcgtccagctgcacagaaattcaattcagtttactgatgggtacgaggtgaaggaggacatcggcgtcggatcttatagcgtctgcaaacggtgcattcacaaagccaccaatatggaatttgccgtgaagataattgacaagtcaaagcgagatcccacggaggaaatagagatcctcctccgctacggacagcatcccaacatcattacccttaaggacgtctatgatgacggcaagtatgtttatgtggtaacagagctgatgaaaggcggagagctgctcgataaaatacttagacagaagttcttctctgaacgtgaggcatccgctgtgcttttcacgattacaaagaccgtcgagtatctacatgctcagggcgtagtgcacagagatcttaaacctagtaatatcctgtacgttgatgagagcggcaaccccgagtccatccgcatctgcgacttcgggttcgccaagcagttaagagctgaaaacggcttgctcatgacgccctgttacacagctaattttgtggcacctgaagtcctgaaacgacaggggtatgatgccgcttgcgatatatggagcctgggggtcctcctgtacactatgctgacaggctatacaccgtttgccaatggcccagacgacactcccgaggaaatcctggccagaatcggaagcggcaaatttagcctcagcgggggatactggaactccgtaagcgacacagctaaggacctggtctctaaaatgctgcacgtggaccctcaccaacgactcactgctgcattagttctgagacatccatggatcgttcactgggaccagttaccccagtaccaactgaatcggcaagacgctcctcacctcgtgaagggcgcaatggccgctacctattctgcactgaatcgtaaccagtctcctgtgttagaaccagtcggacgctcaacactggcgcagcgcagaggcattaagaaaataacctcaacagccctctag

SEQ ID NO: 5190 - DNA, 2139 bp, Artificial Sequence
  Description of Artificial Sequence: Synthetic coding sequence
atggatgagcccatgggcgaggaggagattaatccccagacagaagaggtgtcaattaaggagatcgcaattacccaccacgtcaaagaggggcatgagaaggcagacccaagccagtttgaactgcttaaggtgctaggccagggaagttttgggaaggtgttcctggtaaaaaagatttccggatcagatgcaaggcagctctacgctatgaaagtcctgaagaaggccaccctcaaggtacgtgatagagtgcggaccaagatggagagggacatccttgtggaagtgaaccacccattcattgttaagctgcattacgctttccagactgaaggcaagctctacctgattttggatttcctaaggggtggagatttattcactcgcctgtcgaaggaagtgatgtttacagaggaagatgttaagttctatttggccgagttggcattggcattggatcatctacactcattaggcattatatatagagaccttaagccggagaacatcctcctggatgaagaagggcacattaaactgaccgatttcggattgtctaaggagagcatcgatcatgagaagaaagcctactcattctgcggcaccgtggagtacatggccccagaagtagttaacagaaggggtcacacgcagtcggccgattggtggtcttttggggtgctgatgttcgaaatgctcaccggcacattaccatttcagggaaaggaccggaaagaaaccatgactatgatcttaaaggccaagctcggaatgccgcaattcctgtccccagaggcccagtccctcctgcgcatgttgtttaagaggaaccctgccaatcgtctgggtgccggaccagacggagtcgaggagatcaagcgtcacagcttcttctcgacaattgattggaataaactatacagaagggagatccatcccccattcaagcctgccaccggaagaccagaggatacattttacttcgacccagagtttacagccaagacacccaaggatagtccgggaattcccccatcagccaacgctcatcagctgtttaggggcttctctttcgtggccatcacctccgacgacgagagccaggccatgcagaccgtgggggtgcattcaattgtgcagcaactgcatcggaacagtatacaattcacggatggttacgaagtgaaggaggatataggtgtagggtcctatagtgtgtgtaagagatgcatccacaaggctactaatatggagttcgccgttaaaattattgataagagtaaacgcgatcctacggaggagatcgaaatacttctgagatatggtcagcatcccaacataatcactttaaaggatgtttacgacgacggaaaatacgtgtatgtcgtcaccgaactgatgaagggcggtgaattacttgataaaattttgcgtcagaagttcttctccgaacgagaagcatcggcagtgctgtttacgattaccaagaccgtggaatatctgcacgcccagggcgttgttcatcgcgacctgaaaccaagcaacattttatatgtggacgaatctggaaatcccgaatcgattcgtatctgcgattttggctttgcgaagcagcttcgggctgaaaacggcctgttgatgacaccttgctacacggctaacttcgtggccccagaggtgctgaaacggcaggggtatgatgcagcttgtgatatatggagtctgggcgtactgctgtacaccatgctcactggctataccccgtttgcaaacggcccagatgataccccagaagagatactcgccagaatcggcagcgggaagttcagcctcagcggaggatactggaactcagttagcgacaccgcgaaagatcttgtttccaaaatgcttcacgtggatccccaccagcgactgacggctgcattggttttacgtcacccgtggattgtccactgggatcagcttccccagtaccaactgaatcgacaggacgctcctcatctggtcaaaggggcaatggcagccacgtacagtgctctcaaccgcaatcaatcccccgtgctggagccagtgggaagaagcaccctggctcaaagacggggtataaagaagattaccagcacagccctgtag

SEQ ID NO: 5191 - DNA, 1575 bp, Artificial Sequence
  Description of Artificial Sequence: Synthetic coding sequence
atgggggacgaagatgatgatgaaagctgcgcagttgagctccggattacggaagccaatcttaccgggcacgaagagaaggtcagcgtggagaattttgaactgctcaaggtgctcggcactggggcttacggaaaagtgtttctggtgaggaaggctggcggtcacgacgcagggaagttgtatgccatgaaggtgctcagaaaggccgctctggtgcaaagagcaaagacgcaggaacacaccaggaccgagcggagtgttctggagctggttagacaggcaccttttctcgttactcttcactatgctttccagactgatgcgaagctgcatttgatactggattacgtcagcgggggtgagatgtttacccatctgtaccaacgtcagtatttcaaagaagcagaggtacgcgtgtatggcggagagattgtcctggcgttggagcaccttcacaaactagggattatatacagagatctcaagcttgaaaacgttctgctcgactctgaaggccacattgtgctgacggacttcggcttatccaaggaatttttgactgaggaaaaggagagaacgttttccttctgcggcacgatcgaatacatggcgcctgagatcatcaggagtaaaacggggcacggcaaagcagtcgactggtggagtcttgggatcctgctgtttgagctcctaaccggggcaagtccattcaccctggaaggcgagaggaacacccaagcagaggtctctcggcgaattctgaaatgcagcccacctttccccccaagaatcgggccagtcgcccaggatttgctgcaaagactgctctgtaaggatcccaagaagaggcttggagccggtcctcaaggtgcccaagaggtgagaaatcaccccttcttccaaggattggattgggtagccctggctgccaggaaaatcccagcgccattcaggccacaaatcagaagcgagctggacgtgggaaacttcgctgaagaatttactagactggagcctgtatattctccccctggatcacctcctccaggtgacccacgtatcttccaaggttactcatttgtggcgccatcaattcttttcgatcataacaatgccgcagagatcatgtgtaagatcagggaaggacgcttttctctggacggagaagcttggcagggagttagtgaagaggccaaggagctagtccggggactgctgaccgtcgaccccgcaaagcgactgaagctagagggcttgcggggtagcagttggctccaagacggatctgcccgatcatccccccctttgaggacgcccgacgtgttagaatccagcgggcctgctgtgagaagcgggctcaacgctacgtttatggcgttcaaccgcggtaagagggaaggcttctttcttaagtccgtcgaaaatgccccactggccaagcggcgtaagcagaagttgaggagcgcgacagcgagcaggaggggatcccccgcacctgccaatcctggcagagcacccgtcgccagcaagggcgcaccgaggcgagcaaatggaccactgcctccaagctag

SEQ ID NO: 5192 - DNA, 2319 bp, Artificial Sequence
  Description of Artificial Sequence: Synthetic coding sequence
atgggagacgaagatgatgatgaatcatgcgcagttgagctcagaatcacagaggcaaacctgaccgggcatgaagaaaaagtgtctgtcgagaacttcgaactgctcaaggtcctgggaacaggcgcttatggaaaggtgtttctagttcgaaaagccggaggacacgatgccggaaagttgtatgccatgaaggtgctcaggaaggccgctcttgtgcagcgagcgaagactcaggagcacactcgcacagaaagaagcgtgctagagttggttagacaagctccctttttggtgacactccactacgcattccagacagatgctaaactgcatctcattctggattacgtcagcggcggagaaatgtttactcatctgtatcagagacagtacttcaaggaggccgaagtgcgtgtgtatggaggagagatagtactcgcacttgagcaccttcacaaactcgggattatttatcgggacttaaaactcgagaacgtcttactcgactctgaaggccatatagtgctcacagactttggcctctcaaaagagttcctcaccgaagagaaagagaggacattctctttctgcggtactattgaatatatggcgccagagataatcagatccaagactggacacggaaaagccgtggattggtggagtcttggtatcttactgttcgaactgctgacaggtgctagcccctttaccttggagggagaacgcaatacccaggccgaagtgtcaagacgcattctcaagtgtagcccacccttccctccgagaatcggcccagtcgcacaggatcttttgcaacggctgctctgcaaggacccaaagaaacgcttaggggctgggccacaaggtgcacaggaggtcagaaaccatcctttctttcagggcctggattgggtggccttggccgctaggaaaattccagcacccttccgtccccaaatcaggtccgaactcgacgtgggcaattttgctgaggagttcacgcgactggaacctgtgtactcacctcccggaagcccccctcccggtgatccaagaatctttcagggctactctttcgtggccccttcgattctcttcgaccataataacgccgtgatgacagacggcctcgaagccccaggggctggcgatagaccaggtagggcagcagtggcaaggtccgccatgatgcaggacagcccattttttcagcagtacgagctggacctgcgtgaacctgctttgggtcagggttccttctctgtctgcagaagatgccggcagcgacagtctggtcaggagttcgccgtcaaaatcctcagcagacgcctcgaggcaaacacacagcgagaagtcgcggctctccggctgtgtcaatctcacccaaacgtggtgaacctccatgaggtacaccatgatcagctacacacctatctcgtgctggagctcctccgtgggggagagctgttggagcacattcgcaaaaaacgccacttcagcgaatcagaggcctctcagattttgagatccctggtgagcgctgtgagcttcatgcatgaagaggcaggtgtcgtgcaccgcgatttgaagcctgaaaacattctgtatgccgacgacactccaggcgcaccggttaaaatcatcgatttcggcttcgcgcgtctgaggcctcaaagtcctggggtacctatgcagacaccgtgcttcacactgcagtatgctgctccagaactgctggcccagcagggctacgatgaatcatgcgacctttggtctctaggcgtcattctttacatgatgctgtccgggcaggtgccatttcagggcgctagtggccagggagggcagtcccaagccgcagagatcatgtgcaaaatcagagaggggcgttttagcctagatggcgaggcatggcagggtgtgtcagaagaggcaaaggaacttgtccgaggccttctgactgttgatccagcaaagcgcctaaaactagagggcctccgcggtagcagttggctccaggacggtagtgcaagatcttctcccccactaaggaccccggacgtgctggagagttcaggcccagctgtgcgatctggactgaatgcaaccttcatggctttcaacagaggcaagcgtgagggcttcttcctgaagtccgtggagaatgccccactcgccaagagaagaaaacagaagctcaggtctgccactgcatctcggcgaggcagtcccgctcccgctaatccgggaagagctcctgtcgcaagtaaaggggctccacgcagggcaaacggcccactgccaccatcctag

SEQ ID NO: 5193 - DNA, 2298 bp, Artificial Sequence
  Description of Artificial Sequence: Synthetic coding sequence
atgggagatgaagatgatgacgaaagctgcgccgtagagctgcggatcaccgaagctaatttgacaggccatgaggagaaggtctcagtagagaactttgaactcctaaaagtgctcggaactggagcttatggtaaagtgttcttagtgcgaaaggcaggtggccacgacgctggaaaactgtacgccatgaaggtgctcagaaaagcggctctggtgcagagagcgaagacacaggagcacacaaggacagaaagaagcgtgctggagcttgtgcgccaagctccttttctggtgaccctgcactatgcttttcagaccgacgccaagttgcacttaatactagactatgtgagcggaggtgagatgtttactcatctctatcagcggcagtactttaaggaggctgaggttcgcgtgtatggaggtgaaattgtgctggcgctggaacacctacacaagcttggaattatctaccgcgacctcaagctcgaaaatgtgctactggatagtgaggggcacattgttctaaccgatttcggtttatcgaaggagtttctcactgaggagaaggaacgaaccttctccttctgcggaaccatcgagtacatggctcccgagatcatccggtccaaaaccggccatggtaaggccgtggactggtggtccttggggattctgctgttcgaactgctgacaggggcttctccatttacactggagggcgagaggaatactcaagccgaggtgtcaagaaggatcttaaagtgctcccctcccttcccacccaggattggtcctgtggcccaggatctcctgcagcgtctgttgtgcaaagaccccaagaagaggctgggtgctggccctcagggtgcccaagaggttaggaatcatcccttctttcaaggtttggactgggttgccctcgcagctcgaaaaatccccgctccattcagaccccaaataaggtccgaactggatgttggcaacttcgctgaagaattcacacggcttgagccggtgtacagccctccaggttcacctccacctggagaccctaggatttttcaaggctacagctttgtggcaccaagcattctcttcgaccataacaatgccgttatgaccgatggccttgaagcgcctggcgcaggggacagacccggacgggcagccgtggcacgctcggcgatgatgcagtacgaactggatctgagagagccagctttgggtcagggctcatttagtgtgtgccgaaggtgccgccagcggcagtctggtcaggagttcgccgtgaaaatcctatcgcgccgtcttgaagcaaatacacaaagagaggttgccgcattacgtctgtgtcaatcacatcccaatgtcgttaatctgcacgaggtgcaccatgaccagctgcatacctatcttgtccttgaactgctgcgtgggggagaattgctcgagcacatccgcaaaaaacgtcatttttccgaatcggaagcttcgcaaatcctgagaagcctggttagtgctgtctctttcatgcacgaagaggctggcgtggtgcaccgtgacttgaagccagagaatattctctacgctgatgacacacctggagcgcctgtaaaaatcatagattttggcttcgcaagactgcggcctcaatccccaggcgtgccaatgcagactccctgttttaccctacagtatgccgctcctgagctcttagcccagcaggggtacgacgagagctgtgacctgtggagcctgggcgtgattctttatatgatgttgtctggccaggtgccttttcagggagcatcaggccaaggaggccagagccaagccgctgaaataatgtgcaagatccgtgagggacgtttctctctcgacggtgaagcgtggcagggcgtcagtgaggaggcaaaagagctggtgcggggtctgctcactgttgaccccgcaaaacgtttaaagctggagggactgagaggcagtagctggttgcaggacggaagtgctcgatcttccccccctctgcgaacccccgacgttttagagtctagcggaccagccgtgagaagtgggctgaacgccaccttcatggcgtttaaccggggaaagagagaaggcttttttctaaagagcgtcgaaaatgcccctttagccaagcgacggaaacagaaattgcgctccgccacagcttccagacgaggtagtcccgcacccgctaaccctggtagggccccagtagctagtaaaggagctcccaggcgcgctaacgggcctttaccccctagctag

SEQ ID NO: 5194 - DNA, 2118 bp, Artificial Sequence
  Description of Artificial Sequence: Synthetic coding sequence
acagaagccaacctgacagggcacgaggaaaaggtcagcgtggaaaacttcgagctcttgaaggtgctgggtacaggcgcttacggtaaggtgtttttagtgagaaaagctggagggcatgacgccggaaaactgtacgcaatgaaagttctgaggaaggccgcactagtccagagagctaaaacccaagagcatactaggacagaacgatcagttctagagctagtacgccaggccccttttttagtgaccctccactatgcctttcagactgatgccaagctgcacctgattctcgattatgtcagtggaggggagatgtttacccatctctaccagcgtcagtactttaaagaggccgaggtccgagtatatggaggcgaaatcgtgctcgccctagaacacctgcataagctgggcataatctaccgggacctgaaattggagaacgtccttcttgacagcgaaggtcacatcgttctgacggattttgggctcagcaaggaatttctaacagaagagaaggaacggaccttttctttctgtggcaccatagagtacatggctcctgaaataattaggtctaaaaccggacatggtaaagcagtagattggtggagtctcggcattcttctctttgaactcctgactggtgctagtcccttcacgttggagggcgaaagaaatacgcaagctgaagtgagtcggcgaatcctcaaatgtagcccacctttcccaccgaggatcggaccagttgctcaggatctgttgcagcgcctgctatgtaaggacccaaagaaaagactgggagctgggcctcagggagcccaggaagttagaaatcatccattcttccagggactggattgggttgccctggctgcacggaagattcccgctccctttagaccccagattagatcggagctagacgttggtaactttgccgaggaattcacccgcttagaacctgtgtattcccctcccggaagccccccaccgggagaccctaggatatttcagggttacagttttgtcgctccctctatactgtttgaccacaataatgccgttatgaccgacggtctcgaggcccctggggcaggcgaccgacctggtcgcgctgcagtggccaggtccgccatgatgcaacagtatgaattggacctgagggaacctgctcttgggcagggtagcttctctgtctgtcgccgatgtcgccaacgccaatcaggccaggagttcgccgttaagattctcagtaggagattggaggccaacacccagcgagaggtggccgcattgcgactgtgtcagagtcaccccaacgtggtcaatcttcatgaagttcaccatgatcagctccatacctacctcgttttggagttgctgagaggcggtgaactgctggaacatattagaaagaagaggcacttttctgaatcagaggcttcacaaatattacgttctcttgtgtctgccgtgtcctttatgcacgaggaggcaggggttgtgcaccgcgacctcaagccagagaacatattgtatgctgatgatacgccaggagcccctgtgaagatcatcgactttggattcgcccgattgagacctcagtctcctggagtgccaatgcaaaccccatgcttcacactgcaatacgcagcccctgagctgctggcccagcaaggctatgacgagtcctgcgacctatggtccctgggcgttatcctgtatatgatgcttagtggtcaggtccctttccagggcgcttcaggccagggcggtcagtctcaggctgccgaaataatgtgcaagattcgcgaggggagattttcgcttgatggcgaggcctggcaaggagtgtctgaggaggccaaggaactggtccgtggcctgctgaccgttgatccagcaaaaaggctaaagctggaggggcttagaggctcgtcatggctgcaggacggatctgctagaagcagtccaccccttcgaacgcctgacgtactggaaagtagcggcccagcagtacgctcagggttaaacgcaaccttcatggccttcaatcggggaaaacgggaggggttctttctgaagtcggttgagaacgcccctctctag

SEQ ID NO: 5195 - DNA, 2409 bp, Artificial Sequence
  Description of Artificial Sequence: Synthetic coding sequence
atggaggaggagggaggatccagtggaggagctgctggtacaagcgccgatggcggagatggcggtgagcaactcctcactgtaaaacacgagctgaggactgcaaatcttaccggacatgcagagaaggtagggatcgagaacttcgagctgctgaaggtgctgggtaccggagcatatggaaaggtatttctcgtcaggaaaatctctggacacgataccggcaagttgtacgcgatgaaggtcctcaagaaggccaccatcgtccagaaagccaaaaccaccgagcatacacgcaccgagcgacaggtgctcgagcatatcagacagtctcctttcctcgtgactctgcactacgcatttcagaccgagacaaaactgcatctaattctcgactatatcaacggaggggagctcttcacgcatctcagtcaacgggagcggttcaccgagcatgaagtccagatttacgttggagagatagtcctggccctcgaacatctccacaagttaggaatcatctaccgggacataaagctggagaacatcctgctggatagcaatggacatgtcgtgctgacagactttggcctcagtaaagaattcgttgcagatgaaaccgaacgtgcatactccttctgcggtactatcgagtatatggcaccagacattgtaagaggcggagacagtggacatgacaaggccgtcgactggtggtcattgggcgtactgatgtatgagctgctgaccggggcatctccattcacagtggacggcgagaagaacagtcaagctgagatatcccggcgaatcctcaaatctgagcccccatatcctcaggagatgtctgccctagccaaagacctgattcagagacttctaatgaaagatccaaaaaagaggctcggctgcgggcctagagacgcagatgagatcaaagagcacctcttttttcagaagataaactgggatgatttggccgctaaaaaggtgcccgctcctttcaaacccgtgatacgcgacgagctcgatgtgtctaactttgccgaagagtttacagaaatggatccaacctactcccccgctgcactgcctcagagcagcgagaagttgttccaaggttactcatttgttgccccatctatactgtttaagagaaacgcggctgtgattgaccccctccaattccatatgggagttgagaggcccggagttactaatgtggcccgatccgccatgatgaaagatagccctttctatcagcactacgaccttgatctaaaagacaaacctctcggtgaaggctcgtttagtatttgtcgcaagtgtgtgcataaaaaatccaatcaagcgtttgctgttaagatcatctctaagaggatggaggccaacactcaaaaagaaataaccgcactgaagctgtgtgaagggcatcccaacattgttaagctgcatgaggttttccatgatcagctgcacacttttctggtgatggaattactcaatggaggcgaactgtttgagagaatcaaaaagaaaaagcactttagcgaaaccgaagcctcctacatcatgagaaaactggtgtcagccgtcagtcatatgcatgatgttggggtggtacatcgggatctcaaacccgagaaccttctcttcaccgatgagaatgataatttggagatcaagattatagatttcggattcgctcgcctcaaaccaccggataatcagccactcaaaacaccatgtttcactctgcactacgcagcaccagagctgttgaatcagaatggctatgatgagtcctgcgacctctggtctttgggggtaattctgtacaccatgttatctggacaggtccctttccagagtcacgatcgctcccttacttgtacttccgctgttgaaataatgaaaaagattaagaagggcgatttctcttttgagggggaggcctggaaaaacgtgagccaagaagccaaggatctcattcaaggtttgcttaccgtggacccaaacaaacgtctaaagatgagtggtctccggtacaacgagtggctgcaggacggaagtcagttgtcttctaatcccctcatgaccccagacatcctcgggagcagcggtgctgcagtccacacctgcgtgaaagcgactttccacgccttcaacaaatacaaacgggagggattttgcctgcagaacgtggataaagcccctctcgccaaaagacggaagatgaagaaaacatctaccagcactgagacgcgttcttccagtagcgagtcctcccacagcagctccagccactctcacggcaagacaactcctacgaagacattgcaacctagcaacccagccgactccaacaatccggagacactattccaattctctgattctgtggcctag

SEQ ID NO: 5196 - DNA, 1650 bp, Artificial Sequence
  Description of Artificial Sequence: Synthetic coding sequence
atggaggaggaaggagggagcagcggaggtgcagccggaaccagcgccgacggaggtgatgggggagaacagctgctaactgttaaacacgagctgcggactgctaatctgaccgggcacgctgagaaagtgggaatcgagaattttgagctgctgaaagtgctggggaccggagcttatggtaaagtgtttctggtccggaagatctctggccacgatacgggaaagttgtacgcaatgaaagttctgaaaaaggccacaatcgtccagaaagcaaagactacagaacatactcgaacagagcgccaggttctggagcatattcgacagtcccctttcctggtgaccctgcactacgcctttcagactgagaccaagctccatttaatcctcgattatatcaatgggggtgaattgttcactcacctttcccagcgtgagcgttttacagagcacgaagtgcagatttatgtgggcgagattgtcctggccttagagcacctgcacaagcttgggatcatctatcgggatatcaagctggaaaacattctgctggactcaaacggccacgtcgtgctcactgacttcggcctgagcaaagagttcgtcgccgatgagaccgaacgggcttactctttctgcggcaccatcgagtatatggcaccagacatcgtcagagggggtgactctggccacgacaaagcagtggattggtggagcctcggtgtgttaatgtatgagctgcttaccggggcatccccgttcaccgtggacggtgaaaagaattcccaggctgagataagcaggcgtatcttgaagagtgagcccccatacccccaagaaatgagcgccctcgctaaggatctcattcagagactgctgatgaaggacccaaagaaaaggctgggttgcggcccacgggacgcagacgagatcaaggaacatctattttttcagaagatcaattgggatgacttagccgcaaaaaaggtgcccgctcccttcaaacccgtcatcagggacgagctagatgtgtccaacttcgccgaggagttcacagagatggatcccacctactctccagcagctctaccacaatcttccgagaagctgttccaggggtattccttcgtagctccgagtattctcttcaagcgaaatgccgcagtcatagatccactccaattccatatgggcgttgagcgaccgggtgtcaccaatgtagctaggtcagccatgatgaaagattcaccattttaccaacattacgatcttgatctgaaggacaagcccctaggagagggttctttctctatctgcagaaaatgtgtccataaaaaaagtaaccaagccttcgcagttaagattatctccaagcgaatggaagctaacactcagaaagagatcaccgctcttaagttgtgtgaggggcaccccaacattgtaaagctgcacgaggtgttccacgatcagttgcatactttcctggtaatggaactgctgaacggaggagagctcttcgagcgaatcaaaaaaaaaaagcacttcagtgaaaccgaagcatcttatatcatgcgaaagctggttagcgccgtatcacacatgcacgatgtcggagtcgtgcacagagacctaaaaccagaggtctag

SEQ ID NO: 5197 - DNA, 2172 bp, Artificial Sequence
  Description of Artificial Sequence: Synthetic coding sequence
atgaaggtgctgaaaaaagccaccattgtacaaaaagcaaaaacaaccgaacacactaggaccgagagacaggtccttgagcacatccgtcagtctccattcctggtcacactccactacgcatttcaaactgagaccaaactgcacttgatcctggactacataaacgggggagaattgttcacccacctgagccagagagagcggtttaccgaacacgaagtgcagatctacgttggagaaatagtcctggctttggagcacctccacaagctaggaattatataccgcgatattaaactggagaatattctgctggacagcaatggtcacgtcgtccttaccgatttcgggttaagtaaggagtttgttgccgatgagacggagagggcttatagcttctgcgggacgatcgaatatatggcccctgacatcgttcggggtggtgacagtggccatgacaaagctgtggactggtggtcactgggggtcctcatgtacgaacttctaactggcgcttcaccattcacggttgatggggaaaagaactcccaggcagaaatttcacgacgcattttaaaatccgagcctccatatccacaggaaatgtcagccttagccaaagatctgattcagaggcttttgatgaaggaccccaagaaaagactgggctgcgggcctagagacgctgacgagataaaagagcacttgtttttccaaaagattaactgggacgacctggccgcaaaaaaagttcccgctcccttcaagcccgttattcgggatgaactcgacgtgagtaactttgccgaagagttcaccgaaatggatcctacctactcccctgcagccctgccacagtctagcgagaaactttttcaggggtacagttttgtcgccccatctatcctgttcaagaggaacgctgccgtgattgacccactccaattccatatgggggttgagcggcctggcgttactaacgttgccagatctgcaatgatgaaagattcccccttttaccagcactatgatcttgaccttaaggacaaaccattgggcgaggggagttttagcatctgcaggaaatgtgtgcacaagaagagcaaccaggccttcgccgtgaagattatttccaaacgcatggaagcaaacacacagaaggagataacagccctcaagctgtgcgaaggacatccaaacatcgtgaagcttcatgaggtgttccacgatcagctccatacttttctcgttatggagttgcttaatggcggagagctgtttgaaaggatcaaaaaaaagaagcacttttcagagaccgaggccagttacatcatgaggaagctggtttctgctgtttcgcacatgcatgacgtgggagttgtgcatcgcgatctcaaaccagaaaacctgctgttcacagacgagaacgacaaccttgagatcaaaattatcgactttggattcgccaggttgaagccacccgacaatcaacccctgaagaccccgtgctttactctgcactatgcggcaccggagctgctcaaccaaaacggctatgacgagtcctgtgatctgtggtccttgggcgtgatcctctacaccatgctgtccggccaggtcccatttcagtctcatgacaggagtctcacgtgcacctcagctgtagagatcatgaagaaaatcaagaagggagacttctcatttgagggagaagcctggaagaacgtgagccaggaagccaaagacctgatccaagggcttctcaccgtcgacccgaataagcgcttgaagatgtctggtctgaggtacaatgaatggctgcaagatggcagccaactgtctagcaacccactgatgacccctgacattctcggcagttctggtgccgcagtgcacacctgtgtgaaggccacctttcatgcttttaacaagtataagcgagaggggttctgtctgcagaacgtggacaaagccccacttgccaaacgcaggaagatgaaaaaaactagcacgagcacagaaacccgatcctccagctcagagagttcacactcctcaagcagccattcccatggtaaaaccaccccaactaagactctccagccttccaaccccgcagactcaaacaatcccgagacactgttccagttcagcgactctgtcgcatag

SEQ ID NO: 5198 - DNA, 2238 bp, Artificial Sequence
  Description of Artificial Sequence: Synthetic coding sequence
atgctgccctttgcgccacaagatgagccatgggatagggagatggaggtgttcagtgggggaggcgcaagctctggggaggtgaacggcttgaagatggtggatgagcctatggaagaaggtgaggccgacagctgccatgatgaaggcgttgtgaaggaaatacctattacgcatcatgtcaaagagggatacgaaaaagcggaccctgctcagtttgagctgctgaaagtgctggggcagggctccttcggcaaagtcttcctggtccgtaaaaaaaccggccctgacgccggacagctgtacgccatgaaagtgctcaagaaggctagtttgaaggtgagggatcgagtgcgaactaaaatggagagggatatcctggtcgaggtgaaccacccgtttattgtcaagctccattatgcctttcagacagagggtaaactctatctgatcttggatttcctaaggggtggcgacgtgtttaccagactcagtaaggaggtgctgtttacagaggaagatgttaagttttatctggctgagttggccttagcactggaccatctgcaccagctgggaattgtgtacagagatttgaagcccgaaaacatattgcttgatgagattggacatatcaaactgaccgacttcggcctgtccaaagagagtgttgatcaggagaaaaaagcatactccttctgcgggacggtcgagtacatggcccctgaagtagtaaatagaagaggtcattcccagtcagctgactggtggagctatggggtactgatgtttgagatgctgactggcacactcccattccagggaaaagaccgaaacgagacaatgaacatgatcctaaaagccaagttggggatgccacagtttttgtctgccgaggcccagagtctcctcaggatgctgtttaagagaaatcccgctaatcggctggggtcagaaggagttgaggaaatcaagaggcatctgttcttcgctaatatcgattgggacaagctgtataagcgggaggtgcaaccccctttcaaacccgctagcggcaagcctgacgacacattttgtttcgatcccgaatttaccgcaaaaacgccaaaggactcgcccggattgcctgcaagtgcgaacgcccatcagctcttcaaggggttttctttcgtcgccacatctatagcagaagagtataagatcacacccattacctcagcaaacgttctgccaatcgtccagataaatgggaacgctgcccaatttggcgaagtgtacgagctgaaagaagatatcggcgtggggagttactccgtgtgcaaacgctgtatacatgcaacgactaacatggagttcgctgtcaagataattgacaagagcaaaagagaccctagtgaggaaattgagatccttatgcggtacggacagcaccctaacatcattaccctgaaagacgtattcgatgacggacgctacgtttatctggtaactgatctgatgaagggcggtgagttgttagataggattctcaaacaaaaatgctttagtgagcgcgaagcttcagatatcctttatgtcatcagtaagacagtcgactacctgcattgccagggcgtggtgcacagggatctaaagccgtccaatatcctgtacatggacgagtctgctagtgctgactccataaggatctgcgactttgggttcgccaaacagctgcgtggcgagaatggcctgcttctcacaccttgctacaccgcaaactttgtggcccctgaagtgctcatgcagcagggttatgacgcagcatgcgacatttggagcctcggtgtgttgttttacaccatgctggcgggatacaccccattcgctaacgggcctaacgacaccccagaagaaattttgcttaggatcgggaatggtaaattttctctttccggtgggaattgggataacatctctgacggagctaaggatcttctgagccatatgctacacatggaccctcatcagaggtatactgctgaacaaattctgaagcactcatggatcacccatcgcgaccaactgcccaatgatcagccaaagagaaatgatgtcagccacgtcgtgaaaggcgctatggttgccacgtactctgccctgactcataaaacatttcagcctgttctagaaccagttgctgcctcttctttggcccaaaggagaagtatgaaaaagcgcacttcaaccggcctgtag

SEQ ID NO: 5199 - DNA, 2238 bp, Artificial Sequence
  Description of Artificial Sequence: Synthetic coding sequence
atggggttaagcacgagcgcaatttggaaaaacacccgggtggaaattgttaacccctatgaggtgaagcgcaaggtaaaggttaacggactgaaaatggtggatgaaccgatggaggaaggagaggctgatagttgccacgacgagggagtcgtgaaggaaattccgatcacccaccacgtcaaggaggggtatgaaaaggcagacccagctcagttcgaattgcttaaggtgctggggcagggatcctttggaaaagtgttcttggtacgcaagaagaccggccctgacgctgggcagctctatgctatgaaggtcctgaaaaaagcctcattgaaagtgcgcgacagagtgcggaccaaaatggaacgagacatactggttgaagtgaatcacccctttatagttaaactccattatgcattccagactgaaggaaagctgtatttgatactcgactttcttaggggaggagatgtgttcactagactcagcaaagaggtcctgtttactgaagaggatgtaaaattctacctagcagagctggcccttgctctggaccacctgcatcagctcggtattgtgtatagggatctaaaaccggaaaacatattgcttgatgaaatagggcacatcaaattgaccgattttggcctgagtaaagaatcagttgatcaagaaaagaaggcctatagcttctgcggcacagtcgagtacatggctccagaggtagtgaaccggaggggacattctcagagcgcagattggtggtcttacggagtgctgatgtttgaaatgctaaccggaaccctgccttttcagggcaaagaccggaatgagaccatgaacatgattctaaaggctaagctgggaatgcctcagttcctttctgccgaggctcagagccttcttcgtatgctgtttaaaaggaaccctgctaacagactgggtagcgaaggcgtcgaggaaattaagagacatctgttcttcgcaaatattgactgggataaactttacaagagggaggttcaacctccctttaagcctgcatcaggcaaacctgacgataccttctgtttcgatcccgagtttacagctaaaactcccaaagattcccctggattgccagcctctgccaacgctcatcaattattcaagggtttcagctttgtcgctacctcgattgcagaggagtacaagatcactccaatcacctcagctaacgtcctgcccattgtgcagattaacggcaacgcagcccagttcggcgaagtctacgagctgaaagaggatattggcgtcgggtcctacagtgtatgtaagaggtgtatacatgccacgactaacatggagtttgccgtaaagattatcgacaaaagtaagagggaccctagtgaagaaatcgaaattctgatgcggtacgggcagcaccccaatatcattaccttgaaggacgttttcgatgatgggaggtatgtttacctcgttaccgaccttatgaaaggtggagagctcttggaccgtatccttaagcagaaatgcttcagtgagcgagaagcttccgacatattgtatgtgatcagcaaaaccgtggattacctccactgccagggtgtggtgcatagagatctgaaaccttccaatattttatatatggacgaatctgcctcagcagactccatacgaatctgcgatttcggattcgccaagcaactgcggggtgagaatggcttactgctcaccccctgttacaccgccaactttgttgcacctgaagtgttgatgcagcagggctatgacgctgcttgcgacatctggtcactgggagtgctgttctacacgatgctggctggctacactccctttgccaacgggccaaacgatacacctgaggaaattctgctgcggatcggcaatggaaagttttcattatccggcggaaattgggacaatatctctgacggcgcaaaggacctgttgtcccatatgttgcatatggacccccaccagcggtatacggccgagcaaattctgaagcacagctggatcactcaccgtgaccaattacccaatgatcagcctaaaagaaacgatgtgtctcacgttgttaagggagctatggttgcaacttactctgccctcacccacaagactttccagcccgtcctcgaacccgtagccgcatccagtttagcacagcggaggtccatgaagaagagaacctctaccggcctttag

SEQ ID NO: 5200 - DNA, 1626 bp, Artificial Sequence
  Description of Artificial Sequence: Synthetic coding sequence
atgtccctggttgcctgcgagtgcctgccaagtccaggactcgagccagaaccctgttcccgagcaaggagccaggcccacgtgtatctggagcaaatcagaaatagggtggcccttggggtgcccgatatgacaaagcgagactacctcgtggacgctgctacacagattcggctggcgctggaaagggacgtcagcgaggattacgaagctgccttcaatcattaccagaatggggtggacgtgctgctcagaggaattcatgtggacccaaacaaagagcgcagggaggcagtgaagttaaagataacaaaatacctgagaagagccgaggaaatcttcaattgccacctgcagcgccctctctcctcaggcgctagcccctccgccgtccagttagtacaagatccagcaaccggcggtactttcgtggtcaagtccctgcctcgctgccacatggtctctagggagcgcctgaccattattccccacggcgtcccatatatgactaaactcctccgttactttgtttctgaggacagtattttcctgcatttggagcacgttcaggggggaaccctttggtctcacctcctctcgcaggctcattcaaggcactccggactgtcctcgggaagcacccaagagcgcatgaaggcccaattgaacccccacttgaaccttttaactccagcccgtctcccatcaggacatgctcccggtcaggaccggattgccctggaaccacccaggactagccctaacctgctcttggccggagaagctccctccacaaggccacaacgggaagctgaaggggagccgaccgctagaacctctacttcgggatccagcgacctcccaaaagcgccaggtggtcacttgcacctgcaggcacggcgagccggacaaaatagtgatgcgggaccaccacggggtctgacctgggtgccggagggcgcagggcctgtgctgggcggttgcggaagaggcatggaccaaagctgccttagcgccgacggggcaggaagaggctgcgggagagccacctggtcagttcgagaggagcaagtcaagcagtgggctgccgagatgctcgttgcactcgaggctcttcacgaacaaggcgtcctgtgccgtgacctgcacccgggtaacctccttctggaccaagcgggacatatacgactcacatacttcgggcaatggtccgaggtcgagccacaatgttgtggcgaggccgtggacaacctgtattccgcgcctgaggtgggagggatatcggagctgacggaggcttgcgactggtggagcttcggctccctgttgtacgaactcttgaccggtatggccctcagtcagtcccaccctagtggaatccaggcccacacgcagctccagctgcccgagtggttaagtcggccagccgcttctctactgactgaactactgcaattcgaacccacccggaggctgggcatgggcgaaggtggcgtgtctaagctgaagagccacccctttttcagcacaatccaatggtccaagctggtcggaaccagtctcgaaactcacctgagaacactgatccattggctgtcaggtcctaagcctgattgtcctggatag

SEQ ID NO: 5201 - DNA, 1650 bp, Artificial Sequence
  Description of Artificial Sequence: Synthetic coding sequence
atgtccctcgtggcatgcgaatgcctcccaagcccaggtctggaaccagaaccttgcagccgtgctcgtagccaggcccatgtgtatctggagcagattcggaatagagtagcgttgggggtccccgacatgactaagcgggactaccttgtcgacgcggctacacagatccgactagcgctggagcgggatgtcagcgaagattacgaagctgctttcaaccactatcagaacggcgtagatgtcctgttacggggaatccatgtcgatccgaacaaagagcgacgggaggctgtaaaactcaaaattactaagtacctaagacgggcagaggaaattttcaattgccatttgcagcggcctctgagctcaggcgcttctccatctgccggttttagctctctgagacttagacccatacgcaccctgagctcagcggtggagcagttgaggggatgccgggtggtcggagttatcgagaaagtgcagttggttcaggaccctgccacgggcggaacattcgtcgtcaagagtttgcctcgctgccatatggttagccgcgaacgcctaacaatcattccacacggggtcccgtatatgaccaagctgctgagatatttcgtgagcgaggactccatctttttgcacttagaacacgttcagggagggactctgtggtcccatctattgtctcaagcgcactctcggcacagtggactgagctctggctctacccaggagcggatgaaagcccagctgaatcctcacttgaatttgttgactccagcccgtctcccttccggccatgcccctgggcaggatcgtatcgccctggaaccgccacggacctcaccaaatctgcttcttgccggagaggcgccttctactagacctcagcgcgaagccgagggcgaaccaaccgctaggacttctaccagcggctcgtctgatctgccgaaggctcctggcggacatttgcacttacaggctcggagggctgggcagaatagcgacgccggtccgccacggggactgacttgggtaccagagggagccggtcctgtgctcggcggatgcggcaggggcatggaccagtcctgtctgtccgccgacggtgccggacggggttgcggcagagccacttggagcgtacgtgaggagcaggtgaagcagtgggcagccgagatgctggtggctctggaagccttgcatgaacagggagttttatgcagagatcttcacccgggaaatctcctgctggatcaggcaggccacattcggctgacttatttcggtcagtggtctgaggttgagcctcagtgttgtggtgaagcggttgacaacctgtacagcgccccagaggtgggaggaatttccgagctgaccgaggcttgtgattggtggagctttgggtcgctgctgtatgagctgctgaccggcatggcactgagtcagagtcacccatctgggattcaggcacatactcagttacagctgcccgaatggttgtcacggccagctgctagcctgctgaccgaactcctccagtttgagcccacaaggcgcttaggcatgggggaaggcggagtgtctaagctgaagtcccatcccttcttttccaccattcagtggtccaagctcgtgggttag

SEQ ID NO: 5202 - DNA, 1650 bp, Artificial Sequence
  Description of Artificial Sequence: Synthetic coding sequence
atgagcctggttgcatgcgaatgtttaccctctcctggcctggaacccgaaccctgttctagggcccgaagtcaggcccatgtgtacctggaacagattcgtaaccgcgtcgcactgggcgtgccagatatgacgaaacgggactacctcgttgatgcagcgactcaaatcaggcttgcactcgagcgggatgtgtcagaggattacgaggcagccttcaatcactaccagaacggagtggacgtcctgctgaggggcatccacgtcgatcctaacaaggagagaagagaggcggtgaaacttaaaatcaccaagtatctcaggagggccgaggaaatttttaactgccacctacagcggccactatcttcaggcgcatctcctagcgccggtttcagctctctgcgcctgaggccgattcgtaccctgtctagtgccgtcgaacagctacggggttgtcgggtagtgggcgtgattgagaaagtccagctcgttcaggacccagcaacaggcggaacttttgtcgtaaaaagccttcctaggtgtcatatggtgagcagagagagacttactattatcccccatggcgtaccctacatgactaaattactgcggtactttgtctctgaggactccatcttcctccacctcgagcatgttcagggtgggacattgtggagtcacttactgtcccaggcgcattcacgacattctgggttatcctcagggtccacccaagagcgtatgaaggctcagctgaatccacacctgaacttattgacccctgcacggctgccgagcgggcacgccccaggccaggacagaattgctctcgagcctccacgaacctcccccaacttactgctggcaggggaagcgcctagcacacgtcctcagcgagaggctgagggagaacccactgcgagaaccagtaccagtggatcaagtgatttaccaaaagctcccggagggcatctccaccttcaggctaggcgtgcaggccagaattccgatgctggccctcctaggggactgacatgggtacctgagggagccggacccgtgctcggcggatgcgggaggggaatggatcagtcatgcctgagcgcggatggtgcaggtcgcggatgtggtagagctacgtggagtgtgcgggaggaacaggtaaagcagtgggccgctgagatgctggtagccctggaagctctgcacgagcaaggtgttttgtgccgggatctgcaccctggtaacctactcctggaccaggcgggacacattcggctcacttattttgggcagtggtcggaggtggaaccacagtgttgcggcgaggccgtggacaacctgtattccgcgccagaggtgggaggcatttctgagttgaccgaggcttgcgattggtggtccttcggcagtctcctctatgaactcctcactggtatggcactcagccagtcacacccatcagggatccaagcccatactcaactgcagctccctgagtggctttcccggccagccgcttctctgttaaccgaactccttcagttcgagccgacacgaagactaggaatgggagagggcggagtgagcaaacttaagtcccatcctttctttagcacaatccagtggtcaaagttggttgggtag

SEQ ID NO: 5203 - DNA, 30 bp, Artificial Sequence
  Description of Artificial Sequence: Synthetic coding sequence
atgtctctggtggcttgtgagtgtttatag

SEQ ID NO: 5204 - DNA, 1650 bp, Artificial Sequence
  Description of Artificial Sequence: Synthetic coding sequence
atgagtttagtcgcttgtgagtgtctcccctcacccggattggaaccggaaccgtgctcgagggccaggagtcaggctcatgtgtatcttgagcagattaggaaccgtgtagcgctgggggtgcccgacatgacaaagcgagattacctggtggacgccgcaacacagattcgtctggcactggagcgggacgtcagcgaggattatgaagcagcctttaatcattaccagaacggagtcgatgtcttgctgagaggcatacatgtggacccaaacaaagagagaagggaggccgttaagcttaagatcaccaaatacttacgcagggcagaagagatttttaactgtcacttacagaggcccctcagtagcggggcttccccttcagccggtttttctagcctacggctgaggcctattcgcaccttatcctcagctgtcgaacagctgcgtggctgtcgcgtcgtgggagtaatagagaaagtgcagctagttcaagatcccgctactggtggaacgttcgtggttaagtctcttcctcggtgccatatggtatctcgtgagcgcctgaccataatcccacacggagtcccatacatgaccaaactgctgcgatacttcgtgtccgaggattcgatcttccttcatttggagcacgtccaaggcggaactctttggtcccatctgctgtcccaagcccacagcagacactctggcctgtcctcaggctcaactcaggagcgcatgaaagcccagctgaatccccaccttaacttgcttacgcccgcacggctaccctctgggcacgcccctggtcaggaccgcatcgcacttgagccaccacgcaccagccccaatctgcttctagccggagaggcgccttctaccagaccccagagagaagcggagggggagcccacggcaaggaccagtacaagtggcagcagtgacctgcctaaggcccctgggggacatctgcacctgcaggcgagaagggccggacagaacagtgacgccggaccaccacgcggactgacttgggtgcccgagggggcaggcccagtcctgggaggatgcggaagagggatggaccagtcatgtctcagcgcggacggtgcgggaagaggctgcggtcgtgccacttggtctgttagggaagaacaggtgaagcagtgggcggcagaaatgctggtggctttagaagcactgcacgaacaaggcgtcctgtgccgcgacttacacccaggaaacttactcctcgatcaggccggtcacatccgcttgacgtatttcgggcagtggagcgaggtcgaaccccaatgctgcggtgaagccgtggataatctatactccgctccagaggtaggtggaatttctgagctgaccgaggcttgcgactggtggtctttcggtagccttttgtacgagctgttgacaggcatggctctatcccagagccatccatccggcattcaggctcacacacagctgcagcttcccgagtggctgtctagacctgcagccagtttgctgactgaactgctgcagttcgagcctactcgcagacttgggatgggcgagggcggagtttccaaactgaagagccatcccttcttctcaacgatccaatggtcaaaactggtgggctag

SEQ ID NO: 5205 - DNA, 1818 bp, Artificial Sequence
  Description of Artificial Sequence: Synthetic coding sequence
atgttacctcagcaggtcggctttgtgtgtgccgttttggccctggtgtgctgcgcgagtggactgtttggatccctgggacacaagactgcctcagccagcaagagggtgctgcccgatacttggcgcaaccgaaagcttatggcaccagtaaatgggactcagacagcgaagaactgtaccgacccagcaattcacgaatttcctaccgatcttttttccaacaaagagcggcagcacggggctgtcctgctgcacattctgggcgctctttatatgttctatgcgctcgccattgtgtgtgacgatttttttgtcccttccctcgaaaagatttgtgagaggctacacctcagtgaagatgtcgccggagcgacattcatggccgctgggtcctctactcctgagcttttcgcatcagtcatcggtgtctttattacccacggagacgtgggcgtagggacaatcgtagggtcagccgtgttcaacatcttatgcattataggggtatgtggcctgtttgccggtcaggtggtgcggcttacatggtgggccgtatgccgagactcagtgtactacacgatttcggtcatcgtgttgatcgtttttatttacgacgaacaaattgtgtggtgggagggcttggtactgattatcctttacgttttttacatcctgataatgaagtataatgtcaaaatgcaggccttttttaccgttaagcagaaaagcattgccaatggcaaccccgtgaatagtgagttagaagcaggaaatgacttctatgacggctcttacgacgacccttcagtgcctctgctgggccaggttaaagagaagccgcagtatgggaagaatcctgtggttatggtggatgagatcatgtcctcctcccccccaaagtttaccttcccagaggccggacttagaattatgataaccaacaagttcggcccacgcacgagactgcgcatggcttcccgcatcattataaatgagcggcagagactcataaacagcgcaaacggggtgtcaagcaagcccctccagaatgggcgtcacgaaaacattgaaaatggtaacgtgccagtggagaaccccgaagacccccagcaaaatcaggagcagcagccgccacctcagccaccaccccctgagcctgaaccggtcgaggcagattttctgtctccgtttagtgtgcctgaagcaagaggcgacaaggtcaagtgggttttcacctggccactgatctttttgttgtgcgttacgattcctaactgctccaagcctagatgggagaagttttttatggtgacattcatcacagccacattatggatcgctgttttctcttacattatggtgtggctggtgacaattataggctacaccctgggaatccccgatgttattatggggatcaccttccttgcagcaggcacttccgtgccagactgtatggccagcctgatagtcgctcggcagggactaggcgacatggcggtgtccaataccattggatccaacgtcttcgacattctggtagggctaggcgttccttggggcctgcagacaatggtagttaactacggatcaactgtgaagatcaactcccgaggactggtctattcagtggtgctgttgctagggagcgtggctctgacagtgttaggaatccacttaaacaaatggcgattggaccgtaagttaggggtctacgtcttagtcttgtatgcgatttttctgtgcttctctattatgattgaattcaatgtcttcacttttgtgaacctcccgatgtgtcgcgaggatgactag

SEQ ID NO: 5206 - DNA, 1059 bp, Artificial Sequence
  Description of Artificial Sequence: Synthetic coding sequence
atgttctacgccctggcaatcgtgtgcgacgatttttttgtgccttcgctggaaaagatctgtgagcgcctacacttgagtgaagacgttgccggagccacatttatggctgcgggaagcagcactcccgagctattcgcaagcgtgatcggagtctttattacccacggtgatgtcggggtggggacaatttctgtgtcattcgccctgcagtttatatacgatgaacaaatcgtttggtgggagggactggtactgatcatactgtatgtattttacattctgattatgaaatacaacgttaaaatgcaggcattcttcacagtgaaacagaagtccattgctaacgggaatcctgtgaattccgaattagaagctgggaacgacttctatgacgggagctacgacgacccatcagtgccgttgctagggcaagtcaaagaaaagccccaatatggtaagaatcccgtcgttatggtcgatgaaatcatgtcctcatccccccctaagtttacttttccagaagccggtcttcgtatcatgatcactaacaagttcggcccacgcacacgtctgaggatggcatccagaatcatcataaatgagcggcaacggctgattaattctgcaaacggggtcagttccaaaccgcttcaaaatggcaggcatgagaatatagagaatggcaacgtgccagtggagaacccagaggaccctcagcaaaatcaggagcagcagcctccccctcagcccccaccccctgaacccgagcccgtggaggccgatttcctgtctccattcagcgtgcctgaggctagaggggataaggtgaagtgggtctttacttggccactgattttcctcctttgtgtaacaatacctaactgctcaaagccgcgatgggaaaagttcttcatggtgacattcataaccgcaaccctgtggattgctgtctttagttatatcatggtgtggctcgaacaacgcgagggaaagcaattccagcatgggtgctcatcagtggattgcgaaactcactcgcaacctctcaccccatag

SEQ ID NO: 5207 - DNA, 1761 bp, Artificial Sequence
  Description of Artificial Sequence: Synthetic coding sequence
atgctgcctcagcaggtgggctttgtctgcgccgtgttagcgctggtttgctgtgcctctggattattcggaagtttggggcataagaccgcctcggcctcaaagcgcgtactgcccgacacatggcgcaatcggaaacttatggccccagtaaatggaacccagacagcgaagaactgtaccgatcccgctattcacgaatttcccaccgatttattctcaaacaaggaacgccaacacggcgctgttttgctccatattttgggagccctgtatatgttctacgctcttgcaatcgtttgtgatgatttctttgttcctagccttgagaagatctgcgaaagactgcatctttccgaagacgttgcaggtgccacatttatggccgcaggtagttcaacccccgaattgttcgcctcagtgataggggtatttattacacatggggatgtaggagtcggcacaattgttgggagcgctgtgttcaatatcctgtgcattataggcgtatgcgggctgttcgccggacaggtagtgagactcacgtggtgggccgtatgccgagatagtgtgtactataccatttcagttattgtactcattgtcttcatctacgatgaacagatcgtgtggtgggaaggcctcgttcttatcatcctgtacgtgttttacatcttaattatgaaatataatgtgaagatgcaggctttttttacggttaaacagaagagcatcgctaatggcaaccccgtgaattccgagctggaggcagtgaaagaaaagccacagtacggcaaaaatccggtagtgatggtcgacgagatcatgtctagctccccacctaagttcacttttcccgaggcaggcctgcggatcatgatcactaacaaatttggccctcgcacaagactccgcatggctagtagaattatcatcaatgaacgtcagcggctgatcaatagcgcaaatggtgtgtcatctaagccccttcagaatgggaggcatgaaaacatcgagaacggtaatgtgcccgtggagaacccagaggacccccaacagaatcaggagcaacaacccccacctcagccaccccctccggagcctgagcccgttgaggcagattttctgtcgccattttccgtccccgaggccaggggagataaagtaaagtgggtcttcacctggcctctcatttttttactgtgcgtgaccatcccaaattgctctaaaccgagatgggagaagttttttatggtgacatttatcactgcaacactctggattgctgtgttctcatacatcatggtctggctcgtcactattatcggctatacgctgggcataccggacgtgatcatgggaatcaccttcctggccgcaggcacttcagtcccagattgcatggctagcttgatagttgcacgccagggcctgggcgacatggcggtgtccaacacaattggatccaacgtatttgatatacttgttggattgggcgttccttggggcctgcagacaatggtagtgaactacggctcaacagttaagatcaattctaggggtcttgtttactccgtggtcctgctgttagggtctgtggctcttactgtgctgggcattcacctgaataagtggcggctcgaccgcaagttgggggtgtatgtcttggtgttgtatgcaattttcctttgttttagtattatgattgaatttaatgtgttcacctttgtgaacctccctatgtgtagggaagacgattag

SEQ ID NO: 5208 - DNA, 1677 bp, Artificial Sequence
  Description of Artificial Sequence: Synthetic coding sequence
atggctcccgtgaacgggactcagaccgccaagaactgtaccgatccagccatccatgaattcccaaccgacctcttctctaacaaagagcggcagcatggagctgtgctgcttcacattttaggggcactctacatgttttatgctctggcaatcgtgtgtgatgacttttttgttccctctctggaaaaaatttgtgagcggctgcacctctctgaggatgtggcaggggcaacattcatggctgccggatcttccacaccagagctgttcgcgtcagtcatcggggtgttcatcactcatggggatgtgggtgttgggaccatcgtaggctccgccgtgtttaatattctctgcatcatcggagtttgcgggctgttcgctggacaggttgtccgcctgacatggtgggccgtctgtcgggacagcgtctactatacaataagtgtgattgtattgatagtcttcatctacgatgaacagattgtttggtgggaagggctagtcttgatcattctctatgtcttttacattttgatcatgaaatataacgtcaaaatgcaggcgtttttcactgtgaagcagaagtctatcgctaatggcaatcctgttaattcagaactagaagcgggaaatgacttctatgacggatcttatgatgatccctcagtacccttactggggcaggtgaaggagaaaccacagtacggcaaaaatccagtcgtgatggtcgacgaaataatgtcgtcgagccctccaaagtttactttccctgaagcgggtctccgcatcatgattaccaacaagttcggcccaaggaccagactgcgcatggctagtaggatcatcattaatgaacgccagcgtctgatcaactcggctaacggggtcagctcaaaacccctacaaaacggaagacatgagaacattgaaaacggtaacgttccagtcgaaaatccagaagacccccagcaaaatcaagagcagcagcctcctccacaaccgcctccacctgaacctgaaccggtggaggccgactttttgagccccttctccgtgccagaagcacgcggtgataaggtcaagtgggtctttacctggccactgatatttctcctgtgcgtgactattccaaactgtagcaagccccgttgggaaaaattttttatggttacgttcatcactgccaccctgtggatagctgtgtttagctacatcatggtctggctggtgacaatcatagggtacaccctgggaattccagacgtgattatgggcatcacttttctggctgctgggaccagcgtgccagactgtatggcctctttaattgtcgcccgtcagggccttggcgacatggcggtgtctaataccattggaagtaacgttttcgacattctggtgggcctgggagtgccatgggggctgcagacaatggtggtaaattatggtagcaccgtgaaaattaactcaagaggactggtgtactcagtcgtgcttctgctaggaagcgtcgctcttaccgtactcgggatacacctgaataaatggcggcttgaccggaagctcggcgtgtatgtgttggtactttatgccatcttcctctgtttttccataatgatcgaatttaacgtctttacttttgtgaacctccccatgtgtcgggaagacgactag

SEQ ID NO: 5209 - DNA, 1812 bp, Artificial Sequence
  Description of Artificial Sequence: Synthetic coding sequence
atggctctcagaggaacactgcggccattgaaagttcggagacgcagagagatgctccctcaacaggtgggatttgtgtgcgccgtgctcgcgctggtctgctgcgctagtggtctgtttggctctctcggacacaaaacagcctccgcaagcaagagagtcctaccagatacttggcgcaatagaaaactgatggccccagtgaacgggacacagacggcaaaaaactgcaccgacccagcaatacatgaatttcccacggatttgttcagtaataaagagagacaacatggagcggtgttactccacattcttggcgcactctatatgttttacgcattagctatagtgtgtgacgactttttcgtgcctagtctggaaaaaatttgtgaacgcttacatctgtccgaggatgtagccggagctacatttatggccgcagggagctcaacacccgaactgttcgctagcgtcatcggcgtgtttatcacacatggcgatgtcggagtcggaacgattgtcggaagtgcagtgtttaatattttgtgtataatcggtgtttgcggcctgtttgccggtcaggtggtgaggctcacctggtgggccgtctgcagagattccgtgtattatacaataagtgttatcgtgctgattgtctttatatatgacgagcagatagtgtggtgggaggggctggtgctgattatattatacgtattctacatcttaattatgaagtataacgtgaaaatgcaagcttttttcaccgtcaaacagaagtccatcgccaatggcaaccccgtaaattcagaactggaagcggtgaaggagaagcctcagtacggaaagaatccagtcgtaatggtcgatgaaatcatgagcagcagccccccaaaattcacgtttccagaagctggcctaaggattatgattacaaacaagtttggccctaggacccgtctaaggatggcctcgcggattattatcaacgagagacagaggctgataaactctgctaatggggtgtcttcaaagccactccagaacggcaggcacgagaacattgagaatggaaacgtgcctgttgaaaacccagaagatcctcaacagaaccaggagcagcaaccgcctccacagccaccaccgccagaaccagagcctgttgaggcagatttccttagtccattctcagttccagaggccaggggggacaaggtaaagtgggtcttcacctggcccctgattttcttgttatgcgtgaccattcctaattgttctaaacccagatgggagaaatttttcatggtgacattcataaccgccaccctttggatcgctgtgttctcctatatcatggtctggcttgtcactattatcggctatacgctaggtatccctgatgtgatcatgggcatcacatttctggcagcagggaccagcgtgccggattgcatggcgagtctgattgtggctcggcagggattaggtgatatggcagtctctaataccattggctcaaacgtctttgatatcctggtgggccttggtgtgccttggggattacagacaatggtggttaattacggttcaacagtgaaaatcaactcgaggggccttgtgtattccgtggtcctcctcctgggctctgtggcgctgactgtcttgggcattcacctcaacaagtggagactggatcggaagctgggcgtctacgtgctcgtcctatacgccattttcctgtgtttctctatcatgattgagtttaacgtgttcactttcgtaaatctcccaatgtgtcgggaggatgattag

SEQ ID NO: 5210 - DNA, 1869 bp, Artificial Sequence
  Description of Artificial Sequence: Synthetic coding sequence
atggctctgcggggaactttacgacccctgaaggtgcgacgacgcagagagatgttgccccagcaggtcgggttcgtttgcgccgtcctggccctggtgtgctgcgcctccggcctgttcgggtctctaggacataagactgctagcgcctccaagagagtgctcccggatacctggaggaaccgcaaattaatggcccctgtgaatgggacgcagaccgccaaaaactgtactgaccccgcaattcacgaattccccactgacctgtttagcaataaggagcgtcagcacggggcagtgctactacacatcctgggtgccctctatatgttttacgcgctcgcaattgtctgtgacgacttcttcgtgccgagcttggagaagatctgtgaaagactccacctgagtgaagatgtcgctggcgcaacctttatggccgcaggcagcagtactcccgaactgttcgcaagcgtgattggcgtgtttattacacatggggatgtgggggtgggcacgattgttggctcagctgtgtttaacattctctgcataatcggggtgtgcggcctgttcgcgggtcaggtcgtacgcctgacctggtgggcagtctgtcgggacagtgtgtactatactatcagcgtgatagtgctcatcgtcttcatatacgacgagcaaattgtctggtgggagggactagtgctaatcatcctgtacgtgttctacatcttgataatgaaatacaatgtcaagatgcaggcattctttaccgtgaaacaaaaaagcattgccaatggaaaccctgtaaattctgagctggaggcgggtaatgacttctacgacggttcatatgacgatccgtccgtgcccttactaggccaagtgaaggaaaagccacagtatggaaagaaccctgtagtgatggtcgatgagattatgtcctccagtcccccaaagttcaccttcccggaagctggcctcaggattatgatcaccaacaaatttggaccacgtacccgtcttaggatggcttctcgcatcattataaatgagcggcaacgattaatcaattccgccaacggggtgagtagtaaacctctccagaacggcagacatgaaaatatcgaaaacggcaacgtcccagttgaaaatcctgaggatcctcaacagaaccaggaacaacaaccaccgccacagccccctcctcccgagccagagcccgtagaggccgattttttgagccccttttccgtacccgaggccagaggagacaaagtgaagtgggttttcacatggccactcatcttcctgctgtgtgtcaccatcccgaattgctctaaacctagatgggaaaagttctttatggttacctttattactgcgacattatggatcgccgtgttctcatacatcatggtgtggttagtcacaatcatcgggtataccctgggcatcccagacgtcatcatgggaataacttttctggcagcaggcacttccgtacccgactgcatggcgagtctgatagtggcacgccagggcttgggcgatatggctgtgagcaatacaattggctctaacgtcttcgacattcttgtggggctgggggtgccttggggtctgcagacaatggtggtgaactatggctcgactgttaagatcaattctcggggtcttgtgtactctgtggtcctgctcctcggctctgtggccctgaccgtgctgggaatccatttgaacaagtggagattagatcgcaagctgggcgtgtatgtcctggtcttgtacgccatatttttatgcttcagcattatgattgagttcaacgtgttcacattcgtgaacttacctatgtgtcgagaagacgattag

SEQ ID NO: 5211 - DNA, 1503 bp, Artificial Sequence
  Description of Artificial Sequence: Synthetic coding sequence
atgcagaccaaggggggtcagacatgggccagacgggctctgctgctcggaattctttgggccacagcccaccttccactatccggtacaagtttgcctcaaaggcttcctcgggctaccgggaattcaacccagtgtgtcattagtcctagctcagaatttcccgagggatttttcactaggcaggaacgcagggatggtggaataattatctacttcctgatcatcgtgtacatgtttatggccataagtatcgtgtgtgatgagtacttcctgccctctctggaaattatctccgaatcactggggctgtcccaggacgtggcaggtaccacatttatggccgctgggtcatccgcacccgagcttgttacagcatttcttggcgtgtttattacgaaaggagatattggcattagcacgatcctaggctcggccatctacaacctcttggggatttgcgcagcctgtggattgctttcgaataccgtgagcaccttgtcctgctggccactgttccgagactgcgccgcatataccatttctgctgccgctgtcctcggaatcatatacgacaaccaggtctactggtacgagggggctctgctattacttatctacggattatatgtccttgtcctctgttttgacattaaaatcaaccagtatatcatcaaaaaatgttccccatgttgtgcatgcctggcaaaagccatggaaaggtcagaacagcagcccctgatgggatgggaagacgagggacaaccatttatccgcagacaatcccgaacggactccggtattttctacgaggattctggctattcacagctgtccatcagcctccacgggctgtctcaagtatctgaggacccaccttctgtgttcaatatgccggaagccgatttgaagagaatcttctgggtactgagtttgcccattatcacactattgttcttgacaacacccgactgtagaaagaagttttggaagaactatttcgtcatcactttcttcatgtcggccatttggatatcagccttcacatacatcttagtctggatggtgacgatcaccggagaaacactcgaaatccccgacaccgtgatgggccttactctgcttgcagccggaacaagtatacccgataccatcgccagcgtactcgtcgccagaaagggtaagggggatatggcaatgtctaacattgtggggtccaacgtgtttgatatgttatgtctggggataccttggtttattaaaaccgccttcatcaacggaagcgcgcctgccgaggttaactctcggggtttgacttacataactatctctctgaacatcagcatcatttttctgtttttggctgtgcactttaacgggtggaagctggatcgtaagttaggcatcgtatgtctgctgtcttatctagggctggcaacactctctgtgctctatgagctgggaatcattggaaacaacaagattagaggttgtggcggatag

SEQ ID NO: 5212 - DNA, 1323 bp, Artificial Sequence
  Description of Artificial Sequence: Synthetic coding sequence
atgcaaacgaagggcggacagacttgggcaaggcgagcactgctgttggggatcctgtgggccacagcacacctgcccctctccggcactagcctgccacagcgtctgccgagagccactgcactcgggctctcacaggacgttgcaggtacaaccttcatggcagcaggtagctccgctcctgagctagtcacagctttcctgggcgtcttcatcaccaagggtgatattgggatcagcaccatactcgggagcgcaatctataacctgctagggatctgcgcggcatgcggactgctctctaatacggtgtccactttgtcttgctggcctctgttccgtgattgtgcagcctatactatttccgccgctgcggtgctggggatcatatatgataaccaggtatactggtatgaaggagcactgctcttgcttatttatggcctctatgtgttggttttatgtttcgatattaagattaaccaatacatcattaagaagtgctcgccgtgctgtgcctgtctagccaaggcgatggagcggtctgaacagcaaccgctgatggggtgggaggatgagggacagccctttatccgtcgccagagccgtaccgacagtggcattttttacgaagacagtggctactcccagctgtctatttcgttgcacgggctgtctcaggtctctgaggatccaccttccgtgtttaatatgcccgaggctgacctaaagcgcattttctgggttctttccctaccaattatcaccctgctgttccttaccaccccggattgtagaaaaaaattttggaaaaactacttcgtaataaccttcttcatgtccgccatctggattagtgccttcacatacatcttggtgtggatggtgaccatcactggtgagactttggagattcctgatactgtgatgggccttaccctgctagcagccggaacttctattcctgacacaatagcttcagtactcgtagctcgaaagggcaagggagacatggccatgtccaatattgttggctctaatgtgtttgatatgctatgtttgggaataccctggtttatcaaaacagcattcattaatgggtcagctcccgctgaggtgaatagcaggggactgacatatattactatatccctaaatatctcaattatttttctctttctagccgtccattttaacggttggaagctggaccggaaactagggattgtttgccttttgagttaccttggcctcgccacattatccgttctatatgagctcgggatcatcggaaacaacaagataagaggatgcggaggatag

SEQ ID NO: 5213 - DNA, 552 bp, Artificial Sequence
  Description of Artificial Sequence: Synthetic coding sequence
atgttatccagagcagtctgcgggacctcacgacaactggcaccagtgctaggttacctcggctcccgtcaaaaacactcattgcctgatctcccatacgactacggcgctctggaaccacacattaacgcccagatcatgcagttacatcactcaaagcatcatgccgcttacgtgaacaacctgaatgtgacagaagagaagtaccaggaagccttggccaagggagaattactggaggcaattaaaagggactttggttccttcgacaagttcaaagaaaagctgaccgccgcttccgttggggtccaaggcagcggctgggggtggcttggtttcaataaggagcgtgggcaccttcagattgccgcatgtccaaatcaggaccctttgcagggcaccacagggctgatccccctgctagggatcgacgtttgggagcatgcttactacttgcaatataagaatgtgcgtccggattatctcaaggcaatatggaatgtcattaactgggaaaatgttacagaacgctatatggcttgtaaaaaatag

SEQ ID NO: 5214 - DNA, 552 bp, Artificial Sequence
  Description of Artificial Sequence: Synthetic coding sequence
atgctcagcagggcggtctgcggtacctcccggcaacttgcacccgtcttgggctacctgggaagccgtcagaagcattcactgccagatctgccttatgattatggtgcactcgagcctcacatcaatgcacagataatgcaactgcatcattccaaacaccacgccgcttacgtgaacaatctgaacgtcacagaagaaaaataccaggaagccctggccaagggagagctcctcgaggccatcaagagagacttcggctcctttgataagttcaaggaaaagcttacagctgcgagtgtcggagtgcagggctccggttggggctggctgggatttaacaaggaacggggtcaccttcaaattgcagcctgccctaatcaagacccactccaggggacaacaggtctgatccccctgttggggatcgatgtgtgggagcacgcgtactacttgcagtataagaatgtcaggccggactatttgaaagccatttggaacgtgataaactgggaaaatgtgaccgagcgctacatggcttgtaaaaaatag

SEQ ID NO: 5215 - DNA, 669 bp, Artificial Sequence
  Description of Artificial Sequence: Synthetic coding sequence
atgctcagtagagcagtgtgcggaacatctcggcagctagcacctgttttaggataccttggcagccgccaaaagcactcactccccgacctgccatatgactatggcgctctcgagcctcacattaatgcacagattatgcaattgcaccatagcaagcaccacgctgcgtacgtcaacaacctcaacgtcacagaggaaaaatatcaggaggctctggcaaagggagacgttaccgcccaaatagcactgcagccagcactgaagttcaacggaggaggtcacatcaaccattccatcttctggaccaatctaagcccgaatgggggaggtgaaccaaagggcgaactgctcgaggctattaaaagagattttgggtctttcgataagtttaaggagaaactcacggctgcctctgtcggggttcaggggtcaggatggggatggctaggatttaacaaggagcggggacatctgcagatagccgcttgtccaaaccaggatcctttacagggtaccaccggactgatccctctgttaggcatagatgtctgggagcatgcctactacttacagtacaagaatgtgcgccctgactatctgaaagcgatctggaatgtgatcaattgggagaatgtgaccgagcggtatatggcctgcaaaaaatag

SEQ ID NO: 5216 - DNA, 669 bp, Artificial Sequence
  Description of Artificial Sequence: Synthetic coding sequence
atgctcagtcgcgctgtatgcggaacatccaggcaattggctcctgttcttggctatctcggtagtcgccagaaacattccttgcccgatctaccgtatgattacggcgcactggagccacatattaacgcacagatcatgcagttgcatcactccaagcaccacgctgcatacgtgaacaatctcaatgtcacagaggaaaagtatcaagaggccctcgccaagggggacgtgacagctcagatagcattgcagcccgcacttaagtttaacggcggaggccacattaaccactccatattctggacaaacttgagtccgaatggaggcggtgaaccgaagggggagcttctcgaggcgatcaagagggattttggcagcttcgataagttcaaagaaaaattgaccgcagcttctgtgggtgtacagggaagcggctggggctggctgggcttcaataaggaaaggggacacctgcaaatagccgcttgtcccaaccaggatcccctccagggaaccaccggcttgattcccctcttaggcatcgatgtgtgggagcacgcatactacctgcagtataagaacgtacggccagactatctgaaagccatctggaatgtcattaactgggagaatgtgaccgagcgatatatggcctgcaaaaagtag

SEQ ID NO: 5217 - DNA, 531 bp, Artificial Sequence
  Description of Artificial Sequence: Synthetic coding sequence
atgcagttacaccacagtaagcaccatgccgcatacgtgaataatcttaacgtcacggaagaaaaataccaagaggcgctagccaagggcgatgtcacagctcagattgcgctgcagccagccctcaagtttaacggcggtggccacatcaaccattctatattttggacaaatctatctccgaacggtggcggagaacctaagggcgagctgctggaagccattaagcgggactttgggtcgtttgacaagtttaaagagaagttaactgctgcatccgtgggggttcagggctccggttggggatggctcggcttcaataaagagagagggcacctacaaatcgcagcttgtccgaaccaggacccactgcaggggaccacagggttaatccctctgctcggcatcgacgtctgggagcatgcttattatttgcagtataaaaacgtgcgccctgattatctaaaggctatctggaacgttattaattgggagaacgtcacggagcggtacatggcttgtaagaaatag

SEQ ID NO: 5218 - DNA, 723 bp, Artificial Sequence
  Description of Artificial Sequence: Synthetic coding sequence
atgcttgcgctcttatgtagctgtctcttgctggcagcaggcgctagtgacgcatggaccggcgaagattcagcagagcctaacagcgattcagccgagtggatacgggatatgtacgctaaagtaaccgagatttggcaggaagtcatgcagcgacgggatgatgatggcgcactccatgctgcctgccaagttcagccatctgccaccctggacgcagcccagccacgtgtgacaggtgtggtgctgttcaggcagctggcgcctcgcgcaaagctggacgctttctttgctcttgagggattccctacggagcccaatagctcatccagggcaatacatgtccaccagtttggagacctgtcacagggatgtgaaagtacgggtcctcactacaaccccttggcggtcccacaccctcagcaccccggagatttcggtaatttcgccgtccgggatggctctctatggaggtatcgcgcaggtttggccgcatctctcgccggacctcatagcatcgtaggtagggccgttgtggtccacgctggtgaagacgacttaggacggggtggcaaccaagctagcgtggaaaatggcaacgccggaagacggctagcgtgttgcgtggtcggcgtatgtggcccaggcctatgggaacgtcaggccagagagcattccgagcgcaaaaagaggcggagggagagtgaatgcaaagccgcatag

SEQ ID NO: 5219 - DNA, 390 bp, Artificial Sequence
  Description of Artificial Sequence: Synthetic coding sequence
atgaaaatactagtcgccttggcagtcttcttcctggtgagcacacaactgtttgccgaggaaatcggcgcaaatgatgacttgaactactggtccgattggtatgacagcgaccagattaaggaggagctgccggagccttttgagcacctgctgcaaaggattgcaagacggccaaaaccccagcagttttttggcctcatgggcaagcgggatgctgattcaagtatcgaaaagcaagtagccttgctgaaggccctgtacggtcacggccaaattagtcacaaacggcacaagaccgactcttttgtgggcctgatgggcaaacgggcactgaacagcgtcgcatatgagcgcagcgcaatgcaaaactacgagagacggcgatag

SEQ ID NO: 5220 - DNA, 345 bp, Artificial Sequence
  Description of Artificial Sequence: Synthetic coding sequence
atgaagattttggtggccttggcggtgtttttccttgtgagtacccagctctttgccgaagaaatcggagcaaacgacgatttgaactactggagcgactggtacgatagcgatcagattaaggaagagctgcccgagccttttgaacacctgctccagaggattgcccgtcgtcccaaaccccaacagttttttggcctcatgggaaaacgcgatgcaggacacggccagatcagccacaagaggcacaagaccgacagcttcgttggcctcatgggcaagagagctttaaacagcgtggcatacgaaaggagcgcgatgcaaaactatgaaagaagaaggtag

SEQ ID NO: 5221 - DNA, 336 bp, Artificial Sequence
  Description of Artificial Sequence: Synthetic coding sequence
atgaaaatcctggtggccctcgctgtatttttcttggtgtccacgcaattatttgcagaggagattggcgctaacgacgatctgaactattggagtgattggtacgattccgatcaaatcaaggaggagttgccggaaccttttgagcacctgctccagcggatcgcgagaagaccgaagcctcagcagttctttggcctcatggggaaacgcgacgcagactcttccatcgagaagcaggtggcactactgaaagccctatacgggcatggccagatttcccataaaatggcatacgagaggtccgccatgcagaattacgaacggagaaggtag

SEQ ID NO: 5222 - DNA, 417 bp, Artificial Sequence
  Description of Artificial Sequence: Synthetic coding sequence
atgactgccctcttccttatgtccatgctcttcggcttgacatgtgggcaggccatgtccttttgtatccccacggagtacactatgcacatcgaacggagagagtgcgcctactgcctgactattaacaccaccatatgcgctggttactgcatgacaagggacatcaatggtaagttatttttacctaagtacgccctaagccaggacgtttgtacttatcgagattttatttacagaacggtggagattcctgggtgcccgctgcatgtggcaccatatttcagctaccccgtggctctgtcctgcaagtgcgggaagtgtaatacagactatagtgactgtatccacgaggccatcaagactaattattgcacaaagccccaaaagtcgtacttagttggtttttcagtctag

SEQ ID NO: 5223 - DNA, 417 bp, Artificial Sequence
  Description of Artificial Sequence: Synthetic coding sequence
atgaccgcattatttctgatgtcaatgctgtttggactcacatgtggccaggctatgagcttctgtatccccactgagtacacaatgcatatagaaaggcgggaatgcgcatactgcctcacaatcaacactaccatctgcgcaggttactgcatgaccagggacattaatggtaagctgttcttgcctaagtatgccttgtcacaggatgtgtgtacttatagggacttcatatacagaacagtggagatcccaggctgtcccctgcatgtggccccatatttttcttaccctgtggcattgagctgtaagtgtgggaagtgtaacactgattattcagactgcatacatgaggctataaagacaaactattgtacgaagccacagaagtcatacctggttgggtttagtgtgtag

SEQ ID NO: 5224 - DNA, 2418 bp, Artificial Sequence
  Description of Artificial Sequence: Synthetic coding sequence
atggcccagccattggcgtttattcttgacgttcctgaaacacccggagatcagggccagggcccaagcccctatgatgagtccgaagtccatgattcctttcaacagttgatccaggagcagtcccagtgtactgcccaggaaggactggagctccagcagcgtgagcgggaggtgaccggcagcagccagcagacattgtggaggcctgagggtactcagtctacagcgactcttagaatccttgcgagtatgcccagcagaaccattggaaggtcccgcggagctatcatatcacaatactacaacaggaccgtgcagctcaggtgccgtagctcacgtccgctattggggaatttcgtccgttcagcctggcctagcttgcggctgtacgatttggagctggaccccactgccctggaggaggaagaaaagcagtccctgctcgttaaggagctccaaagtttagctgtggctcagcgcgaccacatgctcagagggatgccactttccctcgctgaaaagagaagcttgcgagagaagtcaagaactcctcggggtaagtggaggggtcagcccggttcgggtggcgtgtgtagttgttgcggccgactccgctatgcctgcgtcctggcattacatagtctgggtctcgctttactgtctgccctgcaggctttgatgccctggcggtatgccttaaagcgcatcggcggtcagtttgggtcatccgtcctctcctatttcttattcctaaagacactgctggccttcaatgctctcctgcttcttctgctggtagcattcatcatggggccacaggtcgctttccctccggctttgccgggtccagctcctgtttgtaccggccttgaactactcaccggggcaggttgctttactcatactgttatgtattacggacattattctaacgctactcttaatcagccatgtggcagcccgttagatggatctcagtgcacgcccagagtaggcggacttccttataacatgcctctggcttatcttagcaccgttggcgtatcctttttcattacctgcatcactctggtatactctatggcccacagttttggcgaatcttatcgcgttgggagcaccagcggaatacatgccataaccgtgttctgcagctgggactacaaggtgacacagaagagagcctctaggctgcaacaggacaacatccggacccggctgaaagagctcctggccgagtggcaactccgtcactctccccgatcggtctgtggtaggctaaggcaggcggctgtgctgggtttggtgtggttactttgtctgggcaccgcactgggctgtgccgtggctgtgcatgtgtttagtgagttcatgatccagtctccagaagctgccggacaagaggccgtgctattggtgcttccattagtggtgggtctattaaatcttggtgctccctacctgtgccgggtgcttgcagctctcgaaccccacgattcaccagtcctcgaagtgtatgtggccatttgcagaaatctcattctgaagttggccattctaggtacgctgtgttaccactggctgggcagaagagtgggcgttcttcagggccagtgttgggaagattttgtgggacaggagctgtaccgatttctggtaatggattttgtgctaatgctgctggacacgctgtttggagagctggtctggagaattattagcgagaaaaaactaaagcgaagacgcaaaccagagtttgatatcgctcgcaacgttctggagttgatttacgggcagacattaacttggcttggggtactctttagccccctcctgcccgctgttcagatcataaagctgctgttggttttttacgtcaagaaaacctccttgctggcaaactgccaggcacctcgcagaccttggctggcaagtcatatgagtacggtttttctgaccctcctgtgctttcctgcttttctcggcgctgccgtgttcctttgctatgccgtttggcaagtgaagccttccagtacctgcggcccattccgaaccctggacaccatgtacgaagcgggtcgagtgtgggtcagacatttggaagctgccggtcctcgcgtgagctggctaccctgggttcatcgttacttgatggagaacacctttttcgtgttcctggtatcagctctcctgctcgccgtgatatatctcaacatccaagtggttcggggacagagaaaagttatctgtctcctgaaagaacaaatcagtaatgaaggcgaggacaagatttttctcataaacaaacttcacagcatctatgagaggaaggagagggaagagcgctccagggtaggcactaccgaggaagccgctgcaccacctgccctattaactgacgagcaagacgcttag

SEQ ID NO: 5225 - DNA, 864 bp, Artificial Sequence
  Description of Artificial Sequence: Synthetic coding sequence
atgcttcttcctaggagtgtctcgtctgaaagagcacccggagtgcccgagccagaggagctgtgggaagcagaaatggaacggctgagaggctctgggacgcccgtgcggggacttccgtatgctatgatggataagagactgatttggcagctgagagagccagccggtgtccagacgttacgatggcagcggtggcagcgtcggagacaaaccgttgagagaagactgcgcgaagctgcccagagactggctcggggactcggtttatgggaaggcgcactgtatgagatcgggggactctttggcactggtattcgctcttacttcaccttcctccgatttcttctgctcttgaatctgctctcacttctgcttacagccagttttgtgctgctgccattagtttggctcaggccaccagacccaggacccacattgaatttgaccttgcaatgccccggttcacggcaaagccctcccggagttctgcggttccacaaccagttatggcacgtgctcaccggacgagccttcacaaatacttatttattttatggtgcctatagggttggcccagagtcttcaagtgtctactctatccggttagcttacctgttgtccccattggcttgccttctgctgtgcttctgcggcacacttcggagacttctaagcactttggcttcaggacccggtgccggtggaccctgggccccagctcactggccagcctgccctcctctgcccggactacctcgcctgcaactcccacctccacaccatgctcaggtgctgagggctgcgggtgccatgggaggggatacatggcggggtcgttcctttttaccctggggttggtag

SEQ ID NO: 5226 - DNA, 2181 bp, Artificial Sequence
  Description of Artificial Sequence: Synthetic coding sequence
atgttgctgccgaggtcagtgtcttctgagcgcgcacccggtgtgccagagcccgaggagttgtgggaagctgagatggaaaggctgagggggagtggtactccagtgcggggactgccatacgctatgatggataagcgattgatttggcagctgagggaacccgcaggcgtgcagaccctacggtggcagcgctggcagcggagacgccagaccgtggagcgacggctccgggaggctgcacagagactggcgcgaggactgggtctgtgggaaggagctctatacgaaatcggaggcctgttcgggacaggtatcaggagctatttcacttttctgagattccttctcctcctaaacttactctcactcttgctcaccgcctcttttgtactgctccccttagtatggctgagacctcctgacccaggacccacactcaatctgaccctgcagtgtcccggatccaggcaatcgccccctggtgttctacggtttcacaaccagttgtggcacgtgctgacaggacgggcttttacgaacacctatctgttttatggagcctacagagttggaccggagagtagctccgtctatagtattaggctggcctacctgctgtctccgctcgcatgcctgctcctgtgtttctgcgggacccttcgcagaatggtaaaaggtctgccccaaaaaaccctgcttggtcaggggtaccaggcccctctttctgctaaggtcttttcatcgtgggatttttgtatcagagtgcaagaagctgctactattaagaagcatgaaatatcaaacgagtttaaggtggagctcgaggagggacgacggttccaacttatgcagcagcagacccgggctcagactgcttgtagactgctcagctacctgagggttaatgttcttaacggcttgctagtcgtcggagctatttccgctattttttgggccactaagtacagccaggacaataaggaagagtccctattcctcttgctgcagtatctgcccccaggtgtgatagcgctggtgaacttcctgggcccactactgtttaccttcctggtgcagctggagaactatccccctaatactgaggtgaatctgacactgatttggtgcgtggtgctgaaacttgcctcattggggatgttctcagtgtcgctggggcagacaatcttatgtatcgggcgtgataagtcgagctgcgagtcttatgggtataatgtgtgtgactaccaatgctgggagaactccgtgggcgaggaactctacaagctgtctatttttaactttctccttacagtcgcattcgcattcctagtaactttgccacggagactgctggtggaccgtttcagtggtaggttttgggcttggctggaacgagaggagtttctggttcctaagaacgtgctggatatcgttgcaggccaaacagttacatggatgggcttgttctactgtccactgttaccacttttgaatagcgtgttcctattcctgaccttttacataaaaaagtataccctcctcaagaactcgagagcgagtagtcgcccatttcgcgcttctagcagtaccttctttttccagctcgtgctgctgcttggtctgttacttgccgctgtgccgctaggatatgtcgtttctagcatccatagcagttgggattgcgggttattcacaaactactcagccccatggcaagtggtgcccgaactggttgcactcggcctgccccctatcgggcaaagggcgctacattatctcggatctcatgccttttcctttccccttttaatcatgctgtcacttgtcctcacagtgtgcgtgtcacagactcaggcgaatgccagagctattcacagactccgcaaacaactggtgtggcaggtgcaagagaagtggcacctggttgaagacctatcacgactgttgcctgaacctggcccaagtgattctcccggacccaagtatccagcttcacaggccagcaggccccagtcgttttgtcctggatgcccatgcccgggaagtcccggtcatcaagcgcctcgtcctggcccttctgtggtggacgccgctggtttgcgcagtccctgtccaggccaacacggcgctcctgcttccgctcggcgtttccgatttccaagcggcgctgagctgtag

SEQ ID NO: 5227 - DNA, 702 bp, Artificial Sequence
  Description of Artificial Sequence: Synthetic coding sequence
atgagcacagagagcatgatcagagatgtggaacttgcggaagaagcactgccaaagaaaactggtggccctcagggctctcgcagatgtctattcctatctctgttcagcttcttgatcgttgctggagctaccactctcttctgtctgctccacttcggggttattggaccccagcgggaggagttcccaagagacctgagcttaatcagccccctcgcacaggcggtgcgctccagctcccgcacgccttctgacaaacccgtcgctcatgtggttgccaacccacaggctgagggacaactgcagtggctcaacaggcgggctaatgccctgttggccaatggagtcgagctcagggacaaccagttggtcgtccctagtgaggggctctatctcatctacagccaagtcctgttcaagggtcagggctgcccatcgactcacgtgctcctgacacatacgattagcagaattgccgtctcctaccagaccaaagtcaatctgcttagcgcaatcaagagcccttgccagagagagacgccagagggtgcggaggctaagccctggtacgaacctatttatctgggtggggtcttccagctcgagaagggcgatcggctgtcagctgaaatcaaccggcctgactatctcgatttcgctgaatccgggcaggtctactttgggatcatcgcactgtag

SEQ ID NO: 5228 - DNA, 702 bp, Artificial Sequence
  Description of Artificial Sequence: Synthetic coding sequence
atgtcaacagaatctatgataagagatgtggaactcgcggaggaggctctgccaaagaagaccggcggtcctcaaggatcccgtcggtgtctgttcctctctctgttttctttcttaatcgtcgcaggggcaactacactcttctgcctcctgcactttggggtcataggtccccaaagggaagagtttccaagggacctctccttgatttctcccctcgcacaagctgttcggtccagctctagaaccccaagtgataagccggtggcgcacgtcgtagccaatccgcaagccgaagggcagctgcagtggctgaacagaagggccaatgcgcttctggctaatggagtggaactcagggacaaccagttagtcgtaccgtccgaaggcctgtatttgatttacagccaagtgttattcaaaggacagggttgcccatcaacccacgtcctcctgacccacaccatttcccgtatcgccgtgtcgtaccagactaaggttaatcttctgagcgcaattaaaagcccatgtcagagagagacccctgaaggcgctgaagcaaaaccctggtacgaaccgatttaccttggtggggtgttccagctggaaaaaggcgaccgtctttccgccgagattaaccggcctgactacctcgattttgccgagagcggtcaagtgtattttggaatcatagccctttag

SEQ ID NO: 5229 - DNA, 702 bp, Artificial Sequence
  Description of Artificial Sequence: Synthetic coding sequence
atgtcgacagagtctatgattagagacgtggaactggctgaagaagcccttccgaagaaaacagggggtccccaggggtctaggaggtgtctctttctctctttattcagttttctgattgtcgctggagcaactactctcttctgtctgttgcactttggcgttatcggcccacagagggaggagtttcccagggatctgtctctgatatctccgctagcccaagcagtccgttcatcttccagaaccccaagtgacaaaccggtcgcccacgtagtcgctaatcctcaagcagaaggacagctccagtggctaaatcgcagagcgaatgccctgcttgctaatggagtggaactgcgggataaccaactagttgtacccagtgaggggctatatctcatatactcacaggtgttgttcaagggtcaggggtgcccctccacccacgtccttctgacgcatacaatctcaagaatagcagtatcataccaaacgaaggtgaacctgctgagtgccattaagagtccgtgccaacgggaaactccggagggagctgaggcaaaaccatggtatgagcctatatacttagggggagtgtttcagcttgaaaagggggatcgactgtcggccgagatcaatcgcccagactacctggattttgccgagagtggccaagtctattttggcataatcgctctatag

SEQ ID NO: 5230 - DNA, 702 bp, Artificial Sequence
  Description of Artificial Sequence: Synthetic coding sequence
atgtcaaccgaaagcatgatccgggacgttgaattggctgaggaggccttgcccaaaaagactggcggaccacagggatccagacgttgtttattcttgagcttattcagctttcttattgtggccggtgctacaacactcttctgcctccttcacttcggggtgatcggcccacagcgagaagaattcccccgagacctgtccctaattagccccctggcccaggccgttaggagctcgtctagaacccctagtgacaagccagttgcccacgtggtggccaaccctcaggcagaaggacagctgcaatggcttaatagaagagccaacgcattgcttgcaaacggcgtggaacttcgggataaccagttggtcgtgccctccgaagggctgtatctaatctactcccaggtgctctttaaagggcagggctgcccctccacccatgtcctattgacccacaccatctctcgtatagcggtgtcctatcagaccaaggtcaatttgctctctgcaatcaagtcaccatgtcaaagagagaccccagagggcgcagaggccaagccatggtatgaacccatctatttgggaggcgtcttccagctggagaaaggagaccggctcagcgccgagattaataggcccgactatctggacttcgctgagtccggtcaggtgtattttggcatcattgcattatag

SEQ ID NO: 5231 - DNA, 702 bp, Artificial Sequence
  Description of Artificial Sequence: Synthetic coding sequence
atgagtactgagtccatgattcgcgatgtagaactggccgaggaagccttgcctaagaaaacgggcggaccccaggggagtagaagatgcctgttcctgtcattattctcctttcttattgtggctggcgctacaaccttgttttgtctgctacattttggcgtgattggccctcagagagaggaatttcccagagacttatcactcatcagtccgctggctcaggcagtccgctctagctcaaggacacccagcgacaagcctgtggctcacgttgtggccaatcctcaagccgaaggacagctgcagtggttgaaccgtcgtgcgaatgccttgctcgccaatggtgtggaactccgagacaaccaacttgtggtgccatcagaaggcttatatcttatctactcgcaggtgctctttaagggccaaggatgtcccagtactcatgtgctcttaactcataccatctcaagaatcgccgtaagctaccagaccaaggtaaatttactgagtgctatcaaatcaccctgtcagcgggaaacccccgaaggagctgaggctaaaccgtggtatgagccaatctacctaggtggtgtttttcaactggagaaaggtgacagactcagcgcggaaatcaacaggcctgactatctcgatttcgccgagtctgggcaggtgtattttggaataatcgcactgtag

SEQ ID NO: 5232 - DNA, 702 bp, Artificial Sequence
  Description of Artificial Sequence: Synthetic coding sequence
atgtccactgagtctatgataagggacgtggagctcgctgaagaggcactacccaagaaaaccggtgggccacaggggagtcgcaggtgtttatttctatccctgttctcttttcttatcgtcgctggggctaccaccctattttgcttgctgcacttcggggtgatcggcccacagcgcgaagaattcccaagagacctttccttgatctctccacttgcacaggccgtgaggtcttcttccaggaccccctctgacaagcccgtggctcatgtggttgccaatccacaagctgaaggccagcttcagtggctgaaccgccgagcaaacgccctgctcgctaacggggtggaactgagagataaccaacttgtcgtgcccagtgaaggcctgtacctgatctactcccaggtcctgtttaagggtcaaggctgcccatccacccacgtgctgttgacccacaccatctctagaattgctgttagctatcagacaaaagttaatttgcttagtgccatcaaaagtccctgccaacgcgagacccccgagggagccgaggcgaaaccgtggtatgaacctatttaccttgggggtgtctttcagctcgaaaagggagataggctctctgccgagatcaaccggccagattatcttgattttgccgagtctgggcaggtctacttcggtatcattgcgctttag

SEQ ID NO: 5233 - DNA, 702 bp, Artificial Sequence
  Description of Artificial Sequence: Synthetic coding sequence
atgagcaccgagtccatgattcgagatgtggaattggcggaggaggccctgcctaagaagaccggcggtccccaggggtcccggaggtgtctcttcctctccctcttctccttcctaattgttgccggtgcaacaacactgttttgtttgctgcactttggagtgatcggccctcagagagaagagtttcctcgggatctgtcccttatatctccattggcccaggctgtgcggagttcttctaggacaccgtccgacaaacccgttgcacatgtagtggctaacccacaggccgagggacaactgcagtggcttaaccgccgtgctaatgcccttcttgcaaatggcgtcgagctgcgggacaaccagctggtcgtgccatcggaaggtctctatctcatttactcccaggtgttgtttaagggtcagggatgcccgtccactcatgtgctgctaacccataccatatctcgaatagcagtgtcatatcagaccaaagtcaatttgctgtccgcgattaagagcccctgccagcgggaaacgcccgagggggcagaagccaagccttggtacgagccgatttatctcgggggagtgttccagttggagaaaggcgacagactcagcgcagagatcaatagacccgattatctagacttcgccgagtctggccaggtgtattttgggattattgccctgtag

SEQ ID NO: 5234 - DNA, 741 bp, Artificial Sequence
  Description of Artificial Sequence: Synthetic coding sequence
atggcgcaggtccctcctccagcgagcggtgagcggcacgcaggtacggaagacggacctatacgcaggaacccagctggcaacgtagctagacccatggtgcagagactgccagagccccaggacgtagcccagtgcctcgaggtggggttgttcgacacccccccattttacagtaatagcaccaactcctttcgtaataccgtggagggaaatgatccaacaggaaagtacgatcccgcagtgcggagtcttcacaacctagcacacctgttcctgaatggcaccggcggacagacccacctgagtccaaacgatcctatctttgtgctgttacatacattcacggacgcagtattcgatgagtggctgcggaggtacaatgcggatatcagtaccttccctctagaaaatgcccctattggccacaatcgtcagtacaacatggtccccttctggcctcctgttactaatacagaaatgttcgtgactgctcccgacaatctcggctacacctacgagatccagtggccatcccgcgaattctctgtgccagagataatagccattgcagttgttggggctcttctccttgtagccctgattttcggcaccgcctcctatctgatccgtgctcggagatccatggatgaggctaaccaaccacttcttactgaccaataccagtgctacgctgaggaatacgagaagttgcagaaccccaaccaatcagtcgtttag

SEQ ID NO: 5235 - DNA, 1614 bp, Artificial Sequence
  Description of Artificial Sequence: Synthetic coding sequence
atgagcgctcccaagttgctgagccttggctgcatcttttttccactgctcctgttccaacaagctcgcgcacagttccctcgacaatgtgccacagtagaggccctgaggagcggaatgtgctgccccgacttgtcacctgtttctgggccaggaacagacaggtgtggctcctccagcgggaggggccgttgtgaagccgtcaccgctgactcacgtccccattccccgcagtacccccacgatggcagagacgacagagaagtgtggcccctccgattttttaacagaacttgccactgcaatggcaatttttcggggcacaactgcggcacgtgcagacccggatggagaggcgctgcatgtgaccagcgcgtgctcatcgttcggcgtaacctgttagacctctccaaagaagagaagaaccactttgtccgagcccttgatatggccaaaagaaccacccatccactctttgtcattgctactaggcggagtgaagaaattctagggccagatggaaacacgccccagtttgagaacatctctatttataattacttcgtctggacccactactacagtgtgaagaagactttcctaggggttgggcaggaatcattcggggaagtggatttctcccatgagggacctgcttttctcacgtggcaccgctatcacctgttgaggctcgagaaagatatgcaagagatgctccaggagcccagtttcagcctgccctattggaacttcgccaccggtaagaacgtttgcgatatatgtacagacgacctgatggggtccagaagcaattttgattccacactgatctcccctaacagcgtgttctcccagtggcgagtcgtgtgtgattcacttgaggactatgacacactcggcacattatgtaattctaccgaagacggcccaatcagaaggaaccccgctggaaatgtggcgcgaccaatggtgcagcgtctccccgagccccaggatgtggctcaatgcctcgaagtgggattgtttgacacaccacctttctatagcaacagtacaaatagcttcaggaatacagtggaggggtacagcgatccaaccggtaagtatgatcccgctgtgcgtagcctccataacttggcccatctattcttaaacggaactggcggacagacccacctctcccctaatgacccgatatttgtgttactgcacacatttaccgacgccgtgtttgatgagtggcttcgacgctacaacgccgacattagcacttttccactggagaacgctccaattgggcacaatcggcaatataacatggttcccttctggcctcctgtgaccaacacagaaatgtttgtcaccgcgccagacaatctgggttatacctatgaaatacagtggccctcaagagagttcagcgtgcctgagattatagccattgccgtggttggggctctcttattggtggccctaattttcggaaccgcatcctacctcattcgagccagacgtagcatggacgaggccaatcagccattacttacggaccagtaccagtgttatgccgaagagtacgagaaacttcagaatcccaaccagagtgtggtgtag

SEQ ID NO: 5236 - DNA, 309 bp, Artificial Sequence
  Description of Artificial Sequence: Synthetic coding sequence
atgtcggcacccaaactgctctctctcggctgtatattcttcccattgttactcttccagcaggccagggcccagttcccacgccagtgcgctaccgtagaggccttgagatctggcatgtgctgccccgatctttcccccgtgagtggacccggaactgacagatgcggaagctcttctgggaggggtcgctgcgaggcagtcactgcggattctaggccacactccccgcagtatccccacgacgggcgagatgacagagaggtatggccgctccgattctttaatagaacatgccactgcaactag

SEQ ID NO: 5237 - RNA, 1281 nt, Artificial Sequence
  Description of Artificial Sequence: Synthetic coding sequence
auguccggcggaguguauggaggcgaugaaguuggcgcccuggucuuugauauuggcuccuucucgguucgggcaggauacgccggugaagauugccccaaggccgauuucccaaccaccgugggucuacuagccgcugaagaagggggcggacuggaacucgaaggagacaaagaaaaaaaagggaaaaucuuucauaucgauacaaaugcauugcacgugccaagagacggcgccgaagugaugagcccacuuaaaaauggcaugauagaggacugggaaugcuuccgggcuauccucgaucacacuuacucuaaacacgugaaguccgagccaaacuuacauccuguguuaaugucagaggcgccguggaacaccagagcaaaacgugaaaaacugacugaguugauguucgaacaguacaacauacccgcguuuuucuugugcaagacggcagugcugaccgccuucgcaaauggacgcucaaccggcuuggugcuugauuccggcgcaacccacacaaccgccauccccguccaugacgguuacguguugcagcaggguauugucaagaguccucuggcaggggacuucaucagcaugcagugccgagagcucuuccaggaaauggcuauagacaucaucccuccuuacaugauugcagcuaaggaaccugugcgugaaggcgccccgccgaacuggaaaaagaaggaaaagcugccccaggugagcaagagcuggcacaauuacauguguaacgaggugauucaagauuuccaggccucaguauuacaggugagcgacucacccuacgacgaacaagucgccgcccaaaugccaaccgugcacuaugaaaugccaaacgguuauaacacagauuacggggcagaaagacuacgaauuccugaaggucucuuugacccaucaaauguuaaaggauugagugggaauacaauguugggagugggucacgucgucacuacuucaaucggcaugugugauaucgacauuagacccggacuguaugggucagugaucguaaccgggggcaauacacuucuccaaggguuuacugaccguuuaaauagggaacuaucucagaagacuccgccaucaaugagguuaaagcucaucgccucuaauucuacaauggaaagaaaguucagccccuggaucggcggcaguauauuggccucucuggguacuuuccagcagauguggauuagcaaacaggaguacgaggaaggcggcaaacagugugucgaaagaaaauguccauag

SEQ ID NO: 5238 - RNA, 3939 nt, Artificial Sequence
  Description of Artificial Sequence: Synthetic coding sequence
auggguccucgucuuucuguguggcuccuucuccuccccgccgcccugcuucuacaugaggaacacucgcgggccgccgccaaaggggggugcgcuggcuccggauguggcaaaugugacugccacggggucaaaggacaaaaaggggaacgcgggcuuccgggucuccagggagucauuggcuuucccggcaugcagggccccgagggaccacagggucccccaggacaaaaaggcgacacgggggaacccgggcucccaggaaccaaaggcaccaggggcccacccggcgcuucuggguacccuggaaacccgggacucccgggcauuccuggucaggacgguccacccggaccucccggaauuccuggcugcaauggcacgaagggggaaagagggccccuaggacccccaggacuccccggauuugccggaaaccccggcgauccuggagaaauucuuggccauguacccggaaugcuacucaagggcgagagagguuuccccggaaucccaggaacaccaggaccaccaggucugccugggcuccagggucccgucgggccacccggcuucaccggcccucccguauccuuugguggaugccuguccgaauucggccacgggggaaucuccuucccauugaccaagcgccgacagggggaccagggcguaucagggccaccuggaguucccggccaagcacagguucaagagaagggggacuucgcaacaaaaggcgaaaaaggacagaagggggagccuggcuuucagggcaugccagguguuggggaaaagggcgaaccaggcaagccuggaccuaggggaaagcccgggaaagacggcgacaagggugagaagggaucaccaggauuuccaggcgaaccuggguacccugguuugaucggccggcaagggccacaagugaacgcugguacaaucgcauacccucucccaccauguccagugaucgggacgggcccccucggcgagaaaggggagcgaggguauccgggaacuccagguccccguggcgagccaggcccuaaggggucauuccuggcuuuuuuccccccuccacccacaccccccccauuugcuggccucccugucccagggcaggcaggggcccccggcuuccccggugagcggggcgagaaaggagauaggggcuuccccgggacaucacugcccggccccagcgggagagauggccuuccagguccuccgggaucacccgggccucccggacaaccuggcuacacgaacgggaucguugagugccaaccaggcccaccaggugaucagggcccaccugguauucccggucagccaggguuuaucggagaaauuggcgagaaaggacagaagggcgaaaguugcuugaucugugauauugauggguaucgagguccccccgguccacagggacccccuggcgagauuggcuuuccgggucagccaggggcaaagggacuuccugggauaaccgggcagucuggccugcccggucuaccagggcagcagggcgcaccaggcauuccugguuucccggggagcaagggugagaugggcguuaugggaacaccugggcagccuggaucucccggccccgucggagcucccggccugccaggagagaaaggcgaccauggcuuccccgggucuucuggcccucguggugaccccggcuuaaaaggcgacaaaggcgacguaggccugccgggcaaaccuggaucuauggacaaaguggauauggggagcaugaaaggccagaagggggaccagggugagaaagggcagaucggacccauuggugaaaaagguagucggggcgacccgggaacgcccgguguuccagggaaggacgggcaggccggacagcccgggcagccagguccuaagggugaccccgggauuagcggcacacccggugccccgggucugcccggaccgaagggaagugucgguggcaugggucuuccaggcaccccuggagagaaaggagucccugggauuccuggaccgcagggaucgccaggccugcccggagacaagggcgccaaaggugagaagggccaggccgggccaccagggaucggcauuccaggauugcgaggagagaagggggaucaaggcauagcuggguuuccaggcucaccuggugagaaaggcgagaaaggaucaauugguauuccagggaugccaggaaguccaggucugaaggguucuccuggcagcguggguuacccaggaucgccgggacugcccggggagaaaggcgacaaaggacuuccaggauuggacgguaucccaggagucaagggugaggccggccuuccgggcacuccugggccgacagggccugcuggccaaaagggcgaaccaggaagcgacggcaucccggguagcgcuggcgaaaagggcgaacccggacucccugggcgaggcuuucccggauuccccggcgccaaaggagacaaagggagcaagggagaggucggcuuucccggacuggcgggcucuccuggcaucccagguaguaagggagaacagggcuuuaugggcccccccggaccccagggacagccgggucuuccaggaucaccaggccaugcgaccgaaggaccaaagggcgaucgaggaccucaaggucaaccugggcuuccaggccugccuggccccauggguccaccuggguugccgggcaucgauggggucaagggggauaaagguaauccuggauggcccggugcaccgggggucccuggaccaaagggggacccuggcuuccagggcaugccagguauagguggcuccccugggaucacgggaaguaaaggggauaugggcccuccaggcgucccuggcuuccaaggcccgaaaggcuugccugggcuucagggaauuaagggggaccagggggaccagggcguaccuggggccaagggcuugcccggacccccaggaccaccuggcccauacgauauaaucaagggggagcccggacucccgggacccgagggcccucccgggcugaaggguuuacagggccucccuggcccuaaaggacaacaaggggucacugggcuugucgguaucccuggcccgcccggaauucccggguucgacggggcacccggacagaaaggugagauggggccagccgguccuacagggcccagggguuucccagguccacccggcccagauggacugccgggguccauggguccgccuggaacaccaucaguggaccacggcuuccucguuacccgucacagccagaccauagacgacccccaguguccgucaggaaccaagauccucuaccauggauacucccuacuguauguacagggcaacgaacgagcacacggccaggaccucgggacagccgggucuugucuuagaaaauuuucuaccaugcccuuucucuuuugcaacauuaauaacguuuguaauuucgcaucccgcaaugauuacaguuacuggcugucuaccccugaaccaaugccgaugucuauggccccuaucacgggcgagaauauaaggccauucaucucccggugugcaguaugcgaagcucccgccaugguuauggcuguacacucccaaacuauccagaucccccccuguccaucuggcuggaguucucucuggaucggguacucuuucgugaugcacaccagugccggcgcagaaggcagcggacaggcucuggccucaccaggcaguugccuggaggaguucagauccgcccccuucauugaaugccaugggcgcgggacguguaacuacuaugccaacgccuauaguuucuggcucgcaacaaucgagaggagugaaauguuuaaaaaaccuacccccagcacacugaaggcgggcgagcugaggacccauguguccaggugucaggucuguaugcgaaggacuuag

SEQ ID NO: 5239 - RNA, 5010 nt, Artificial Sequence
  Description of Artificial Sequence: Synthetic coding sequence
augggcccaaggcucucgguguggcuuuuacuacugccugccgcauuacuguugcacgaagaacacucucgcgcugcggccaagggugggugugcuggcucgggaugcgguaaaugcgauugccacggugugaaagggcagaagggagagaggggacugcccggacuccaagguguaaucggauuuccaggcaugcagggaccagaaggcccccagggacccccaggacaaaaaggagacacgggagaaccagggcuucccggcaccaaggggacacgggggccacccggagcaagcggcuaccccgguaaccccgggcucccugggauaccggggcaggauggaccaccaggcccccccggcauuccuggcugcaaugguacaaagggcgaacgggggccuuuaggcccuccuggccugcccggguucgcgggaaaccccggaccucccggcuugcccggaaugaaaggugauccgggcgagauccucgggcacgugccaggcaugcuccugaaaggcgagaggggauucccaggaauucccggaaccccagguccgccaggucugccuggucugcaggguccagucggaccucccggcuucacaggaccgccagggcccccuggcccaccuggccccccuggugagaaaggacaaaugggccuuagcuuccaaggcccaaagggugacaagggcgaucagggcgugaguggcccacccggggugccgggccaggcacagguccaagaaaaaggugauuucgcaacuaaaggagagaaagggcagaagggggagccaggguuccaaggcaugcccgguguuggcgagaagggcgagcccggcaagccuggaccacgggggaaaccugggaaggacggcgacaagggugaaaagggcagcccaggauuccccggggagcccggauauccuggguugaucggaagacagggaccgcaaggagagaaaggggaagccggaccaccgggaccaccuggaaucgucauaggaaccgggccccugggggaaaagggagagagaggauacccugggacaccagggccuagaggcgaaccagggccuaaaggguuucccggacuccccggucagccuggccccccuggacuaccuguuccugggcaggccggugccccaggcuuuccaggugaaagaggagagaaaggggacaggggcuuucccgggacgaguuuacccggcccaucugggcgagaugggcucccuggaccucccggcagcccgggcccaccaggccagcccggcuacacaaauggcaucguugaaugucagcccgggccuccaggugaucagggcccuccgggcauccccggacagcccgguuuuaucggcgagauaggugaaaaaggccagaaaggugaauccugucucauaugcgacauugacggauauaggggcccccccggcccucaaggacccccaggugagauaggcuuucccggucagccaggugcuaagggugauaggggacuucccggacgcgacggaguugccggugugccuggcccucaagggacccccgguuugaucggccagccuggggcuaagggcgaaccgggggaauucuacuucgauuugaggcuuaagggugacaaaggugacccagguuuuccagggcagccaggcaugacgggcagagccgguucgcccggccgggacggccaucccgggcugccaggcccaaaaggaucuccaggguccgucgguuuaaaaggcgaacgaggaccaccagguggugucggauucccaggcagucggggagauacggguccgcccgggcccccgggcuacgguccagcuggucccaucggcgacaaaggacaggcaggauucccuggggggcccggcucuccuggccuuccaggcccaaagggggaacccgggaagauagucccccugccuggcccccccggagcagaaggucugcccgggucgcccgguuuuccugguccacagggugaccgcggcuuccccggcacacccgggcgaccaggccugccaggagagaagggcgccguggggcagccggguaucgguuuucccggcccacccgguccaaagggaguggacggacugccuggagauauggggccgcccggaaccccaggaagaccaggauucaacggacuccccgggaaccccgggguacagggucagaagggcgagcccggagucggccugccuggccugaaaggucugccgggguugccuggcaucccugggacacccggcgaaaaaggguccauuggagugccuggcguccccggagaacacggcgccaucggccccccuggcuuacagggcauccggggcgaacccggaccccccggguugccggguucagucggcucuccuggcgucccuggcauugggcccccuggcgcucgcggaccuccaggcgggcagggcccaccgggacugucaggcccaccaggcauuaaaggcgaaaagggguucccugguuucccuggccuagacaugcccggaccaaagggggacaaaggcgcacagggucugcccgggaucaccggccagucugggcugccaggauuacccggccagcaaggcgccccuggcauccccggauuccccgguucaaaaggagagaugggagugaugggaacgccuggccaaccaggcucgccaggcccagugggggccccgggacugccaggcgagaaaggagaucacggcuucccugguagcaguggcccucgcggggaccccggucuaaaaggggacaagggugaugucggcuuaccgggaaaaccaggaaguauggacaagguugacauggggagcaugaagggucaaaaaggcgaucagggagaaaaaggccagauaggcccuaucggagagaagggcucuagaggcgaccccggcacaccaggcgugcccggcaaggauggccaggcuggccagccuggccagccuggaccaaagggcgaccccgggauuaguggaacccccggugccccgggccuaccgggacccaaaggaagugugggagguaugggacuaccugguacaccaggggaaaaaggagugccaggcaucccgggaccgcagggcuccccuggccugccuggugauaagggcgccaagggugagaaggggcaggcgggucccccugguaucggcauccccggccugagaggugaaaagggcgaucagggcaucgccggguuccccgggucuccuggggagaaaggcgagaaggguaguauuggcauacccggcaugcccggcucuccaggguugaaggguagcccuggcucaguuggcuaccccgggagcccaggauugccuggagagaaaggagacaagggccuccccggacuggauggaauucccggcguaaaaggcgaggccggacuacccggaacaccggguccaacuggaccugccggacagaaaggggagccagggucugaugggauuccugggucugccggagagaagggcgagccaggacucccuggaaggggguuuccuggauucccuggagccaagggagauaaaggcagcaagggugaaguuggauuucccggacuggcggguagucccggcauaccugguaguaagggagagcagggauucauggggccccccggaccucaggggcagccuggucuacccgggucaccaggucacgcuacagaaggccccaaaggagaccgaggcccucaagggcagcccggccuuccaggccugccuggcccaaugggcccuccuggucucccagggauugaugguguaaagggcgauaagggaaacccuggguggccuggagcacccggggugccuggaccuaaaggcgacccuggguuccaaggcaugcccgggauuggaggcagcccuggcaucacugguagcaagggggauaugggcccucccggaguuccuggcuuucagggcccaaaaggucugcccgggcuccaggggaucaagggcgaucagggagaucagggcguuccgggugccaaaggacugccuggaccccccggaccccccggcccuuaugacaucauuaaaggcgaaccaggccugccuggcccagagggcccccccgggcugaagggacuacaggggcuccccgguccaaagggacagcagggcguaacgggacugguagggauuccuggccccccugggaucccgggcuucgacggcgccccaggucagaagggcgagaugggaccagccgguccuacaggaccccggggauuuccggggcccccgggacccgacggucuaccaggaucaaugggcccgccuggcacccccucgguggaccauggcuuccuggugaccagacauucgcagacuauagaugacccucagugucccagcgggaccaaaauacucuaccacggauauucacuucuguacguucaggguaacgagcgugcccacggacaggaccuggguacagcaggcucuugccugcgcaaguuuagcaccaugcccuuccuguuuuguaauauuaacaaugucugcaauuuugcgucucggaaugacuacucuuauugguuauccacaccugagccaaugccuaugagcauggccccuaucacaggggagaauaucagaccuuucaucagcaggugugcggugugcgaggcccccgccauggugauggcuguccauucacaaacuauccagaucccacccuguccuagcgggugguccucguuauggauuggguauucuuuuguuaugcauaccucagccggagccgaggguuccgggcaggcccuugccucaccuggcuccugccuagaagaguuuagguccgcaccuuuuauagagugucauggacggggaacauguaauuacuacgcgaaugcuuauagcuuuuggcucgccacgaucgagagaagugaaauguucaagaaacccacacccaguacccuuaaagcgggagagcugcgcacucaugugucuaggugccaggucugcaugagacgaacauag

SEQ ID NO: 5240 - RNA, 3957 nt, Artificial Sequence
  Description of Artificial Sequence: Synthetic coding sequence
augggcccucgccugucgguguggcuguugcuucugcccgccgcgcugcuccuucacgaagaacacucgcgugcugcggccaaggguggcugugccggcagcgggugcggaaagugcgacugccacgguguuaaaggacaaaaaggcgaacgcggacuccccggacuccaggguguuaucgguuuuccuggcaugcaggggccagaagguccucaagguccuccaggccagaaaggcgacacaggugagccuggccuuccagguaccaaagguaccagaggcccuccuggagcuagcggcuauccggggaacccaggccucccagguauucccgggcaggaugguccaccuggccccccugggauacccgggugcaauggaacgaaaggggaaagaggcccacugggucccccuggccugccaggauucgcuggcaacccaggaccuccuggauugccagggaugaagggugauccaggcgaaauccucggccacguaccagggaugcugcugaagggagagaggggcuucccugguauucccgguacaccuggaccccccggccugcccgggcuccagggccccgucgguccccccggcuucacugguccucccggaccuccaggcccaccuggaccaccuggugaaaaggggcagaugggacugucauuccaagggccaaagggugacaaaggcgaccagggugugagcggcccuccugguguaccuggccaggcucaagugcaggaaaagggugacuuugcuacuaaaggcgaaaagggacaaaaaggagaacccgguuuccaggggaugccuggcgugggcgagaagggcgagccuggcaagcccggcccccggggcaaaccaggaaaggacggcgacaagggugaaaagggaucuccaggcuuccccggggaaccaggauauccaggucugauagggcgccaggggccccaaggcgaaaaaggagaggccggacccccugggccaccgggaauugugauugggacggguccucuuggggagaaaggagagaggggcuacccaggcaccccaggcccuagaggggagccuggccccaagggcuuccccggauuacccggacaaccuggaccuccuggucucccgguuccaggucaggccggcgccccuggauucccuggcgaacguggagagaagggggaccguggcuuccccggcacaagccucccaggucccagcggccgggacggccucccggggccccccggauccccaggaccaccgggccaacccggcuacaccaaugggauuguggaaugccagccaggcccucccggagaucaaggcccacccggcauccccggacagccuggauucauuggggagaucggcgagaagggccagaagggagagucuugucuuaucugugacaucgacggguauagggggccuccgggcccacaggggccaccgggagagauaggcuuuccaggccagccaggggcaaaaggccugccaggaaucacaggucagagcggacugccaggacugccuggacagcagggggcucccgggauccccgguuuccccggaucaaagggugaaaugggaguaaugggcacucccggucagcccggaucgcccgguccagugggcgccccuggcuugccuggagagaaaggagaucacggcuuccccggauccuccgguccaagaggcgacccuggguuaaagggcgauaagggagaugugggccugccaggcaagcccggaucuauggauaaaguagacauggguucaaugaaagggcagaagggagaucagggggagaaggggcagauuggcccaauaggcgagaaagggucuaggggggauccgggcacucccggagugcccggcaaagaugggcaggcaggacagcccggccagcccggcccaaaaggagacccaggcaucaguggaacccccggagcaccggggcugccagguccaaaagggagcguaggcggaaugggccuuccagguacaccgggagagaagggggugccagggauuccugguccucagggaucgcccgggcugccaggggacaagggcgccaaaggugaaaaaggccaggcaggaccucccgguauuggaauucccggacugcgcggcgagaagggugaucaggggaucgcuggguuucccgguucaccgggcgaaaagggcgagaagggcucaaucggcauccccggaaugccaggcuccccuggucugaagggcaguccgggaucaguugguuacccaggcagcccaggauuaccgggugaaaagggagacaagggauuaccgggguuggauggcaucccggguguaaagggagaggcaggccugccugguacccccggaccuacaggccccgcagggcaaaagggcgaaccaggcuccgacggcaucccaggcagugcuggcgaaaagggcgagccaggacuacccgggaggggauucccagguuuccccggagcaaaaggggauaagggguccaagggcgagguggguuucccuggguuggcgggaagucccgguaucccaggcuccaaaggugaacagggcuucauggggccuccuggcccgcagggccagccaggguugccuggaucacccggacacgccacugaagguccuaaaggagaccgugguccacagggucagcccggccuucccggcuugccaggaccuauggggccaccuggucuacccggcaucgauggcgucaagggcgauaagggcaaccccggauggccuggagcucccggaguacccggaccaaagggggauccaggguuucagggcaugccaggaaucggcggcaguccaggcaucaccgggucaaagggggacaugggaccccccggagugccuggcuuccagggcccuaagggucucccggguuugcaggggauuaagggcgaccagggggaucagggagugcccggagcaaaaggucucccagggccaccgggcccacccgggccauacgacaucauuaaaggggaaccaggccugcccggcccugaggggcccccggggcugaagggcuugcaaggccuccccgguccgaaaggucaacagggagucaccgggcuggugggaauuccagguccaccagggaucccaggauucgacggagcuccaggacaaaagggagaaaugggacccgccggcccgacaggcccccgcggauuccccgguccuccagggccugauggccucccggguagcaugggaccuccuggcaccccgagcguagaucauggcuuucugguuacccgccacucccaaaccauugacgacccucaaugccccagugguacuaagauucuguaccaugguuacucccugcuguaugugcaaggcaaugagagagcucacgggcaggaucucggcacugcuggaagcugccuuaggaaguucagcaccaugcccuuccucuuuuguaauaucaauaacgugugcaacuuugccucucgcaacgauuauaguuauuggcuguccacgccagaacccaugccgaugaguauggcgccgauuaccggggagaauauucgacccuuuaucagcagaugugcaguuugcgaagcccccgcaauggucauggccguccacagccaaacuauccagauucccccaugucccagcggcuggucuagcuuguggauaggcuauucuuuugugaugcacacuagugccggcgccgaaggaucugggcaggccuuagccucuccuggcucaugccucgaggaauucagaucugccccguucauugagugccaugggcgcgggaccuguaauuacuaugccaaugccuauucauucugguuagccacaaucgagcgaucagaaauguuuaagaagccuacaccuaguacacugaaagccggggaacugagaacucacguguccaggugccagguaugcaugcgucggaccuag

SEQ ID NO: 5241 - RNA, 1560 nt, Artificial Sequence
  Description of Artificial Sequence: Synthetic coding sequence
augggucccaggcugucuguauggcucuugcuguuacccgccgccuugcugcugcacgaggagcauucacgagcagccgccaagggcgguugcgcuggguccggaugcggcaagugcgauugccacggagucaaaggacagaaaggagagaggggacucccaggauugcaaggcguaaucgguuuccccggcaugcagggcccugagggaccccaaggcccucccgggcagaagggugauacuggcgagccagggcuuccagguaccaaaggcacaaggggcccaccaggcgccagcggguacccugguaauccugggcuaccagguauucccggucaagauggacccccagguccaccuggcauccccggguguaauggcaccaaaggagagagagguccacuagguccucccggccuaccaggguucgccggcaacccaggaccccccggucucccuggaaugaaaggcgaucccggcgagauuuugggacaugugccagggaugcuccugaagggggagagggguuucccaggcaucccgggcacuccagguccaccaggccuucccggucugcagggccccguaggcccaccugguuucaccggcccccccggcccaccugguccaccaggcccacccggggagaaggggcaaauggggcuuagcuuccagggcccuaaaggugacaagggcgaccaaggaguaucaggcccaccuggggugccaggacaggcccaagugcaggagaagggcgacuuugcuacuaagggcgaaaagggccaaaaaggagaaccagguuuccaaggcaugccaggcgugggagagaagggugagcccgguaagccagggccaagaggcaagccaggaaaagauggugacaagggagaaaaagguucaccuggcuucccuggugaacccggauacccuggacugaucgggagacagggcccacagggugaaaagggcgaagcuggaccacccggcccccccgggaucgugauagggacagggccccucggcgaaaagggggagaggggguauccaggcacuccuggcccaaggggagaacccggaccaaagggguuccccgguuugcccggacaaccuggaccaccugggcuccccgugcccggucaagcgggugcgccgggcuuuccaggcgagcgcggcgaaaaaggggacaggggcuuucccggcaccagccugccaggcccuagcggccgcgauggacuuccugguccuccaggaagccccggcccaccgggacagccggguuacaccaacggcauuguugaaugucaaccaggcccgccaggcgaucaaggaccuccgggaauucccggacaaccuggauucaucggggagauuggggaaaagggccaaaaaggagagagcugcuugauuugugacaucgauggguauaggggcccacccggcccucaggguccucccggcgaaaucggguucccgggacagccaggcgcaaagggcgacaggggccucccggguagagauggcguggcaggcgucccgcuccuguuucagauccauaaguag

SEQ ID NO: 5242 - RNA, 252 nt, Artificial Sequence
  Description of Artificial Sequence: Synthetic coding sequence
auggccgccgcuacugcgaguccaagaucucuccucguacugcuucaaguugugguccucgccuuggcucagauucgggguccccccggcgaacgcggaccaccaggccccccuggcccccccggggugccaggaucagauggcaucgacggaccacccggcccgguggggcuuccuggcgaaaucggcaucagaggaccaaaaggggacccaggccccgauggaccaagcggaccgccuggaccaccguag

SEQ ID NO: 5243 - RNA, 2070 nt, Artificial Sequence
  Description of Artificial Sequence: Synthetic coding sequence
auggcagcagcgacagccaguccccggagccuguugguacuccugcaaguggucgucuuggcccuggcccagaucagagguccucccggcgagcggggcccuccuggaccuccagggcccccuggaguaccuggaagugauggcauugauggcgacaacgggccuccuggaaaggcaggcccacccggaccuaaaggcgaaccuggcaaagccggaccagacgguccagauggcaagccuggcauugaugggcugaccggggcuaagggcgaacccggaccgaugggcauuccuggcgucaagggucagccuggucuuccuggaccaccaggacugcccggaccuggauuugccgguccucccggcccaccagguccagugggacugccuggugagaucgggaucagaggacccaagggcgacccagguccggacggacccuccgggcccccgggcccccccggcaagcccggcagacccgguaccauucaagggcuagaaggcuccgccgauuuucugugucccaccaauugccccccugguaugaaagggcccccaggauugcagggcgucaagggacaugcuggcaaacgaggaauauuaggggaucccggccaccaggggaagcccggccccaagggugaugucggugccagcggagaacagggcauccccggacccccuggaccccaagguauucggggcuacccagggauggcuggaccgaaaggcgaaaccggaccccacgguuacaaaggcaugguuggugccaucggagcuacgggaccaccaggggaagaaggaccuaggggcccuccuggccgugcuggcgaaaagggugaugagggguccccugguauacgcgggccgcaagggauuacuggaccaaaaggagcuacugguccuccagggauuaauggcaaggauggcacucccggcacuccggggaugaagggguccgcgggucaggccggacaacccggaucacccggucaucagggauuagcuggaguccccggacagccaggaacaaaaggaggacccggagaccagggggaacccgggccccagggccugccuggcuuuucuggacccccgggcaaagagggggagccaggaccaaggggagaaauugggccccaggguauuaugggacaaaaaggcgaccagggugagagggggccagugggccagccgggaccucaagggaggcaaggacccaagggagagcaaggaccuccagggaucccggggccacagggcuugcccggagucaagggcgauaaaggaucaccuggcaagaccgggccucgcgguaaagucggagaccccgggguugccggccugccuggcgagaaaggcgaaaagggggaaaguggagagccgggacccaaggggcaacaaggcguaagaggcgagcccggcuauccgggaccgucuggcgaugcuggggcacccgggguccaaggauauccggggccacccgguccccgcgggcuggccggaaaucggggggugcccggacagccgggacgacaggguguugagggccgggacgccaccgaucagcacaucguggacguggcucugaaaaugcugcaggaacagcuggcugagguagccguaucugcgaagcgggaggcucuuggcgcugucgggaugaugggaccacccgguccacccgggccaccuggcuauccugggaagcagggaccccauggacaccccgggccccggggcgugccugguauuguuggagccguggggcagauugguaauacagguccuaaaggaaagcggggagagaagggagacccuggggaaguggggcgcggccacccuggcaugcccggcccuccagggaucccagggcuuccagggagaccuggucaggccauuaauggaaaagacggagauagaggcuccccuggcgcccccggagaggccggccgaccuggucugcccggucccgucgguuugccuggauucugcgaaccggcugcaugucugggagcgagcgcauacgcuucagcgagacugacagaaccaggcucuauuaagggaccauag

SEQ ID NO: 5244 - RNA, 2055 nt, Artificial Sequence
  Description of Artificial Sequence: Synthetic coding sequence
auggccgggccuagagcaugcgcuccccuguuacuacuucuacuacucggggaacuacuggcagcugccggagcccaacgggucggacuuccuggcccaccuggcccuccaggacccccaggaaagccuggccaggacgggaucgauggcgaggcuggaccucccggguugcccggcccccccggucccaaaggagccccggguaaaccuggcaaaccuggagaggcugguuuacccggucuccccggaguggacggccuuaccggccgggacggaccgccggggccuaagggugccccuggugagcgugguucucucggucccccuggcccgccagggcucggagggaaggggcucccaggaccucccggcgaggcuggugucaguggcccgcccggcggcauaggacuacgcggcccaccgggccccucuggccuuccuggacugcccgggccacccggcccaccgggcccacccggccacccagguguacucccugaaggagccacugaccugcagugcccuucaaucuguccuccagguccacccggccccccugguaugccugguuucaaaggaccgacuggcuauaaaggagaacaaggggaaguggggaaggacggagaaaagggcgacccuggaccccccgguccagccggcuuacccgguagcgugggccuucaggggccacgcgggcugcgcggacucccuggcccucucggaccccccggcgacaggggccccauugguuuucggggcccucccgggauacccggugcccccgggaaagccggugauagaggggaacgcggccccgaaggguuucgcggcccaaagggcgaucuagguagaccuggaccuaaggguacuccaggcguggcagggcccuccggagagccuggcaugccaggaaaagauggucagaacggcgugcccggucuggauggccagaaaggagaagcuggccggaauggagccccuggagagaaagggccuaauggguugccagggcuccccgguagggcggggucuaaaggcgaaaagggagaaaggggcagagcaggagaacugggugaggccggacccagcggagagcccggaguuccaggcgacgccgggaugccuggagaaagaggggaagcaggccaucgcgguagcgccggugcgcuuggaccccaaggaccuccuggagcucccggagugaggggauuccagggccagaagggcuccaugggagacccuggccuuccagggccccaaggucuccgaggugacguaggagauagaggacccggcggugccgcugggccaaaaggugaccaagggaucgccggcucggauggccugccaggggacaagggagaacuggguccguccggccugguugguccaaagggcgaguccggcuccaggggugagcucggaccuaagggcacccaggguccaaauggaacuagcggcguccagggcguuccaggcccgccugguccucuuggguugcagggggugccuggggugccugguaucacaggaaagccaggcguacccggcaaggaagcauccgagcagagaauccgggaacucugcgguggaaugauuagugaacaaaucgcucagcucgcugcucaucugagaaaaccauuggccccgggauccaucgggagaccuggacccgcaggccccccgggcccccccgggccaccaggcuccauuggccauccaggcgcacgcgggccucccggguaccggggaccaaccggagaguugggcgacccgggcccacgaggcaaccagggggaucggggggauaagggcgcagcuggcgcuggucucgauggacccgagggcgaucaaggaccucaggggccacagggcgugccaggaacaaguaaagaugggcaggacggugcgccaggagaaccuggcccacccggggacccuggccuccccggagcuauuggagcucaaggcacuccaggcaucugcgauacguccgcuugccagggcgccgugcugggcggggugggagaaaagucagggagucguagcucuuag

SEQ ID NO: 5245 - RNA, 576 nt, Artificial Sequence
  Description of Artificial Sequence: Synthetic coding sequence
augugguggucuagcacccaaaacgcaggcacagagggugaggcugggccaccaggccucccggguccaccuggcccaaaaggcgcuccagggaagccagggaagccgggcgaagcaggcuugccaggcuuaccaggcguggacggccugacuggaagggauggacccccuggccccaaaggagcucccggcgaacgcgggagccucggucccccggggccacccggacuugggggcaagggccuccccgggccccccggagaggcuggugucagcggaccuccugggggaauuggauugcgaggacccccaggaccuagugggcuccccggccugcccggaccacccgguccaccggggccucccggccacccaggcguccugcccgagggagccacagaucuccaauguccuucuauauguccaccagguccaccagggccaccaggcaugccuggguucaagggcccaacaggauacaaaggugaacaaggagagguagguaaagauggcgaaaaaggagacccaggaccccccggccccgcuggguugcccgguagcguuggucuucaguag

SEQ ID NO: 5246 - RNA, 576 nt, Artificial Sequence
  Description of Artificial Sequence: Synthetic coding sequence
augugguggagcagcacacagaaugcuggaaccgagggagaggcugguccacccgggcugccgggcccgccaggaccaaaaggcgcccccggaaaaccaggaaagccgggagaagcggggcucccuggauuaccaggcgucgauggucuuacaggcagagacggucccccaggccccaaaggagcucccggugagaggggaagucucggcccucccggcccgccagggcugggcggcaaggggcuacccggcccuccaggggaagcuggcguuucuggcccucccggaggcauaggguuacgggggccgccaggccccagcggccugccggggcugccugguccucccggaccucccggccccccuggucauccuggcgugcuuccugagggggcgacugacuuacaguguccaucgauuuguccaccaggcccaccaggaccuccgggaaugcccggauuuaaagggcccaccggauacaagggcgagcaaggagaagugggaaaggacggugaaaaaggagaucccggaccaccgggcccagcuggcuugccagggaguguaggccuucaguag

SEQ ID NO: 5247 - RNA, 1128 nt, Artificial Sequence
  Description of Artificial Sequence: Synthetic coding sequence
auggggccuccuggcuugccuggacucaaaggagacucugggccuaaaggagagaagggucauccaggauugaucggacugauaggucccccgggggaacaaggagagaaaggggauaggggacuccccgguccacaagguagcagugggccuaaaggagaacaaggcauuacuggcccgagcggcccaauaggccccccuggaccucccggcuuacccgguccuccaggcccuaagggugcaaaagggucuagcggcccgaccggcccuaaaggggaagccggccauccuggcccgcccgggccgccaggucccccaggugagguaauccagccacugcccauacaggcaaguaggacuagacgcaauaucgacgcuucccaacugcucgaugacggaaacggggagaacuauguagauuacgcugacggcauggaggagauuuuugguagcuugaauagccucaaauuagagauugaacagaugaagcggccucuugggacgcagcaaaacccggccagaacauguaaagaucugcagcucugccacccugauuuccccgacggagaguacuggguggaccccaaucagggguguuccagggauagcuucaagguguauuguaauuuuacugcgggagggaguacgugcguuuuucccgauaaaaaaagcgagggcaguaaaauggcccgauggccuaaagagcagccuucgaccugguauagucaguacaagcggggcagccuguuaagcuacguugacgccgaaggcaaccccguaggugucguccagaugacauuucugagauuguuaucagccagcgcacaccaaaaugucacuuaucacugcuaccagucugucgcauggcaggaugccgccacaggaucuuacgauaaggcccugagauuucucgggagcaacgaugaagaaaugucuuaugauaauaauccguacaucagggcacugguggacgguugugccacuaagaaaggcuaccagaagaccgugcuugaaauugacacaccaaagguugaacaaguccccauuguggacauaauguuuaaugacuucggggaagccagucagaaauuuggcuuugaagugggaccggcuugcuuuauggguuag

SEQ ID NO: 5248 - RNA, 5517 nt, Artificial Sequence
  Description of Artificial Sequence: Synthetic coding sequence
auggacgugcauacgcgguggaaagcccggagcgccuugagaccaggggcuccuuuguugccgccacuccugcugcuucuucugugggcuccaccuccuagucgcgccgcacagcccgcagaccugcucaaagucuuggauuuucacaaccuccccgauggaaucacgaaaacuacaggguuuugugcaacccgacguagcaguaagggccccgacgucgccuaucggguuacaaaagaugcucagcuauccgcccccaccaaacagcucuaccccgccagugcguucccugaagacuucucaauccugaccacgguaaaagcaaaaaaggggagccaggccuuucuggucucuauuuauaaugagcaggguauucagcaaauaggauuggaguuggggagauccccugucuucuuauacgaagaccauacaggcaaacccggccccgaggauuacccgcucuucagaggcaucaauuuauccgauggaaaauggcaccgcaucgcccugucuguccauaagaaaaacgugacccucauucucgacuguaagaaaaagacuacuaaauuccucgaccggagcgaccacccaaugauagauauuaaugguauaaucguguucgguacccgcauccuggaugaggagguguucgagggggacauccaacagcugcucuucguuagugaucaccgggccgcauacgauuauugcgaacacuauucgcccgacugugauacagccgucccugacacuccccaaucccaagacccuaaccccgaugaauauuauacggagggugacggugagggugaaacauacuacuaugaguacccauacuacgaagacccagaggaucuuggcaaggagccaacaccgucuaaaaaaccagucgaagccgccaaagagaccacagaggucccagaggaacuuacaccuaccccuaccgaagccgcccccaugcccgaaaccagugagggugcugggaaagaagaggacguuggaaucggagauuacgacuauguccccagcgaagacuacuauacccccagcccuuacgacgaccucacuuacggagaaggagaagagaauccugaucaacccacagaccccggagcuggagccgaaauccccacuuccacagcugacacuucuaauucuaguaacccagcaccuccucccggagaaggggccgaugaccuugagggcgaguucacggaagagaccauucggaauuuggacgaaaacuacuacgacccuuacuacgaucccaccagcucuccuucugaaauugggccuggcaugccagccaaucaagacaccauauacgaggggauuggagggccgcguggggagaaaggacaaaaaggggaaccugcgauuauugagcccggaaugcugaucgagggccccccaggaccagaaggacccgcagggcucccuggcccacccgguaccauggggcccacaggucaggugggcgauccuggggagcgcggcccaccagguaggccuggccucccgggagcugacggccugccgggccccccaggcacgaugcucaugcugccuuuccgguucggggggggaggggaugcuggcuccaaagguccuaugguaagugcccaggaaucucaggcgcaagcuauccuccagcaggccagauuagccuugcggggccccgcaggacccauggggcuaacaggcaggcccggccccgucggccccccaggaucagguggguugaaaggugagcccggggauguggggccacagggcccucgaggaguccaggggccucccgguccagccgguaaaccaggcagacggggaagggccgguuccgauggugcacgcgggaugcccggccaaacagggccgaaaggagaccggggauuugauggucuggcaggccucccgggcgaaaagggccaccggggggaccccggcccaucaggcccuccgggcccaccuggggaugauggugagcguggggaugauggggaaguugguccaagaggcuugccuggagaacccggacccagaggguuacuggggcccaaagggcccccugguccuccugguccaccugggguaacuggcauggacggccagccgggaccuaagggaaauguaggaccacagggagagccaggcccuccaggacaacaggguaauccuggggcgcaagggcugccugguccacagggcgccauuggaccgccaggggaaaagggcccuuugggcaaaccgggacuacccggaaugccaggagcagacgguccucccggacauccuggcaaggaggggccaccaggcgaaaagggcggccaggggccucccggaccccagggccccauuggauaucccggcccucgugggguuaagggggccgacggcauccggggcuugaaagguacuaagggggagaaaggagaggauggcuuuccuggauuuaaaggcgauaugggcaucaagggggacaggggcgagaucggaccaccugggccaaggggugaggacggccccgagggaccuaaaggacgaggcggcccaaacggugacccagguccauuggggcccccaggcgagaaggggaaacuggggguccccgggcugccaggguacccuggccgacaggggccuaagggcagcauuggguucccaggguucccuggagccaacggggagaaaggagggaggggcacucccggcaaaccagggccaagaggacaacgggggccuaccgggccucguggagaaagaggaccccgcggcauaacaggaaagccaggaccaaaagggaacagcggaggggauggccccgcuggaccucccggcgagcgcgguccgaacggcccucaggguccuaccgguuuucccggaccgaagggaccgccgggcccccccgguaaagacggacugccaggacacccaggacagcgaggugaaacaggcuuccaaggcaagaccgggccgccaggaccgcccggaguagucgggccccagggcccuacaggggaaacgggucccaugggggaaaggggacauccuggaccccccggaccuccuggggagcagggacuaccuggacuggcugggaaggagggaacuaagggagauccgggacccgcaggacugccuggcaaggacgggccgcccgggcugagaggauuucccggagaucgcggguugcccggaccugucggcgcgcugggccuuaaggggaaugaaggcccccccggcccucccggccccgccggaucacccggggaacgcgggccagcaggugccgccgggccuauaggcaucccgggccggccuggaccccaggguccccccgggccagcgggcgaaaaaggagcaccaggagagaaggggccgcagggaccugccggccgcgauggccuucagggaccggugggucucccgggccccgccgggccugugggaccacccggggaggacggugauaaaggcgaaaucggggagcccggccagaaaggaagcaaaggcgauaaaggggaacagggcccaccugggcccacagggccacaaggaccuaucggccagccuggcccgagcggggcagacggagagccaggcccccggggccagcaggggcucuucggccagaagggagacgaggggccuagaggcuuccccgggcccccuggacccgugggacuucaaggacuuccuggaccccccggggaaaaaggggagacuggugacguuggacagaugggaccuccggggccucccggaccgcgcgggccauccggcgcaccgggggcggauggaccacagggaccccccggugggauaggcaaccccggugcagucggcgagaagggugaaccaggugaagcaggcgaaccugggcuuccgggcgaaggaggccccccuggcccgaaaggcgaaagaggagaaaagggagaaucuggccccuccggugcagccggaccccccggcccuaaaggaccacccggagacgacggccccaagggcagcccugggcccgugggcuucccgggcgacccaggcccuccaggggagccuggaccagccgggcaggacggaccucccggugauaagggugacgacggggagccuggucagacuggaagcccuggacccacaggugaacccggccccagcgguccccccgguaaaagagggccccccgggccggccggacccgagggaaggcaaggggagaagggugcuaagggugaagcuggccuggaggggccccccgggaaaacgggaccaaucggcccacagggagcaccuggcaaaccuggaccagacggccugcgaggcauccccggcccuguuggggaacagggacugccagguaguccggguccagacgggccaccugggcccauggggccgccgggauugcccggucucaagggugauucgggaccaaaaggcgagaagggucaccccggacugauuggccucaucggcccucccggcgagcaaggagaaaaaggugauagagggcugccugguccccagggcagcucuggcccaaagggggaacagggaauuaccggaccuaguggcccuauuggaccuccaggcccaccaggccuccccgguccaccuggaccaaagggagccaaaggaucgagcggaccaaccggcccgaagggugaagccggacauccaggcccacccggccccccgggccccccuggcgaagucauccagccucugccaauucaggcuucgcguacccgccguaacaucgacgcuagucagcuccuggaugacgguaauggagagaauuauguggacuacgccgacggaauggaggagauauucgggagcuuaaauaguuuaaagcucgaaauugagcagaugaagcgcccauuggguacccagcaaaauccagcaagaacaugcaaggauuuacagcugugccauccagauuuucccgacggugaauauuggguggaucccaaccagggaugcucacgggacucuuucaagguauauuguaacuucacagccggcgguagcacaugcguguuccccgauaagaaaucugagggagccagaauuaccagcuggcccaaggaaaaucccggaagcugguuuucagaauucaaaagaggcaagcuuuuaucuuacguggaugccgaggguaaucccgucggaguggugcaaaugacguuccuacggcuccuaucggcaagcgcccaccagaacgugacauaccacugcuaucaaucuguggccuggcaggaugcugcaaccggcucuuaugacaaggcuuuacgguuccuaggcaguaaugacgaagagaugucuuacgauaacaacccauacaucagagcacugguggacggcugcgcaaccaagaagggguaucagaagaccguuuuagagaucgacaccccaaaagucgagcaggugccuaucguugacauuauguucaaugacuuuggugaagccucccagaaauucggcuuugaggucggcccagcguguuuuaugggcuag

SEQ ID NO: 5249 - RNA, 633 nt, Artificial Sequence
  Description of Artificial Sequence: Synthetic coding sequence
ugaaggacucgccggaauaucgacgccucucaguuauuagaugacggcaacggggaaaauuacguggauuaugcugaugggauggaggagauuuuuggaucccucaauagccucaaacucgaaauagagcaaaugaaacguccacuaggcacgcaacagaacccagcucgaacaugcaaggaccuccaacuuugucacccagacuuucccgauggagaauacuggguggauccuaaucagggcuguagcagggacuccuuuaaaguuuauuguaauuuuaccgcaggcgggucuacguguguguucccagauaaaaaaagugagggcucaaagauggcaagauggccuaaggaacaaccauccacaugguauucacaauauaaaaggggcucguugcuguccuauguagaugccgagggcaauccuguugggguuguucagaugacuuuuuuacgauuacucucugccagcgcgcaccagaacgugaccuaucacuguuaccaauccguggccuggcaggacgccgccacuggaucuuacgacaaggcccuuagguuucuggggagcaacgaugaagagauguccuacgauaauaauccuuacaucagggcacugguugauggaugugccuag

SEQ ID NO: 5250 - RNA, 9534 nt, Artificial Sequence
  Description of Artificial Sequence: Synthetic coding sequence
augcggaagcaucggcaucuuccccugguugccgucuuuugucuguuccucuccggcuucccuacaacacacgcacaacaacagcaggcggacgucaagaauggcgcugcagcugacaucaucuuccugguugauuccaguuggacaaucggcgaagaacacuuucaacuagugagagaauuccuguacgacgucgucaaaucacuggcuguaggggagaaugacuuucacuucgcacuuguucaguucaacggcaacccccauacagaguuccuguuaaacacuuaccggacaaagcaggagguccugucccacaucaguaacaugucuuauaucggugggacuaaucaaacaggcaaaggacuugaguacauuaugcagagccauuugaccaaggcggccgggaguagggccggagauggagucccacaggugauugucgugcugacagauggccauagcaaggauggucuggcccugccaagcgcugagcugaagucggccgacgugaacgucuucgccauugggguugaagaugcagaugagggcgcccuuaaagagaucgcuuccgagccgcugaauaugcauauguucaaucuggagaacuucacaucccugcacgauaucgucggaaauuuaguuuccugcgugcacuccagcgucagcccugagagagccggcgauacagaaacccucaaggauauaaccgcacaggauucugccgacaucaucuuucuaaucgacggaaguaauaauacgggaucuguaaacuuugcugucaucuuagacuuccuagucaaccugcuugaaaagcugccaaucgguacucagcagauccgcgugggagucgugcaguucucugacgagccaagaacaauguucucucuagacacguauaguacaaaagcccagguccuuggcgcagugaaggccuugggcuuugcgggcggcgagcucgcgaacauaggauuggcguuagauuucgucguggagaaucacuuuacccgcgccggcggaucccgcguugaagaaggcgugccccaaguccugguccuuauuagcgccgggccgagcuccgacgagauccgcuauggagugguagcgcuaaagcaggcuaguguuuucucauuuggauuaggggcucaagccgccucucgagcagaacuccaacauaucgccacugaugauaaccugguguuuaccgugccugaauuccggagcuuuggugaucuccaggagaagcuuuuacccuacauagucggaguugcucaacggcacauuguucugaagccuccaacuaucgugacccaggugauugagguuaauaagagagauaucguguuccugguggacggaucuucggcucuaggacucgccaauuuuaacgcaaucagagauuuuauugcuaagguaauucagcggcuggaaauaggccaagaucugauccaaguggccguugcccaguaugcugacaccguuaggcccgaauuuuacuuuaacacccaucccacaaaacgugaggucauuaccgcgguacgaaaaaugaagcccuuggacggaagcgcuuuguacaccggaagcgcucuggauuucgugcgcaacaaucucuucaccagcagcgccggcuaccgggccgcagaggggauccccaaacugcucguucugaucaccggagggaaaucucuugaugaaauuagucaaccggcacaagaacugaagaggucgaguaucauggcuuucgcuauugguaauaagggcgcagaucaagcagaacucgaggaaaucgccuuugauucuagcuugguauuuauuccggccgaauuuagagcagccccguugcagggaauguugcccgggcuucucgcuccgcugcguacuuugagugguacuccagagguccacuccaauaaaagagauauaauauucuuguuggauggcagugccaacguaggaaaaaccaauuuuccauacgugcgagacuuugugaugaaccuggucaacagccucgauauugggaaugacaauauuaggguagguuuaguacaauuuucggacacgcccgucacagaguuuucgcuuaauaccuaccagacuaagagcgacauccuuggacaccucagacaacuacaguugcagggcggauccggucuuaauaccgguuccgcccuguccuauguuuaugcaaaccauuucacugaagccggaggcuccagaaucagagaacacgugccgcaacugcuccugcugcucacagccgggcagagcgaagacaguuaccuccaggccgcuaacgcucugaccagggcuggcauccucacauucugcgucggagccagccaagcgaacaaggcagagcuggagcagauugccuucaauccuagucuuguguaccucauggacgacuucagcucgcugccugcccucccccagcaguugauucagccuuuaacuacguacgugagcgguggcgucgaggaagugccacuggcacaaccggaauccaagcgugauauacuguuuuuguuugauggcagcgcaaaucuugucggccaguuccccguggugcgggauuuccuauacaagaucaucgaugagcucaauguuaagcccgagggcacaaggaucgccguagcccaauacuccgaugaugugaaaguugagagcagauucgaugaacaccaguccaaaccggagauccuuaaucuggugaaacgcaugaaaauaaagacagguaaggcgcugaaccucggauaugcccuggacuacgcucagcgguacauuuuugugaagucugccgggagccgaaucgaggacggugugcuccaguuccuggugcuacuagucgccggcagaaguagcgacagagucgacgggccagccagcaaccucaagcaaaguggggucguaccuuuuaucuuccaggcuaaaaaugcugacccugcugaauuggagcagaucguucucagucccgcguucauacucgccgcagaaagucuucccaaaaucggagaccugcacccacaaauugucaaccuccugaaaagcguucauaacggagccccagcaccugucuccggagagaaggaugugguguucuuacucgaugggagcgaaggagugagaagcggguucccccuccuuaaggaauucguccagaggguaguggagagccucgauguuggucaggaucgagugcgcguggccguaguacaguacucugacaggacuaggccagaguucuaucugaauucauacaugaacaaacaggaugucgugaacgcgguucgucagcugacguugcugggcgggccaacacccaauacaggggcggcauuggaauucgugcuucggaacauacuagucaguagugcaggaagcaggaucaccgaggguguuccgcaacuacucauuguguugaccgcugaucgcuccggcgaugacguucguaauccuucugucgugguuaagcgcggcggcgcagucccgaucgguaucgguauuggcaacgcugauauuacugagaugcagaccauuaguuuuaucccagauuucgcuguagcuauccccacguuccgccagcugggaacaguccaacagguaaucuccgagcgggucacccagcugacucgagaagaauuaucgcgucugcagccaguacuucaaccucuaccuagucccggcguaggcggaaaacgcgaugugguguuucuaauagauggaucccagucugcaggaccugaauuccaguacguuaggacgcucaucgagagguuaguugacuaccuggacgucggcuucgacacuacacguguugcugugauucaguuuucugaugaucccaaaguagaauuccugcuuaaugcacauucaucaaaggaugaggugcagaaugcuguccaacggcugagaccuaaaggcgggagacagaucaacguuggaaacgcauuggaauacgucagccgcaauaucuucaagcggccccuugguagccgaauugaagagggggugccccaguuucugguucucaucucauccggaaaaagugaugacgagguugacgauccagccguggagcuuaagcaguucggagucgcccccuuuaccauugcccgaaaugcugaccaggaggaacuugucaagaucagcuugagcccugaauaugucuucucaguuuccacauucagggaacuucccagccuggagcaaaaauuguuaacaccaauuaccacacugacaucagaacaaauccagaaauuacuugccuccacaagguacccuccucccgccgucgaaucagacgccgccgacauuguauucuugauagacagcuccgagggcguccgucccgaugguuucgcccauaucagagacuuugucucuagaauuguucgccgauugaauauuggaccauccaaaguuagagugggugucguccaauuuaguaaugauguguucccggaguucuaucucaagaccuaccggucucaagccccaguccuagaugcgaucaggcggcugcgccuacggggcggcucuccccucaacaccgggaaagcuuuagaguuuguggcucggaaccuguuugucaagucggcuggcuccaggauagaagauggaguuccccagcaucuuguccucguauugggaggaaaaucucaggacgaugucucgcgguuugcgcagguuauccgcucuucuggcauuguuaguuugggagugggugaccgcaacaucgacagaaccgaauuacagaccaucacuaacgacccccgguugguuuuuaccgugagggaguuucgcgaacugcccaauauugaagaacgaaucaugaauagcuucggcccaucugcagccacuccagcucccccaggcguggauacaccuccucccucucgcccugagaagaagaaggccgauauugucuuccugcuggacggauccaucaacuuuagacgggauagcuuccaagagguccugcgauucgugagugagaucguggacaccguauacgaggauggugacucaauacagguugggcuggugcaguauaauagcgaccccaccgacgaguuuuuccuuaaagacuuuaguaccaaacgccagauuaucgaugcgaucaacaaaguggucuauaagggagggaggcacgcaaacacaaaggugggguuggagcaccuucggguuaaccacuucguaccagaagcaggguccaggcuagaucagcggguaccccaaaucgccuucguuauuacaggagggaagucugucgaggacgcccaagacgucucucucgcacugacccaacgcggggugaaagucuuugccguggggguucggaauauugacagcgaagaggugggaaagaucgccagcaacucugcaaccgccuuuaggguaggaaaugugcaggaguuaucugaacuaucugaacaagugcuugaaacuuugcaugaugccaugcaugaaacucugugccccggagugacugacgcugccaaagcuuguaaucucgaugucauccuggguuuugacggcagccgggaccagaaugucuucgucgcgcaaaaaggcuucgagaguaaaguugacgcaauccuaaacaggauuucacagaugcaccgcguuuccuguagcggcggucgcucuccaacugugagaguguccguaguggccaauacgccuucuggccccguggaggcuuucgacuucgaugaauaucagcccgaaaugcuggagaaauuucgcaacaugaggucccagcauccauacguccucacagaggacacacugaaaguuuaccuaaacaaauuucgacaguccuccccagauagugucaagguggucauucacuuuaccgauggggccgacggcgaccucgcagaccuucaccgggcguccgagaaucuaagacaggaggguguccgggcccugauucuggugggguuagagaggguggucaaccuagagcgucugaugcaccuggaguuugggagaggcuucauguacgaucgaccccugaggcugaaucugcuggaccucgacuacgaguuagccgagcagcuggacaacauugcugaaaaggccuguuguggggugcccuguaaauguagugggcaacgcggugaccgcgguccuauuggaucaaucggccccaagggaaucccgggcgaggauggcuacagagguuaccccggagacgaaggcggacccggcgagagggguccgccggggguaaacgguacacagggauuccagggaugucccgggcagcgaggcgugaaggggagccgggguuucccaggcgaaaagggcgaggucggugaaauuggacuggauggucuggauggagaggacggagauaaagggcugccuggguccucuggcgagaagggaaacccgggucguagaggugauaagggcccuaggggagagaagggagaacggggggacgugggcauuaggggcgaccccgggaauccuggccaagacucacaggagcgugggcccaaaggcgagacaggugacuuaggacccauggggguaccuggccgcgacggagucccaggcggccccggcgaaaccggaaagaacggcggauuuggacggcgaggcccccccggagcgaagggcaacaaagggggccccggccagcccggcuuugagggagaacagggcacccggggagcacagggacccgcaggaccugccggcccaccuggccucauaggcgagcaagguauuagcgguccacggggaaguggaggggccgcaggggcgcccggugaacgcggucgcacaggaccacuagggcgaaaaggcgaacccggcgagcccggcccaaagggagggauugguaacagagggccuagaggggagaccggggaugauggcagggauggugugggguccgaggggaggcguggaaagaagggugagagagguuuccccggcuacccugguccaaaagggaauccaggcgaaccgggccugaauggaacaacaggcccaaagggaaucagaggucgaaggggcaauucagggcccccaggcauugucggucagaagggcgacccagguuaucccggucccgccgggccaaaagggaaucggggagauucaaucgaccagugugcccuaauacaaagcaucaaagauaaguguccauguuguuaugguccuuuggagugucccguuuuccccacagaacuagccuuugcauuggacacuuccgaaggcgugaaucaagacacguuuggcagaaugcgcgacgucgucuugucuauugucaacgaucuuacuaucgcugaaucuaauugcccgcggggggcuagaguagcagucgugacauacaacaacgaggucacgacagaaauuagguucgcugauucaaaacguaagaguguucuucuggacaagaucaagaaucugcagguggcacuuacauccaagcagcagucccucgaaacggcaaugucauucguggccaggaauacuuucaagagaguucgcaaugguuuccucaugagaaaaguggcugucuucuuuucuaauacuccaacaagggcaucaccccagcugcgcgaggcaguacugaaauuauccgaugcgggaauaacgccauuauuucucacaagacaggaagacaggcagcuuauuaaugcccugcagauuaacaauacugccguuggucaugcacuuguguuaccugcaggccgugaucugaccgacuuccucgagaacguacuuacaugccaugugugccucgauauuuguaauaucgaccccaguugcggcuucggcucuuggagacccucauuucgggaucggcgggccgccgggucugauguagacaucgauauggcauucauucuagacagugcugagaccaccacgcucuuccaguucaacgagaugaaaaaguauaucgcguaccuggucagacaacuugacaugucaccggaucccaaagccagccaacacuuugcaagaguggcugucgugcaacaugcuccuucugagagcguagacaacgcaagcaugccaccugucaagguggaguucagcuuaacugauuauggcagcaaggaaaaacuggucgauuuccuuagcaggggaaugacccaauugcaggggaccagagcccuuggcuccgccauugaguacaccauugagaauguguucgaaucugcacccaacccaagagaucuuaaaaucgugguucucaugcucaccggcgaggucccugagcagcaacuagaagaagcucagagagugauccuccaagccaaguguaaaggcuacuuuuuuguuguccuggggauuggucgcaagguaaacaucaaagagguuuauacuuuugcuucugaacccaaugacguuuuuuucaagcuggucgauaagagcacugagcugaaugaggagccucugaugcgguucgggcgacuccucccuagcuucguuucaucagaaaaugcguucuaucucucuccugacauaagaaagcaaugugacugguuccagggggaccaacccaccaaaaaccugguaaaauuuggucauaagcagguaaacgugcccaacaacguuacaucaagccccaccaguaauccggucaccacaacaaaaccugucacuaccaccaagcccguuaccaccacaacuaagccagugacuacaacuacuaaacccgugacaaucauuaaucaaccgucuguaaaaccggcagccgcuaaaccugcucccgcuaagccuguugccgccaaaccagucgccacaaagauggccaccguacgcccucccgucgcagugaagcccgcgacugcugccaaaccuguggcggcuaaacccgccgcugugcgacccccugccgcugcagcggcuaaacccguugccacaaagccagaggugccccggccucaggcagccaagccagccgcaacaaagccugcuacuacgaagcccaugguaaaaaugucacgagaaguucaggucuuugagauaaccgaaaauuccgccaagcuccacugggaaagagcagagcccccuggccccuauuucuaugaucucaccguuacauccgcgcacgaucaaucacuggugcucaagcagaauuugaccgugacagauaggguaaucgguggccuccucgccggccaaacuuaccacgucgccguggucugcuauuugagaagccaggugagagcuacauaccacgguagcuuuaguacgaagaaaucacagccucccccaccgcagccugcgcggagugcgagcaguuccacgauuaauuugauggugucuacggaaccccuugcacugacugaaacggacaucuguaaacucccaaaggaugaagggacuugccgggauuuuauacugaagugguacuaugaucccaauaccaaaagcugugccagauuuugguacggaggguguggagggaacgagaauaaauucgggagccagaaggaaugcgagaaggucugugcaccuguguuagcuaaaccaggaguuauuuccguuaugggaacauag

SEQ ID NO: 5251 - RNA, 8934 nt, Artificial Sequence
  Description of Artificial Sequence: Synthetic coding sequence
augaggaagcacaggcaccugccacuggucgcgguguuuugccucuuccuguccggguuccccacgacacacgcgcagcagcagcaggcugacguuaagaacggcgcugccgcggacaucaucuuccucgucgacaguucuuggaccauuggggaagagcauuuucaauugguacgugaguuccuuuacgacgugguuaagucacuggcugugggagagaacgauuuccacuucgcucucgugcaauucaaugggaacccacauaccgaguuccugcugaacacguacaggacaaaacaggaggucuuaucccacauaagcaauaugucguacauugguggcacaaaucagaccgguaaaggguuggaauacaucaugcagucccaccugaccaaagcggcuggcagcagagcuggggaugguguuccgcagguuaucgugguucucacugacggccacaguaaggacggccuggcuuugcccagugcagaacuuaaaagugcagacguaaacguguucgccaucggcguggaagaugccgacgagggcgcccuaaaggagaucgcgucugaaccccucaacaugcacauguuuaaucucgagaauuuuaccucgcugcacgacauagucgggaaccugguaagcugugugcacucaaguguaagucccgagcgggcaggcgacaccgagacgcugaaggacauaacagcccaggacagugcggauauuauuuuccugaucgacgguucuaauaauacagguagugugaacuucgcagugauccucgacuucuuggucaaccuuuuagaaaagcugcccaucgguacccagcaaauacgcgucggggucgugcaguuuucugacgaaccuagaaccauguuuagucuggauaccuauucuaccaaagcucaagugcugggcgcagugaaagcucugggguuugccggcggcgaacuggcaaauaucggucucgcccuggacuucgucgucgagaaucauuucacccgcgcagggggaaguagggucgaggaaggagugccacagguccuggugcugauuagcgcggguccuucgagcgacgagauaagguauggcgucguggcgcuuaagcaggcaucaguguuuucuuuugggcugggcgcccaggcagccagucgggcugagcuucagcacaucgcaacugacgacaaccuaguuuuuacagugccugaguuccguaguuuuggagaucugcaggagaaacuucuucccuauauaguggguguggcccaaagacauaucgugcugaaacccccuacgaucguuacacagguaaucgaggugaauaaaagagauaucguuuuccucguugauggcuccucggcucuggggcucgccaauuucaacgccauacgggauuuuauugcaaaagugauucagagauuagagaucggucaggaucuaauacaaguggcuguugcccaguacgcagauacagugcgcccugaauucuacuucaacacccauccaacaaaacgagaaguuauuaccgcugugaggaaaaugaaaccgcuggacggaucggcccucuauacggguagugcccucgauuuuguccgcaauaaccuauucaccuccucagcaggauaucgggcagcggaggggauccccaaacuuuugguccugaucacuggcggcaagagucuggaugaaauaagccagccugcccaggagcuuaaacguucaucuaucauggccuuugccaucggcaauaaaggugccgaccaagcagaacuggaggaaaucgccuucgauuccagucucguuuucauuccagccgaauuuagggcugccccgcugcagggaaugcuaccuggacugcuggccccauuaaggacucugucggggaccccugaagaaaguaagcgcgacauuuuguucuuauuugaugggucugcgaaccuggugggccaguuccccgugguucgcgauuuccuguacaaaaucaucgaugagcuuaaugugaaacccgaagggacaaggaucgccgucgcccaauacucagacgacgucaaaguggaaucaagguuugacgaacaucaaucuaagccagagauccucaaucugguaaaacgcaugaaaaucaaaaccggcaaggcccugaauuugggguacgcacucgacuaugcucaacguuauauuuucgucaaaucagccggcuccagaaucgaggauggcgugcugcaguuccuggucuugcugguagccggacguucuuccgaucggguagacgggcccgcuagcaaccugaagcagagcggggugguaccauuuauuuuccaagcuaagaaugccgacccugcagagcuggagcaaauuguacucucuccagccuuuauuuuagccgccgagucauugccaaagaucggggaccugcacccccagauugugaaccuauuaaagagcgugcauaauggcgccccugccccaguuuccggcgaaaaggacguugucuuccuacuagacgggucagaagggguucgcaguggauucccacuuuugaaagaauuuguccagaggguggucgagucccuugaugucggccaggaccgcgugagagucgccguuguacaguauagcgacaggacccgccccgaguuuuaucucaacucuuacaugaacaaacaggauguagugaaugccgugcgccaacugacacuacuugguggaccgacaccaaacaccggggcggcauuggaauucguccucaggaauauccuugucaguuccgcuggaucucguaucacagagggagugccccaacugcuuauagucuugacagcagaucggucgggagacgaugucaggaacccaaguguggucgugaaacgggguggagcagugcccaucggcauuggaauugggaaugcagacaucaccgaaaugcaaaccaucucguuuauuccggacuuugcugucgcaaucccuacauucagacaacugggaaccguucagcaggugaucagcgagcguguuacccaacugacuagggaggaacucucuagauugcagcccgugcuccaaccccugcccucuccaggggugggaggcaaaagagacguggucuuuuugauugacggcagccagucggcuggcccugaguuccaguauguaaggacgcugaucgaacggcuggucgauuaccuggacguuggcuucgauacaacucgugucgccguaauccaguuuagcgacgacccuaagguggaauuccugcugaaugcucacaguagcaaggaugagguucagaaugcggugcagaggcugagacccaaaggcgggaggcaaaucaaugugggcaaugcccucgaauacguaagccguaauaucuuuaagaggccgcugggaucgcggauagaagaaggcgucccccaguuccugguguugaucucaucaggcaaaucggacgaugaaguagaugacccagcagucgaacugaagcaguuuggcguugcaccauucacgauagcaagaaaugccgaucaggaggaacugguuaaaauuucccuuaguccagaguacguguucagcgucuccaccuuccgcgagcuaccgucucuugagcagaagcugcucacaccgaucacaacacucaccucagaacagauucaaaaguuacucgcuagcacacgauacccuccuccggccguggaaucggacgccgcagauauugucuuccugauagacaguucugagggaguaagacccgacggcuuugcacacauccgggauuucgugagcagaaucgugcggcggcucaacauuggaccuaguaaaguucgagugggugugguucaauucuccaacgacguuuucccugaauuuuaccugaagacuuaucguucacaggccccagucuuggaugcaaucaggcgacugaggcuucgcggggguaguccacucaacacaggaaaggcccuggaguuuguagccagaaaccucuucgugaaaagcgcaggcucccgaauugaagacggugugccacagcaucucgugcuagucuugggggggaagagccaagaugacguuuccagguucgcccagguaauucgcucuucagguaucgugucacugggcgugggagaucgaaacaucgaucggaccgaacuccagaccauaacuaacgacccccggcugguguuuacagugagagaauucagggaguugcccaauaucgaagaaagaaucaugaacucuuuuggacccuccgcugccacucccgcuccuccuggcgucgacacgccccccccauccagacccgaaaaaaagaaggccgauauuguauuucugcucgaugguucaauuaacuuccgccgcgauuccuuucaagaaguucugcgguucgucagcgaaaucgucgacacuguguaugaggauggcgacaguauucaaguaggccuggugcaguacaauuccgacccgaccgaugaauucuuccugaaagacuuuuccaccaaaagacagaucaucgacgcgaucaauaaagugguguauaaaggaggacggcacgcaaacaccaagguuggccuggaacacuugagggugaaccauuucguacccgaggccggaucucgacuggaccagcgggucccacaaaucgcuuucguaauuacagguggaaaguccguugaagacgcccaagacguuucccuggcccugacacagagaggggugaaagucuucgcuguuggcgucagaaacaucgacucagaggaggucgggaagauugcuuccaacagugcuacugcauuucgaguagggaacguucaggagcugagcgagcucuccgaacaggugcuggagacccugcacgaugccaugcacgagacauuguguccuggaguuacugaugccgcaaaggccugcaaccuggaugucauacugggguucgauggcagccgcgaucagaauguguucguggcgcaaaaaggguuugaaucuaaaguugaugccauucuuaauaggaucagucaaaugcacaggguuuccugcagcggcggcagauccccuacuguucggguuaguguaguggccaacacuccgucuggaccuguugaggccuucgacuuugacgaguaccagccagagaugcucgaaaaauuuagaaacaugcgcagccaacacccuuauguacugaccgaggauacacucaagguuuaucucaacaaauuccgacagucuucucccgauucagucaaaguagucauucauuuuaccgauggggccgacggagaccuggcugaccuccaccgggcuagugaaaaccuuagacaggagggcgugagagcucuaaucuuggucggccuugagaggguugugaaucuggaacgccuuaugcaccucgaguucggaaggggcuucauguacgaccggccucuucggcugaaccucuuagacuuggacuacgagcucgccgaacagcuggauaacaucgccgaaaaggcuugcuguggagugcccugcaaaugcucagggcagaggggagaccgagguccaaucgggaguaucgggcccaagggcaucccuggagaagauggguauagaggcuacccuggcgacgaagggggaccgggugagaggggcccaccgggcgucaaugggacacagggguuucagggcugcccaggccagagaggggucaagggaagcagaggcuuuccaggcgagaaaggcgaagugggagagaucggauuggacggacuggacggugaagauggagauaaggggcugccuggaaguagcggcgagaaagggaaccccgggcgccggggcgacaaagguccccgcggggaaaagggagaaaggggcgauguuggcauucgcggagaucccgguaacccaggccaggauagucaggagcgugggcccaagggagagaccggggaccuuggucccaugggcguaccggggagggauggggugccgggaggucccggcgagacaggcaagaauggcggauucggccgccguggaccgccaggggccaaagguaacaaaggggggccaggccagccuggauucgagggggagcagggaacccgaggagcucagggaccagccggccccgccggaccuccuggccuuauaggcgagcaggguaucucagguccucgcggcuccgggggcgcagccggagcuccuggagaaagaggccggacgggcccucucggacggaagggagagcccggggagccugguccuaaagggggcauagggaaccggggaccccggggcgagaccggcgacgacggaagagacgggguuggcuccgagggacgaagagguaagaaaggggagcgcggcuuucccggcuacccgggucccaagggaaaucccggcgagcccggucuuaauggaacuaccgggcccaagggcauuaggggacgcagaggcaacucaggcccucccgguauugugggccagaagggggauccgggauaucccggccccgccgggccaaagggaaacagaggcgauucuauagaccagugugcacucauucagaguauuaaggacaaaugcccuugcugcuaugggccacuugagugccccgucuuuccaacagaacuggcauucgcccuugacacauccgaaggggucaaucaggacacguucgguagaaugcgcgacguugugcugagcaucguaaacgaucugacuaucgcagaaucuaacuguccuaggggggcccgcguggcaguugucaccuacaacaaugagguuacaacugagauccgcuuugccgauagcaagaggaagaguguacuguuagacaagauuaagaaucugcaaguggcccugaccaguaaacaacagucccucgagaccgccaugaguuucgucgccaggaauacuuuuaaacgggucaggaacggauuucuuaugaggaaagucgcaguauuuuuuucgaacacucccacucgggccagcccgcaguuacgagaagcugucuugaaauuaagugaugcagguauuaccccccucuuccucacccgccaggaagacagacagcugaucaacgcuuuacaaauaaacaauaccgcaguuggacaugccuugguucuacccgcggggagggaccuuacagauuuccucgaaaauguucuaacgugucaugugugcuuagacaucugcaauauagaucccucaugcgguuucgguaguuggcgucccagcuuucgagauagaagggcugcugggagcgauguugacaucgacauggccuucauacucgacagugcagagacuacuacacuguuucaguucaacgaaaugaaaaaguauaucgcguaccuagugcgacaacucgacauguccccagauccgaaggcuucacagcauuuugcacgagucgccguggugcagcaugccccuuccgaauccguugacaaugcuucaaugccgccagugaagguggaauucagccugacagacuacgguagcaaggaaaagcucguagacuuucucucucgggguaugacucagcugcagggaacucgggcucugggguccgccaucgaguacacuaucgagaacguuuuugagucugcgccaaauccucgugaccugaagauagugguucugaugcugacaggugagguccccgaacaacagcuggaagaggcccagcgcgugauccuccaagcgaagugcaagggguauuuuuucgugguacucggcauagguagaaaaguuaacauuaaagaagucuacaccuuugcuucggagccuaacgauguguuuuucaaacuuguugauaagucaacagaacugaacgaagaaccucuuaugcguuuugggagacuccugccgagcuuuguguccagcgaaaaugcguuuuauuuaucgccugauauccggaagcagugcgacugguuucagggggaucaaccaacgaagaaucugguuaaguucggccauaaacaggugaacgugccuaauaaugucacuucuagcccuaccuccaacccggugaccacgaccaaaccuguuacuacuacuaagcccguuacaaccacaacuaagccugucaccaccaccaccaagccggugacaauaaucaaccagcccucuguuaaacccgcagcugcgaagcccgcgcccgcaaagccggucgcugccaaaccugucgccacaaagauggccaccguacgacccccaguggccgucaaaccugccacugccgcaaagccaguggcagcuaaaccagcugcuguucgcccuccugcggcugccgccgcaaaacccguggcuaccaaaccugaagugccacgcccccaagccgcuaagccagcagcuaccaagcccgccaccacuaagccuauggugaagaugucacgcgaagugcagguguuugagauaacagaaaauagugcuaagcugcacugggaaagagccgagcccccggguccuuauuucuaugaucugaccgucacgagcgcccaugaccagagccugguccucaagcagaaucuuacagugacagauagagucaucggggggcuuuuggcuggucagaccuaccaugucgcagucguaugcuaucugaggucacaagucagagcuacauaucaugggucuuucucaacaaagaaaagccagccuccccccccccagcccgcuaggagcgccaguagcucaacaaucaaucucaugguuuccacugaacccuuggccuugaccgagaccgauaucugcaaacugccuaaagacgaagguacaugucgggacuucauucugaaaugguacuacgaccccaacacuaaguccugugcucgcuucugguauggagggugcgggggcaaugagaacaaguucggcagucagaaggagugcgaaaaggugugcgcuccugugcuagcaaagccuggaguuauuuccguuaugggcacauag

SEQ ID NO: 5252 - RNA, 8931 nt, Artificial Sequence
  Description of Artificial Sequence: Synthetic coding sequence
augagaaagcauaggcaccuucccuugguggcaguauuuugcuuguuccuaucagguuuuccaacuacccaugcgcagcagcagcaggccgauguuaaaaacggagccgccgccgauauaauuuucuugguagauagcucuuggacaaucggugaagaacauuuucaguugguuagagaguuccuguaugauguugucaaaagccucgccguuggcgaaaacgacuuccacuucgcucuugugcaguucaacgggaauccucauacugaauuccuacugaauacauauaggacuaaacaggagguccugagccauaucagcaacaugaguuacauuggcggaaccaaucagacagguaaaggccuggaguauaucaugcagagccaucugaccaaggccgcggggagucgagccggggauggcgugccccagguaaucguggugcuuacagacggccacaguaaggacggauuggcccuaccuagcgccgagcugaagagcgcggaugucaaugucuuugcuauaggcguggaggaugcugaugagggagcccucaaggaaauugccucagagccauuaaauaugcauauguuuaaccucgagaacuuuaccucguuacaugacauugugggcaaccugguuucauguguucacuccuccgugucacccgagcgcgcuggugauaccgagacgcugaaggacaucaccguuauugaggucaacaaaagagauauuguuuuucugguggacgguucaucugcauuaggccuugccaacuuuaaugccaucagagacuucauugccaaagugauucagcgccuagaaauuggacaggaucugauacaaguggcuguagcucaauaugccgauaccguuagacccgaguucuacuucaauacccacccuaccaaacgggaggugauuacagcggucagaaagaugaagccuuuggacgggagugcauuguacacaggcagugcucuggacuucgugaggaacaaucucuuuacaagcagcgcggguuacagagcagcagaagguaucccaaaacugcugguccugauuaccgguggcaaaucgcuggacgaaauaagccaacccgcucaggagcucaagagguccaguauuauggcuuucgcgauuggcaacaaaggcgcagaccaggcagaacuagaggagaucgcuuuugauagcagccucguguucauuccggcugaauucagagcugcuccccugcaaggaaugcugccugguuugcuggcgccccugcggacccuauccggaacaccggaggugcauaguaauaagcgagacauuauuuuucuccuugauggcuccgcuaacguugggaagaccaacuucccauaugugcgggauuuuguaaugaaccucgugaacucucuugacauugggaaugacaauauucgcgugggccucguccaguuuucggauacaccugucacugaauucuccuuaaacacauaccaaacuaaaagcgauauccugggccauuuaagacaauugcagcugcaggggggguccggacucaauacaggaucagcacugagcuacguuuaugcaaaccauuucacagaggccggggggucccgaauucgcgaacacgugccucaguuacuccuccuccuuaccgcaggacaguccgaagauucuuacuuacaagcagcaaacgcauugacaagggccgggauacugacuuucugcgugggcgcaagccaggccaacaaagccgaacucgaacaaaucgccuucaacccaagucugguguaccucauggaugacuucuccucucugccugcucugccacaacagcugauucagccccugaccacauacguguccggagguguggaagaggugccacuggcacagcccgagaguaaaagagauauccuguuccuguucgacggcagcgccaaccuugugggccaguucccuguggugcgggacuuucuguacaaaaucaucgaugaguuaaacgugaaaccagaaggaacacgcaucgccguggcgcaguauagugacgacgugaaggucgaguccagauucgaugaacaucagagcaaaccagaaauucugaaccuggugaagcgaaugaagaucaaaacagggaaagccuuaaauuuaggguacgcucucgauuaugcgcagcgauauauuuucguuaagucugcgggaagucggauugaggauggcguccugcaguuccucguguugcuugucgcggggagguccuccgaucgggucgaugggccagcguccaaucuuaagcagucgggcgucguaccguucaucuuucaggcgaaaaaugcagauccugccgaauuagaacaaaucguccuguccccugccuuuauucuggcugcagaaucauugccuaagauaggagaccuccauccccaaauugugaaucuguuaaaaagugugcauaacggagcaccugcgcccgugagcggcgaaaaggacguaguguuccugcucgacgggucagaaggaguucgcagcggguuuccccugcucaaggaauuuguccagagagugguggagagccuggacgugggucaggauagagugcgcguggcaguugugcaguauucugacaggacacggccugaguuuuaucuaaauucuuauaugaauaaacaagacguggucaaugcaguuagacaacucaccuuguuaggaggacccacccccaauacuggagccgcacuggaguucguccugcgcaauauccuuguguccagcgccgggagcaggauaacagagggggucccacagcuccuaauugucuuaaccgcugacagaagcggcgaugacgugaggaaccccucagugguggugaagagagggggggccguuccgauuggaaucgguaucggaaaugccgauaucacugaaaugcagaccauuucuuucauucccgacuuugcuguugccaucccuacuuuuaggcagcuggggacaguccagcaagugaucuccgaacgcgugacacaacugacgcgcgaggagcucagcagguugcaaccagugcuccaaccucugccuagccccggcgugggcggaaagcgugauguaguguuccugauugacggcucucaaagugcuggacccgaguuucaguaugucagaacucuuauugagcgacuggucgacuaccuugaugugggguuugauacaacgaggguagcagugauucaguucagugaugaucccaagguggaauuucuuuuaaaugcacacagcagcaaagaugaggugcagaacgccguccagcggcucagaccuaaaggcggcaggcagauuaacguuggaaacgcucuugaauaugucucacgcaacauuuuuaagcgaccacucggcuccagaauagaggaagggguuccccaguuccuggugcugauaucuucagggaagagugacgaugagguggaugaccccgcaguggaacugaagcaguucggggucgccccauucaccaucgcucguaacgcagaucaagaggagcuggugaagauuucuuugagccccgaguaugucuucucagugagcacauuucgugaauuaccaucuuuagaacagaaguugcugacgccaaucacaacacugaccuccgaacagauccagaagcuccuggcguccacccgcuacccuccacccgcaguggagucugacgcugcugacaucguguuucugaucgauagcagugaaggugugcggccggaugguuuugcccacauucgagacuucgucagcagaaucguccguaggcuuaauauuggucccuccaagguucgcgugggcgugguucaguucucaaacgauguuuuucccgaauuuuaccucaagaccuaucgcucucaggcuccugugcucgacgcgauccggcgucuaagacuucgaggcggcaguccacugaauacaggaaaggcacuagaauucguggcccgcaaucuguuuguuaaaagugcuggcagccgcauagaggauggcgucccgcagcaucuggugcucguccucggcggcaagucccaggaugacgugucuagguuugcacaagugauuagaucuagugggauugugucucucggcgugggggaucgaaacaucgacaggacagagcugcagaccaucaccaacgacccgagacuggucuuuacagugcgagaguuccgcgagcugccaaauaucgaggagagaauaaugaacuccuuuggcccaagcgccgcaacgcccgccccaccuggcguggauacaccgcccccauccaggcccgaaaagaagaaagcugacaucgucuuuuugcucgacgguagcaucaauuuuagaagggauuccuuccaggagguacuccgguucguuucugaaauaguggauaccgucuaugaggauggggacuccauucaagucggccuaguccaauacaacucagacccuacggaugaauuuuuccugaaagacuucucuacuaagcggcaaauaauugacgcuaucaauaagguuguauauaaaggcggacgccaugcgaauaccaaggugggucucgagcaucugaggguaaaccauuuuguccccgaagccgguagcagacuggaccagagggugccacagaucgccuucgugauuaccgggggaaaaagcguggaagacgcccaggaugugagccuggcccucacccagcguggagugaaaguguucgccgucggugugagaaauaucgauucggaggaaguaggaaaaauugcuagcaacagugcuaccgccuuccgaguggguaacgugcaggagcuuagugagcugagugaacaaguccucgagacuuugcacgaugccaugcacgagacacuguguccgggagugaccgaugcggcuaaggccuguaaccuagaugucauuuugggcuuugauggcucccgggaucagaacguuuuuguggcucaaaagggcuucgaaucuaaaguggacgccauucuuaaccgcauuucgcagaugcacagagugucuugcuccggcggcagaucaccaaccguucgggucucaguggucgccaauacuccaucuggaccagucgaagccuuugacuuugaugaguaccagcccgagaugcucgagaaauucagaaauaugcguucacaacacccuuauguccugaccgaagauacacucaaggucuacuuaaacaaguucaggcagaguucgccggauucugugaagguggugauacacuucacugacggugccgauggggaucuggcagaucuccaccgcgcgagugaaaaccugagacaggaaggaguucgagcccucauuuugguuggacucgaacgaguuguaaaucucgagcgguugaugcaucuagaauucggucguggguucauguacgaccggccccugcgcuuaaaccugcucgaucuggauuaugaguuagccgaacaacuggauaauaucgcugaaaaggccugcugcggggugccaugcaaauguagcggccagcgcggcgacaggggcccuauuggaucaaucggaccuaaggggauccccggggaagauggcuaucggggguaccccggggacgagggaggcccaggcgagagaggucccccuggcgucaacgguacacaggguuuccaaggaugccccggacagcgcgguguuaagggaagccgcggauucccaggagaaaagggcgaggucggugaaaucgguuuggauggccuggacggugaggauggggauaagggacucccaggcucauccggggaaaaaggaaacccaggacggagaggagauaaggggccacguggggaaaagggagaacgcggcgacguggggauaagaggagacccagggaauccagggcaggauucucaggagagagggcccaaaggggagaccggugacuuaggccccaugggagugccagggcgugauggagugccuggggggccgggcgaaacugggaagaauggcggcuuuggaaggcggggccccccuggcgcuaagggaaauaagggaggcccaggucaacccggcuucgagggggaacagggaacaagaggcgcacagggcccugcaggccccgcaggcccuccuggccucauaggagagcaggggaucuccgggccccguggcagcgguggcgcugcgggggcgccuggggagcgcggccgcacugggccguuaggccggaagggagaaccuggggaaccaggcccuaaagggggcaucgguaaccgcggccccagaggagaaacuggagaugacggccgagauggcgugggaagugaaggccgucguggcaagaaaggggaaagaggcuucccaggcuaccccggaccuaagggaaauccuggagagccuggacugaacggaaccaccgguccaaaaggaauuagaggccgucguggaaauucuggccccccaggcaucgucggccagaaaggagauccaggauaucccggccccgcaggaccuaaagggaaccggggcgacuccauugaccagugcgcuuuaauccagucaauuaaggacaaaugcccgugcugcuauggaccguuggagugcccagucuuccccacugagcuggccuuugcccucgauacuuccgagggcgucaaucaagauacguuugggagaaugcgggaugucgugcucaguauugucaacgaccugacuauugccgaaaguaacugcccacgcggcgcucggguggccguggugacuuauaacaaugaaguaacgacugagauaagauuugcagauucaaaaaggaagucggugcuucucgacaagauuaaaaauuugcagguggcccuuaccucuaagcagcagagccuggaaacggcaaugagcuucgucgcccgaaacaccuucaagcggguucggaacggcuuuuuaaugaggaagguggccgucuuuuucucaaacacccccacacgggcgaguccacaacucagggaggcagugcuuaaacucucagacgcuggaaucacuccgcuguuucugacccggcaggaggacaggcagcugauaaacgcccuccagauuaauaacacugccgugggccaugcucuuguauugcccgccggccgagaucugacagacuucuuggaaaaugugcucaccugccaugugugucucgacaucugcaacaucgauccaucuugcggguuuggcucauggagaccauccuuccgagacagaagagcagccgggucagauguagauauagacauggcuuucauucuggacagcgccgagacuacaacccuguuccaguucaaugagaugaagaaauauauugccuaucucgugcgccaacucgauaugucuccagauccaaaagcaagccagcacuuugccaggguugcugugguacagcacgcaccaucugagagcguagauaacgcaagcaugccccccguaaagguggaguuuucucuaaccgauuauggguccaaggaaaaacugguggauuuccucaguagggguaugacccaauugcagggcacccgggcccuuggaagcgccauagaauacaccaucgagaauguuuuugaauccgcaccuaauccaagggauuuaaaaauagucgugcugauguugaccggagaggugccugagcaacaguuggaagaggcucagagagucauuuugcaggccaagugcaaaggguauuuuuuuguggugcucggaauaggacgaaagguuaauaucaaggagguguacacauucgcuagugagccuaaugauguguuuuucaaacugguggauaagagcaccgagcuuaaugaagagccucugaugcguuuuggccgucuacugcccucauucguuagcucugagaaugcauucuacuuaaguccugauauccgcaaacagugcgacugguuccagggcgaccagccuacaaagaaccuggucaaauucggucacaaacaggugaauguccccaacaacgucacuucuucccccacgaguaacccggugacuacaacuaagccagucaccaccacuaagccaguuaccacaacaacgaaaccugugacaacaacaacaaaacccguuacgaucaucaaucagcccagcgugaagccugcagcagcuaagccugcuccugcaaagcccgucgcugccaaaccuguggcuaccaaaauggccacuguaaggcccccugucgccgucaagcccgcuacggcagccaagccaguggcagccaaaccggcugcagugagacccccagcggccgccgccgcuaaaccgguggcaacaaagcccgaagugccuagaccacaggccgcuaaacccgcugccacgaagcccgccaccaccaagccuauggucaaaaugucccgcgaaguccaaguguuugagauuacagaaaacagugcgaagcugcauugggagagagcagagccaccugggccauauuucuaugaucuuacagucacaagcgcucacgaucaaagccucguucucaagcaaaaucucaccgugacggacagggucaucggagggcuccuggcugggcagaccuaucacguugccgucguguguuaucuccgaucucaagucagggcuacauaccacggaucuuuuucuaccaaaaagucccaaccuccccccccucagcccgcgcgcagcgcauccuccucaacuaucaaucucauggugucaaccgagcccuuggcucucacagagacagauaucuguaaacugcccaaagaugaagggacauguagagacuuuauucugaagugguacuaugaucccaacacgaaauccugcgcucgguuuugguaugguggaugcggggguaacgagaacaaguuugguagucaaaaggaaugcgagaaagucugugcacccgugcucgcgaaacccgggguaauuucaguaauggggaccuag

SEQ ID NO: 5253 - RNA, 8916 nt, Artificial Sequence
  Description of Artificial Sequence: Synthetic coding sequence
augcggaaacaccgccaccugccacucgucgcuguuuucugccucuuucugucaggauuucccacuacucacgcccaacagcaacaggcggcgcaggauucagcugauaucaucuuucugauugauggaucuaauaauacuggcucugugaauuucgcagugauccuggacuuccuggugaaucugcuggagaagcucccuauuggcacccagcaaauuagagugggggugguucaguucagcgacgaacccaggacuauguuuucgcuggauacauacucaaccaaagcccaagugcuaggcgcaguuaaggcccugggguucgcuggcggugaacucgcuaacaucggccuggccuuggacuucguuguggaaaaucacuucaccagagcuggcgggucccgugucgaagagggagugccccagguccugguauuaaucagugccggucccucgagugaugagauucgauauggcgugguggcccucaagcaggccucuguuuuuucguuugggcucggggcccaggcugcaucccgggcugaacuacaacacauugccacagaugacaaucugguguucacugugcccgaguuccggagcuucggggacuugcaggaaaaguuauugccuuauauagugggcguggcccagaggcacaucgugcuuaaacccccgacuauagugacccaagucauugaggugaacaagcgugacaucgucuuucuaguggaugguucuucagcuuuaggccucgcuaacuuuaacgcgaucagggacuucaucgccaaaguaauucagcgacucgagauaggacaggaccucauccagguggccguggcacaguaugccgauaccgugcgacccgaauuuuacuucaacacccaucccaccaagagggaggugaucacugcugugcguaaaaugaagccgcucgauggcagcgcacuuuacacuggaucagcccucgacuuugugcgcaauaaccuguucacuuccuccgcaggauauagggccgcagaaggaauaccaaaacugcucgugcuuauuacgggcgggaagagccuggaugagaucucucaaccugcccaagaacugaagcgcucuucaauaauggcguuugccaucgguaacaagggugcagaucaagccgaacuggaagaaauagccuuugauucgucccucguuuuuauaccagcugaauuccgcgccgcacccuuacaaggcaugcucccggggcuucucgcuccccugcgcacgcugucaggcacaccugaggugcacucaaacaagagagauaucauauuccuauuagaugggagugcaaacgugggaaaaacaaauuuuccuuacguucgggauuuugucaugaaucuggugaacagucucgacaucggcaaugauaauauucgggucggacucgugcaguuuagcgacacaccagugaccgaauucucccuuaacacauaccagaccaaguccgacauucugggucaccugcgccagcuccagcuccaaggcggcucuggccugaauacggguucugcguugucguauguauacgcaaaucacuucaccgaagccggcggaagcagaauucgggaacaugugccgcaguuacugcugcucuuaaccgcuggucagucugaagacucuuauuugcaggccgccaaugcccugacacgggcuggcauacuuacauucugugucggcgcuucucaggccaacaaggcugaauuggaacagauugccuuuaaucccucacucguguaucugauggaugacuucaguucccugccugcccucccgcaacaacucauacagccuuugacuacuuaugugagugggggaguggaagaggucccacuugcccagccggagagcaaacgggacaucuuguuucuguuugauggcucugccaaucuuguuggccaguuucccguagugagggauuuccuguacaaaaucaucgaugagcuaaaugucaaaccagaaggcaccaggauugcagucgcacaguacagcgacgauguuaagguagaaucccgguucgaugagcaccagucuaagccagagauacucaauuuggucaagaggaugaagauuaaaaccggcaaagcccuaaaccugggauacgcccucgauuaugcacagcgcuacauuuucgucaagagcgcaggcucacgaaucgaggacggcgugcuccaauuccuuguccucuugguagcagggagaucaucugacaggguggauggaccggcuagcaaucuuaagcagagugggguggugccguucauauuccaagcaaaaaacgccgacccugcggagcuagagcagaucguucugaguccugccuuuauccuagcagccgaaagcuugcccaaaaucggugaccugcacccacagauagugaaccugcuuaagagcgugcauaauggagcuccugcgcccguaucgggagaaaaagaugugguguucuuacuggauggguccgaagggguaagaaguggcuuuccauugcucaaagaguucgugcagagggucguggagucgcuggauguuggacaggauaggguacgagucgccguggugcaguacucagacagaacuaggcccgaguucuaccugaacagcuauaugaacaaacaggaugugguuaacgcgguaagacaguuaacucuccucggagggcccaccccuaauacgggcgccgcucuggaguuuguauugcgcaauaucuuggugucuuccgccgggagcagaaucaccgaaggggugccgcagcuucugauuguguugacugcugaucguagcggggaugauguacgcaauccaagcgucguuguaaaacggggcggcgccguucccauugguaucggcaucgggaacgccgacaucacagaaaugcagacaaucagcuuuauuccagacuuugcaguggccauaccuaccuuccgccagcugggaacaguacagcaggugaucucugagcgagucacccagcuuaccagagaagagcucucucgccuucagccugugcugcagccucugcccaguccaggggucggaggaaagcgcgauguugucuuucugauugaugggucccagagugccggaccugaguuucaguaugugaggacauugauagaaagacugguugacuaccuugauguaggauucgauaccacacggguggcgguuauacaguucagugaugacccaaagguggaguuccucuuaaacgcucauaguuccaaggacgaagugcaaaaugcaguucagagguuaaggcccaaggggggcaggcaaauuaaugugggcaaugcacucgaguaugugucaagaaauaucuuuaagagaccucugggcaguaggauagaggaaggugucccccaguuucucguccucaucuccagcggcaaaagcgaugaugaaguagacgaucccgcuguggaacugaagcaguucggugucgccccauucaccaucgcccguaacgcagaccaggaggagcuaguuaaaaucagccuuucacccgaguauguguucuccguguccacuuuuagggaacuuccaagucuggagcagaaauuacuuacccccauaacgacucugacaagugaacagauacagaaacugcuggcaucuaccagguaucccccccccgcuguggagucugaugccgcugauaucguuuuccuuauagauucuucagagggggugcguccagacggcuuugcucacauccgagacuuugugucuaggauugucagacggcucaauaucgguccuucuaagguccgaguuggggugguucaguucuccaaugauguuuuucccgaguucuauuugaagaccuaucgcagccaggcuccaguucuagacgccauuaggcgacuccgccuccgggggggaagcccacugaauacagggaaagcgcuugaguucgucgcaagaaaccuguucgucaaaagugcagggucucguauugaggauggggucccacaacauuugguucuggugcugggggggaaaucucaagaugacgugucaagguucgcgcagguaaucagaaguuccggcauugugucacugggcguuggggacagaaauauagauaggacugagcuccagaccauuacuaaugauccccgacugguauuuacagugcgcgaauucagagaauugccuaauaucgaagagcgaaucaugaacagcuucggaccuucugcugcaacaccagcuccgcccggugucgauacaccuccgcccuccaggccugaaaaaaaaaaagcagacaucgucuuucugcuggaugggaguaucaacuuccgccgggacaguuuucaggaaguauuaagauuuguaucagagauuguggacacaguguacgaagacggggacucaauucaagucggccuagugcaauacaauuccgauccgacugaugaguucuuuuuaaaggauuucucaacuaagcgccagauuaucgaugccauaaauaaaguuguguacaagggugggagacacgcaaacacuaaggucggccuggagcacuugagggugaaucauuucguuccugaagccggcucucggcuggaccaaagggugccacagaucgcauucgucauaacagggggcaagucugucgaagaugcccaggaugucucacuugcccugacccagcgaggagugaagguauuugcugugggagucaggaauaucgacucagaggagguuggcaaaaucgcaagcaacuccgcgacugcauuccgcguagggaacguucaagaacugucugagcugucugagcaaguauuagagacuuugcaugacgccaugcacgagacacucugcccaggugucacagacgccgcgaaggcgugcaaccuggaugucauccuggguuucgaugggagucgcgaucagaacguguucguggcucaaaaagguuucgaguccaagguugaugccauccugaacagaaucagucagaugcauaggguaagcuguucaggcggccggucucccacagugcgcgugucugucguugccaauaccccaagcgguccggucgaagcuuuugacuuugaugaguaccagcccgagaugcuagaaaaauuucgaaauaugagaucucaacacccuuauguguugaccgaagauacccucaaaguuuaccugaauaaauuuaggcaaucuuccccagacucagugaagguggucauccauuuuacagauggcgcagauggcgaucuugcagacuugcauagagccagcgagaaucuccgacaggagggagugcgggcacucauccucgucggccuagaaagagucguuaacuuggaacggcugaugcaucuggaguucggcaggggauuuauguacgaccgcccacuucgccuuaacuugcuggaccuggauuacgagcucgccgaacagcucgauaauaucgcagagaaggccugcugcggggugccgugcaaguguucugggcaacgcggcgaccggggucccauaggaagcaucggcccaaagggaauuccuggugaggauggguauagaggcuaucccggggaugagggcggaccuggcgaaagaggcccucccggaguuaacggaacucagggauuucaggguugucccggccagcguggaguuaaagguagcaggggcuucccaggcgagaagggagaggugggugaaaucggacuagauggauuggacggcgaggacggagauaaaggacugccugguuccagcggugagaaggguaacccuggaaggagaggggauaagggcccacguggugagaagggggaaaggggggacguugguauccgcggggauccuggaaaucccggccaagauagucaggagcgggggcccaagggggagacuggugaucuggggcccaugggcguuccugggcgagacggugucccaggcggaccuggagaaacaggcaagaacgggggauuuggacgcaggggaccgcccggagcaaaagggaauaagggcggaccaggccagcccgguuuugaaggugagcagggaacccgcggugcacaggggcccgccggaccagcuggcccccccggucugaucggagagcaggggauuuccggaccacgcgguaguggcggugcagcgggggcuccuggagagcgggggagaaccgggccucuggggcggaaaggcgagccaggcgagccaggacccaagggggguauugguaacaggggcccuaggggcgaaacgggcgaugacggucgagauggagugggaucugaggggagaagaggaaagaaaggggagaggggauuuccaggguacccgggacccaaaggcaauccuggagaaccuggccugaacgggacaacuggccccaagggcaucagaggcaggcgcgguaacagcgggccuccaggcauugugggccagaaaggagacccugguuauccuggccccgccggccccaaggguaacaggggugauuccaucgaccagugcgccuugauucagucaauuaaagacaaguguccaugcuguuauggcccauuagaauguccugucuucccaacugaguuagccuuugcccucgacacuuccgagggcgugaaucaagacacauucggcaggaugagggacgucguucuuucuaucgucaaugaucuuaccauugccgaguccaacugcccuaggggggcucguguggccgucgugacauacaauaaugagguuacuaccgagauuagauucgccgacuccaagcgaaagagcguccugcucgauaagaucaaaaaccuccagguugcacugaccaguaaacagcagagccucgagacugccauguccuucguggccagaaauaccuucaaacgcguucguaacgguuuccucaugcggaagguggcuguguucuuuaguaauacuccaaccagggcaaguccgcagcuucgcgaggcgguccugaaguuaucagacgcaggaaucacaccucuuuucuugacaagacaggaggacagacagcucauaaacgcccuacagauuaacaauacugcuguaggacacgcacuuguauuaccugcuggccgcgauuugacagauuuucuggagaauguucugacaugucacgugugccuggacaucugcaacaucgacccuucuuguggauuuggaucguggcgccccuccuucagagaccguagagcugcuggguccgacguggacaucgauauggccuucauucucgacuccgcugagacuaccacucucuuccaguucaacgaaaugaaaaaauauauugccuaucucgugcgccaguuggauaugagccccgaccccaaagcuucgcaacacuucgcccgcguugcagugguucagcacgcaccguccgaauccguggauaaugcaaguaugccacccguuaaaguggaguuuagccucacugacuaugguuccaaggaaaaacugguggauuuccugucccggggcaugacucagcuccagggaacucgagcccugggaagcgccauagaguacacaaucgagaaugucuucgaaagcgcgccaaacccucgagaucuuaaaauuguaguuuugaugcuuaccggagaggugcccgagcagcagcuugaggaggcacaacgcgucauucuucaagccaaguguaaggguuacuuuuuugugguucucgggaucggucguaaagugaacauaaaggaaguguacacauucgcgucggagcccaacgacgucuuuuucaagcuuguggacaagucuaccgaacuaaacgaagagccucugaugagauuuggccgacugcucccaucuuuugucucgagcgagaaugcauucuaucuuucccccgacauccggaaacaaugcgacugguuucagggggaucagccgaccaaaaaccucgugaaauuuggucauaagcaggugaacgugccaaauaaugugaccucuucuccaacauccaacccugugacaacaaccaagccaguuacaaccacaaagcccgucacgacuacuacuaaaccgguaacgacuacaacuaaaccugugacuaucauuaaccagccgagcgugaagcccgcugccgcaaagccagcgcccgccaagccuguagcggcaaagcccguggccaccaaaauggccacugugcgaccacccguggccguuaagccugcgaccgccgcaaaaccagucgcggccaagcccgcggccgugagaccuccggcugcagcggccgcuaaaccugucgcgacuaagccagaagugccuaggccccaagcggccaaaccugcggcaaccaagccugccaccaccaagccaauggugaagauguccagggaggugcagguguuugaaauuacggagaauucagccaaauugcacugggaacgagccgagccuccagggccauauuucuacgaccucacaguaacaucagcccacgaucaaucccugguucugaagcagaaccugaccguuacugauaggguaauuggaggacuucuggcaggucagacuuaccauguggcuguugucugcuaucuccggagucagguucgggccacauaucauggguccuucaguacaaagaaaagccagccucccccuccccaaccugccaggagcgccucaagcuccacaaucaaccugauggugaguacggagccacuugcucuuacggaaacagacauuugcaaacugcccaaggacgaggggacuugucgggauuucauacuuaagugguauuacgaucccaacacuaaguccugcgcaagguucugguaugguggcugcggagggaacgagaacaaguuuggcucgcagaaagagugcgagaagguaugugcacccguccucgcuaaacccggggugaucagugugauggguaccuag

SEQ ID NO: 5254 - RNA, 3111 nt, Artificial Sequence
  Description of Artificial Sequence: Synthetic coding sequence
augcgaaaacacagacaccucccacugguggcuguguucugccuguucuugagcggcuuccccacaacccacgcacagcaacagcaggcuguuauagaagugaacaaaagggacauugucuuccugguggaugguagcagugccuuaggacuggcaaacuucaaugcaauccgggacuuuauagccaaaguaauucagcgacucgaaaucgggcaggaccucauucagguggccguagcgcaguacgcagauacgguucggcccgaguuuuauuucaacacacaucccaccaagcgagaggugauaacagcggugcggaagaugaagccccuggauggaagcgcucuuuacaccggcucugcccucgacuucgugaggaauaaccuguuuaccagcucggcaggcuaucgggcugcugagggaauucccaaacuacucguccugauuaccggagguaaauccuuagacgagaucucacaacccgcucaggaguuaaaaagaagcucaauuauggcauucgcaaucggcaacaagggugcggaucaagccgaacuggaagaaauagccuuugauucgagccuagucuuuauucccgcugaauuccgggcugcaccgcuccaggggaugcugccggggcugcuggcaccucuucggacacucucuggaaccccagagguccacucuaauaaaagggauaucauuuuccuccuggacggaucagcaaacguuggaaagaccaauuuuccguacgugcgagacuucguuaugaaccuggucaacagccuugacaucgguaaugauaacauucggguaggucucguccaguucucggauacacccgugaccgaguucagucugaacacguaccagaccaaaucagacaucuugggccaucuucgacaacuccaacugcagggugguaguggucugaauaccggcucagcccucuccuacguguacgcuaaucauuuuacagaagcaggggguucacgaauacgggagcaugugccccagcugcuccugcugcugacagcuggacaguccgaggacagcuacuugcaggcagccaaugcucuuacacgcgccggaauucugacuuuuugcgucggagcuucccaggcuaauaaagccgagcuggagcagaucgcguucaauccuucucugguguaucugauggacgacuuuuccagucuacccgcuuugccacagcagcucauacagccauugaccaccuacguaagcggugguguggaggagguuccacuugcucaaccggagucuaaacgcgacauucuguucuuguucgacggaucagcaaacuuggugggccaguuuccugugguaagagacuuccuguacaagauuaucgaugagcucaacgugaaaccagaaggcacuagaaucgcaguugcucaguauucagacgacguuaaaguggagagucgauuugacgagcaucagucaaaaccggaaauucugaaucuggucaagcgcaugaaaaucaagaccggaaaagcccucaaucuggguuacgcucuggauuacgcccaacgcuacauauuugucaaguccgcagggucacggaucgaagauggugugcugcaguuucucguccuucugguagcuggucggaguagcgaccggguggauggaccugcuaguaaucugaaacagagugguguggugccauuuauuuuccaggcaaagaaugccgauccugcugaguuggagcaaaucgugcucagucccgccuucauccucgcagcagagucucucccaaaaaucggugacuugcauccccagaucgucaaccuccugaaaucaguccacaacggcgcgcccgcgccuguuucuggcgaaaaagaugugguuuuucuuuuagaugguagcgagggcgugcgcagcggauucccucugcuuaaagaauuuguacagagagugguggaaucucuugacguaggacaagaccgcguccgcguggcgguugugcaguacucugauaggacaaggcccgaauuuuaccugaauucauauaugaauaagcaggacgucgugaacgccgugcgucaauugacccuccugggcggacccacaccuaacacuggcgccgcacuugaauucguccucaggaauauccuggucucaucugccgggucuagaaucacggagggugugccgcaguuacuuauugucuugacggccgaucgaagcggagacgacgugaggaauccuagugugguggucaaaaggggcggagccgugcccaucggcaucggcaucggaaaugcagacauuaccgaaaugcagaccaucucuuucauucccgacuucgcuguggccauuccuacauucaggcaguuaggcacaguucagcaggucaucagcgagcgcguuacucagcuuaccagggaggagcuaucaagacugcagccuguucugcagccucucccuagccccggugugggggggaagagagacgugguguucuuaaucgaugggagucagagcgcagggcccgaguuucaguacguacgaacacugauugagcgcuugguagauuaccuggauguuggauucgacaccacgcgaguugccgugauucaauucagugacgaucccaaagucgaguuucuauugaacgcccauucaaguaaggacgaagugcagaaugccguacagagacugagacccaaggggggucgccagaucaauguugguaacgcuuuagaguacgugagccgcaauaucuuuaagagaccucugggcagcagaauugaagagggagugccgcaguuucuugugcuaauuucaucugguaagucugacgacgaagucgacgacccggcggucgagcucaaacaguuuggggucgcuccauuuaccauugcccgcaacgcugaccaagaggaacugguuaagauuucacugagcccugaauacgucuuuuccguguccacauuccgugagcugccaagucuugaacagaaauuauugacaccuauaaccacccugacgucggaacaaauccaaaaauuguuagccuccacacgauaccccccgccuggugaaaugggggcauccgaagugcuucugggcgcuuuuuccaucuag

SEQ ID NO: 5255 - RNA, 8916 nt, Artificial Sequence
  Description of Artificial Sequence: Synthetic coding sequence
augaggaagcacagacaucugccacugguggcuguauuuugccuguuccugaguggcuuccccaccacccacgcccagcagcagcaggcagcccaagacuccgcagauaucauauuuuuaauugacggcagcaacaauaccggcucggucaauuucgcaguuaucuuagacuucuuagugaaccugcuggaaaaguuaccuaucggcacacaacagaucagggugggaguaguccaauuuagcgaugagccuagaacaauguuuagccucgacacauauuccacuaaagcccaggugcugggcgcuguuaaagcucugggguuugcagggggcgagcucgccaauaucggccucgcucucgauuucguuguggaaaaucacuucacuagggccgggggcucccggguagaagagggcgugccgcagguccugguucucauuagcgccgguccuagcagcgaugaaauuagauacggagucgucgcauugaaacaagccucagucuuuucuuuuggccucggggcacaagccgcuucuagagcugaguugcagcauaucgccacagacgacaaccugguuuucacuguuccugaguuuagaucauucggagaccugcaggaaaagcuucugccguauaucguggggguggcucagcgccacauaguguugaaaccacccacaaucgugacacaaguaaucgaggugaauaaacgcgauauaguguuccucguggauggcucauccgccuugggacucgccaauuuuaacgcaauccgggauuucaucgcaaaggugauucaaagguuggagaucggacaagaucuaauccaaguggcugucgcacaguaugccgacacggugcguccugaauuuuacuuuaauacgcauccaacaaagcgggaggugauuaccgcugugaggaagaugaagccccucgauggaagugccuuguauacggguuccgcuuuggacuuugugaggaacaaucuuuucacaagcucugccggcuaucgggccgcagaggggauucccaagcugcuggugcucauuaccggcgguaaaucucuggacgagaucagucagccagcccaggagcuuaaaagaucaucuaucauggcuuucgccaucgggaacaaaggcgccgaccaggcagagcucgaagagaucgcauuugacuccucacucguguucauuccagcugaguuccgugcugcuccauuacaaggcaugcugccggggcuacucgcccccuugcggacgcugagcggcacaccagaagugcacucuaauaaacgcgacauaauauuccuacucgacggcucagcgaacguaggcaaaacgaacuuucccuaugugagggauuuugugaugaaucucgugaauaguuuggauaucggcaaugacaacauacgggucggccugguucaguucuccgacacaccugugacugaauuuagucugaacaccuaucagacaaaaagcgacauccuggggcaucugcgccagcuacaacugcagggggguuccggcuugaauaccggaucagcacucucauacguuuaugccaaucauuuuaccgaggccggaggaagcaggaucagggaacauguaccccagcugcugcuguugcucacugcaggacaguccgaagacucuuaccuucaggcagcaaaugcucucaccagagcugguauccucacauucugugugggcgccucccaggccaauaaggcugaauuggaacaaauugccuucaacccaagccuuguuuaucuaauggaugacuuuucaagccugcccgcucugccgcagcagcucauccagccacuuacgacauaugucucaggcggcguggaggaagugccacuggcacagccagaaagcaaaagggacauucucuuucucuucgacggaagcgcaaaccuuguaggccaauuucccguaguaagagauuuccuguacaaaauuauagacgagcucaacguuaaaccugaaggaacgcgaauugccgucgcacaguauagcgacgacgugaaaguggagucaagauucgaugagcaccagaguaaaccugagauacugaaccucgugaagcguaugaaaaucaagacggggaaggcacugaaucugggguaugcacucgauuaugcucagcgguacauuuucgugaagucagcuggcucaagaauagaagauggaguguugcaauuucuugugcugcuuguagcaggccgaucaucggauagaguggacggucccgcaucuaaccuuaaacaguccggggucgucccuuucauuuuucaagcuaaaaacgcagacccagccgaacuugaacaaauagugcugagcccagcuuuuaucuuggcagccgaaucccuuccgaaaaucggagaccuucacccacaaauugugaaccuguugaagucaguccauaauggggcccccgccccagucucaggcgagaaagacgugguguuccugcuggauggcagcgaggggguaagaagcggcuuuccccucuugaaggaguuuguccaacgggugguggaaucauuggauguuggccaagacagaguaagagucgcaguggugcaguauucagauagaacuagaccagaauucuaccugaauuccuauaugaauaagcaggauguugugaaugccguacggcaacugaccuuguugggaggcccuacgccuaauacuggugcagcucucgaauuuguucugaggaauauucuggugaguagcgccggaagccgcauaacugagggcgugccgcaacuucugauaguccucacugcagacaggaguggcgaugaugugcggaauccuuccgugguggugaagagaggaggcgcuguaccuaucgggauuggaauuggaaacgccgacauaacagaaaugcagaccaucagcuucaucccugauuuugcgguggcuauuccaaccuuucgucagcuaggcacaguucagcaaguuaucucagaaagagugacucaacugaccagagaggaauugucccgucuccaaccagugcuacagccacucccuucuccuggagucgggggaaagcgcgacguuguuuuccugauugacgguucucaauccgcaggccccgaauuucaauacguccggacucuaauugaaaggcugguggacuaucuggacgucggguucgauaccaccagaguagcugugauccaguuuucagacgacccuaaagucgaauuucuucugaacgcccacuccucuaaagacgaaguucagaaugccgugcagcgucuuagaccaaagggagggcggcagaucaacguggguaaugcccuggaguauguuucccggaacaucuuuaaacggccccugggcucccggauugaggaaggggucccucaguuccucguucucaucagcagcgggaagucagaugacgaaguggaugauccagcaguagagcugaagcaguucgggguugcuccuuuuacaaucgcccgaaacgcugaccaagaagagcucgugaagaucucucugucaccagaauacgucuuuucaguuucaaccuuccgugaacucccaucgcuagagcagaaacugcuuacaccgaucacaacucugacaagcgagcagauucagaagcuucuggcgagcacucgcuaucccccccccgccguagagagcgaugcagcagauaucguguuuuugaucgacaguuccgaaggagugcgcccagacggguuugcucauaucagagauuucgugucacgaaucguccgucggcuuaacaucggaccuaguaaagucagagugggggucguucaauucuccaaugauguguuucccgaguuuuaccuuaagacuuauaggagccaagcaccgguguuggaugcaauacgucgguugaggcuuagggguggauccccccuuaacacagggaaggcauuagaauucguagccagaaaucuguucgucaaaagcgccggcucaagaaucgaggacggcgugccucagcaccugguguugguccucggaggaaagucucaggacgaugugucuagauuugcucaggucauucgguccagcggaaucgugagccugggcgucggggaccgcaacauugaccgaaccgaauuacagacgauaacaaacgaucccagacuggucuucacgguucgcgaauuuagggaauugcccaacaucgaggagaggauuaugaacucuuucggcccaagcgccgccacgcccgcuccgccuggaguggacaccccgcccccuucacggccagaaaaaaagaaggcagauaucguguuccugcuggacggaucaaucaacuuccggcgggauucauuccaggagguauugcgcuuugugagugagaucguggacaccguguacgaagauggagacucgauccaggugggguuggugcaguacaacucugauccuaccgaugaauuuuuccugaaggauuuuuccaccaagaggcaaaucaucgacgcuauuaauaagguaguguacaaggggggucggcacgcaaauacgaagguuggccuugaacaccugcgagugaaccauuuugugccagaggcggggucccgccucgaucagagagugccccaaaucgccuucgucauuacugggggaaagagcguagaagaugcccaagaugucagcuuggcuuugacucagaggggggucaaagucuucgcugugggcguacgcaauauagauucugaggagguugguaaaauagcaucgaauagugcaacugcuuuccgcgugggaaacguccaggagcugagugagcuuagcgaacaagugcuggaaacccugcacgacgccaugcacgagaccuuaugccccgguguaacugaugcugcuaaggccuguaacuuggauguuaucuugggguucgacgguagccgcgaucagaacguauucgucgcgcaaaagggauucgagucgaaaguggaugcaauacugaauagaaucucucagaugcaucgcguguccuguagcggcggccgauccccuaccgugcgugucagcguggucgcuaauacucccucgggcccggucgaggccuuugacuuugacgaauaccagcccgaaaugcuggaaaaguuccggaacaugcggucucagcauccauauguucuuaccgaggacacacugaagguuuaccucaauaaauucagacagucaaguccagacucgguuaaagucgugauucacuucacagauggcgcugacggagaccuagcugaccuacauagagcaagcgagaacuugcgucaagagggaguacgagcuuuaauccuugugggcuuggaaaggguugucaauuuagaacgguugaugcaucucgaguucggccgcgguuucauguacgacaggccgcuccgcuugaaccugcuugaccuggacuaugaacucgcugaacaacuggacaauaucgcagagaaggcauguuguggugugccuugcaaauguagugggcaaaggggagaucgcggucccauaggaucuaucgggccgaagggaauccccggcgaggauggcuacaggggauacccuggggacgaaggaggaccuggggagaggggaccaccaggcgugaacgggacucagggcuuccagggaugcccaggacagaggggcgugaaggggucuagaggcuucccuggagagaagggagagguuggggaaauugggcuggauggccuggauggcgaagacggcgacaaaggucucccuggcaguuccggugaaaaggggaauccuggcagacgcggggacaagggaccuaggggagaaaaaggggaacggggugaugucgggauucguggcgacccuggcaacccagggcaagacagucaggagaggggucccaagggugaaacuggagaccuugggccaaugggagugccaggccgagauggagugccuggagguccgggagagaccgggaaaaaugguggguucggaaggcgcggucccccuggugcaaaggggaacaaagggggcccaggucaaccaggguuugagggugagcagggaacucgaggagcucaaggaccagccgguccagcgggcccuccaggguugauaggagaacaggguaucuccggaccuagaggaaguggaggugcggccggcgcgcccggagagcggggaagaacaggcccacuuggacgaaaaggcgaaccaggggagccgggucccaaagggggaaucggcaaccggggucccaggggagaaacgggcgaugauggucgugacggaguagggucagaaggcaggagagguaaaaaaggcgagcggggcuuuccggguuaucccgggccuaagggaaacccuggggagccgggacugaauggcaccacgggccccaaagguauccgcggacgucgcggcaacucagggcccccuggaaucguggggcagaagggcgaccccggauacccugggccagccgggccaaaaggaaauagaggugauuccauagaccagugugcacugauacagagcaucaaggauaagugucccugcuguuaugguccacuggaaugcccagucuuuccuacagaacuugcuuucgcucucgacacuucugaaggagugaaccaggacacguucggacguaugagggaugugguguuguccaucguaaaugaccuuacaauugcagaguccaauugcccccggggagcacgcguggcugugguuacauauaacaacgagguuacaacugagaucagguucgccgacucaaagaggaaaagugugcuacuggauaaaaucaaaaaucuucagguggcuuuaacuuccaaacaacagucuuuggaaacugccaugucauuuguggcucgaaauaccuucaagagagugaggaacggcuuccugaugcggaaagucgccguauucuuuucuaauacccccacgagggcaucaccccaguugagggaggccgucuuaaagcuaucagacgcuggcaucacaccucuguuccuuaccaggcaagaggaucgccagcugaucaaugcccugcaaaucaauaauacggccgugggucacgcucugguacuuccagcaggaagggauuuaacugacuuucuagagaaugugcugacuugccacguaugccuagauauaugcaacauagaucccaguugcgguuucgggaguuggcgcccuagcuuccgagaccgcagagccgcuggauccgacguugacauugacauggcuuucauccuugacucugcugaaacuacuacccucuuccaguuuaacgaaaugaaaaaauacauugcguaucucgugcgacaauuggauaugagcccugaucccaaagcuagccagcacuucgccaggguggcaguugugcaacacgcaccgagugagaguguggacaacgcuagcaugcccccaguaaaagucgaauucagccugaccgauuacggcagcaaagaaaaacugguugacuuccugagcagggggaugacucagcugcaggguacccgggcccuugggagugcaaucgaguacacaauugaaaacguguucgagagugcuccaaaucccagggaccugaagauugugguccugaugcucacgggcgaggugccugaacaacaacuggaggaggcccagagagugauccugcaggccaagugcaaggguuauuuuuuugucguacuggggaucgggcgaaaggucaacaucaaggaaguauacacauucgcuuccgaaccuaaugauguauucuucaaacucguagauaaauccaccgagcugaacgaagagccuuugaugcgauucgggcgacugcuuccgucguucguaucuagcgagaaugccuucuaucuaucuccugacauacggaagcaaugcgauugguuucagggugaccaaccuacuaaaaaccugguaaaguucggccauaaacaggugaacguucccaacaacgugaccuccagucccacuagcaauccugucacuaccacaaagccuguuaccacuaccaagcccgugacaacuacaacuaagcccgugacaacgacaacaaaaccaguuacgauuaucaaucaacccuccguaaaacccgccgcagcaaagccggccccagccaagcccguugcugccaaaccuguggcaaccaagauggcuacuguacggccacccguggcagugaagcccgcaacagccgccaaaccaguggcagcaaagccugccgcgguucgaccuccagccgccgcugcugcgaaaccaguagccaccaaaccggaggugccacgaccccaggcugcaaagccagccgcgacuaagccagcuaccacaaagccaaugguuaaaaugucaagagaggugcagguauuugagauuacugaaaacagcgccaagcuccauugggagagggcugaaccaccuggccccuacuucuacgauuugacagugaccucagcucaugaccaaagucugguguugaaacagaaucugacagugacagauagagugauugguggccuucuggcuggccagaccuaucauguugcagugguuuguuaccugcgaagccaaguucgcgcaaccuaccauggaucauuuucaacaaagaaaucacagcccccaccuccccaaccugcccgcagcgcuucuagcucuaccauaaaucuuauggugaguacagaaccccuagcguugacugagacagacaucugcaaacuccccaaggacgagggaacauguagggauuucauccugaagugguacuaugauccgaauacuaaaagcugugcaagauucugguauggcggaugcgggggaaaugaaaacaaguucggaagccagaaagagugugagaaggugugugccccgguucucgccaagccuggugugaucucggugaugggaacuuag

SEQ ID NO: 5256 - RNA, 7848 nt, Artificial Sequence
  Description of Artificial Sequence: Synthetic coding sequence
augaagauccuucugaucauuuuugugcugauaaucuggacugagacccuggccgaucagucccccgggccaggaccaguguacgcugaugugguauuucuggucgacaguagcgaccaccugggacccaagucuuuuccuuuugugaagaccuucauuaacaaaaugauuaacucacuuccaauugaggccaacaaguacagaguugcgcuugcucaguauuccgaugaguuccauucagaguuccaucucucgaccuuuaaaggccgcucuccgaugcucaaccaucuuaagaagaauuuccaguuuauuggaggcucauugcagauugguaaagcauugcaggaagcucaucguaccuauuuuucagccccaauaaacgguagagaucguaaacaguuccccccuauccuggucgugcucgcuagugcugaaucugaggaugaagucgaagaagccagcaaggcccuccagaaggauggugugaaaauaauuucuguaggcguucagaaggcgagugaagagaaccucaaagcuauggccacgucucacuuucauuuuaaccuacggaccauccgcgaucuuuccacauucucucagaauaugacacagaucauaaaggacgugacgaaguacaaggaaggcgcggucgaugcggacaugcaggugcacuuucccaucuccugccagaaagauucucuggcugaccuuguguuccuuguugacgagucacuuggcacgggaggaaaucuucggcaccugcagacuuuccuugagaacauuacuagcaguauggacgugaaagagaacuguaugcguuuaggacucaugucguacucaaacagcgcgaaaacuauuuccuuccucaaaagcagcacgacccaauccgaguuucagcagcagaucaaaaaucugucuauucagguaggaaagucaaauaccggcgccgcuaucgaucagaugagacgcgauggauuuucugagaguuauggcagcaggcgggcacagggcgugccucagaucgccgugcugguuacccaucggccauccgacgacgaagugcaugaugcugcucugaaccugagacuagaagaugugaacgucuuugcccugagcauccagggggcuaacaauacccagcuggaagagaucgugucuuacccuccugagcagaccaucuccacccucaagaguuacgcagaucuggagaccuacucaacaaaguuccuuaaaaagcugcaaaacgagauuuggagucagaucagcacuuacgccgaacagagaaaccuggauaaaacuggguguguggacacaaaagaggcagauauacauuuucugaucgauggauccagcuccauucaggagaaacaauuugaacagauuaagcgguuuaugcuggaggucacagaaauguucaguauuggaccugacaagguccggguggggguaguccaauacucggacgauacggaaguggaguuuuacaucacggacuauagcaaugacauugaucuccgcaaagccaucuuuaacaucaagcaacugaccgggggaacuuacaccggcaaggcuuuagauuauauccugcagaucaucaaaaacgguaugaaagaccguaugucuaaagucccgugcuacuuaauuguucugacagauggaaugucgaccgaucgcgugguugaaccggcaaagagguugagggccgagcaaauaacugugcacgccguugggaucggggccgccaauaaaaucgagcuccaggagaucgcugggaaagaggagaggguguccuucgggcaaaacuucgacgcucucaaaucaauuaagaacgagguggugcgugagauuugugcggagaaaggaugcgaggauaugaaagcagauaucauguuucucguugauucuucuuggagcauugguaacgaaaacuuccgcaaaaugaagaucuuuaugaaaaaccuccuuacaaaaauucagaucggagcugauaagacccagauaggcgugguucaauuuuccgauaagacuaaggaagaauuccagcugaacagauacuuuacucaacaggagauuucagaugccaucgaccgaaugucucugauuaacgaggggacuuugacugguaaggcacuuaacuuugugggucaauauuucacucacuccaaaggcgcccgccugggcgcuaagaaguuccucauccucauuaccgacggcguggcccaggacgaugugcgugauccagccaggauccugagagguaaagacgucacaauauuuucugugggcgucuauaacgcuaacagaucacaacucgaagaaauuagcggagacaguagucuggucuuucauguggagaauuucgaccaccugaaggcccuagagaggaaguuaaucuuccgugucugcgcuuugcacgauuguaagcggaucacucugcucgauguggucuuuguucuagaccauucagggucaaucaagaaacaguaucaggaucacaugaucaacuugacuauccaccuuguaaaaaaagccgacgucggacgcgaccgcguucaguucggcgcccuuaaguauagcgaccaaccaaacauucuguucuaucugaacacauacuccaaccguagugccaucauugagaaccuacggaaaaggagggacaccggagguaacacauauacagcaaaggcucugaagcaugcaaacgcccucuucacagaagaacacggauccagaauuaagcagaacgugaaacagauguuaauaguaauuaccgacggcgagucccaugaucaugaucagcugaacgacacggcacuggaauugagaaauaaagggaucaccauauucgccgucggugugggaaaggccaaccagaaagaacuugagggaauggccgggaauaaaaacaacacuaucuauguagauaacuucgacaagcugaaggauguguucacacucgugcaggaaaggauguguacagaagcaccggaagugugucacuuacaggaggcggacgucauauuucucugcgauggcucagaccggguguccaacucagacuuuguuacaaugaccacauuucugucagaucucaucgauaacuucgauauucagagccagcgaaugaaaauaggaauggcgcaguuugggagcaauuaccaaucuaucauugaguuaaagaauucacuuacuaaaacccaauggaagacgcagauccagaacgucaguaagucugggggcuuuccccggaucgauuuugcccugaagaaagucagcaauauguuuaauuugcacgcuggcggucgcagaaacgcuggaguuccacagacacuuguugugaucacgucuggggacccuagauacgaugucgcagacgcugugaagacccugaaggaccugggcauuugcgugcuuguucugggcaucggagaugucuauaaggaacaccuccuacccauuacagguaacagcgaaaaaauaaucacauuccaagacuuugacaagcugaaaaaugucgaugucaaaaagaggauuaucagggaaauuugccaauccugugggaagacuaauuguuucauggauauagucgucggguuugacauuucaacccaugugcaaggacagccacuuuuucagggccacccucagcuugaguccuaucuccccggcauuuuggaggauauuucaucaaucaagggcgucagcugcggugcugguacagaggcacagguaucuuuagcauuuaaaguuaacagcgaucaaggauucccggccaaguuucagauuuaccagaaggcgguguucgacucacugcuccaaguaaacgucucugggccaacucaucuuaaugcccaguuuuuaagaagucugugggacaccuuuaaagacaaaagugcgucucgcggacagguucuuuugauuuuuucagacgggcugcaguccgaaucgaauaucaugcucgaaaaccagucggauagauuaagagaagcaggcuuggaugcccuucucguggucagucugaacacaacugcccaccaugaguuuucuagcuuugaauuugggaaaagauucgacuacaggacucaccugacuaucggcaugcgugaacugggaaaaaaacugagccaguaucuugguaauauugcagagcggacaugcuguugcacguuuuguaagugcccgggaauuccagguccccauggaacacggggcuuacaagcuaugaaagggucucaagggcucaaggguucgcgcggacacagaggagaagacgguaaccccggcguucgcggagauacaggcccucaaggggacaagggcauugcaggcuguccuggagccuggggucaaaagggacucaagggauucagugggccaaaagguggacauggggaugauggaauugaugggcuugauggcgaggaagguugccauggauuucccggaauaaaaggcgagaagggugaccccggaucccaggguucucccggcagcagaggggccccgggacaguacggagagaaaggauucccgggggacccuggcaauccugggcaaaacaacaacauaaaaggucagaaggggucaaagggggaacaggggagacaagggcgaucagggcaaaagggcguacagggcucccccuccaguaggggcucccguggacgcgagggccagcgcggccucagaggaguaaguggcgaaccaggaaacccuggcccaacagguacacugggggcggagggacugcagggaccucaggguucucagggaaaccccggaagaaagggcgagaaagggagccaggggcaaaaagguccccaggggagucccggucugaugggggcuaaaggaucaacgggacguccaggacugcuuggcaaaaaaggcgagccggggcugccaggcgaucugggaccagucggccaaacaggccagagaggcagacagggagauuccggaauccccggauacggccagaugggcaggaaaggugucaaagguccuaggggcuucccaggggacgcugggcagaaaggcgauaucggcaacccuggcaucccagggggaccgggucccaaagguuuucgcgggcuggcgcuaacugucggauuaaagggugaagaaggcagccgcgggcucccagggccuccaggucagcgggggauuaagggaauggcugggcagcccguauacagccagugcgaucuaauacgguuccuucgggagcauucgcuuuguucucuggaaaagugcccggcguaucccacugaguuaguuuucgcccucgacaauuccuaugacguuacggaagagaguuuuaauaagaccagagauauaauuaccucuauagucaaugaucugaacauccgggaaaacaacugcccagucggcgcuaggguggccaugguaagcuacaacagugguacgaguuaucucauuagaugguccgacuauaauagaaagaaacaauugcuacaacaguugucacagauuaaauaucaggauacaacagagccuagggacgugggcaaugcaaugcgguuugugacgcggaacguguucaagcguacauaugcuggcgcgaacguccgucgcguagcaguuuuuuucuccaacgggcaaaccgccagccgcuccucaaucauuacagcaaccauggaguucagugcccucgacaucucccccaccguuuucgcuuuugacgagaggguuuuucuggaggcuuuugguuucgacaauacuggaacuuuucaggugauccccguaccgccaaauggggaaaaucaaacucuggaacggcuacgcagaugugcccugugcuacgacaagugcuucccaaaugcuuguauucgcgaagcuuucuuaccugaggacucauauauggacguuguguuccucaucgauaacuccagaaauauugccaaagacgaguucaaagcagugaaagccuuggucucuucugugaucgacaauuuuaacauugcauccgacccacuuaucucagacuccggcgaucgaaucgcgcuucuuucauacagccccugggagucuaguaggagaaagaugggaacaguuaagaccgaguuugacuucaucacauaugauaaucaacuguuaaugaaaaaccacauucagacaagcuuucaacaguugaauggagaggcaaccauuggacgagcgcuucuguggacuaccgaaaauuuguucccugagacacccuaccuccggaaacacaaagucaucuuuguggucucugcaggagagaauuacgaaagaaaggaguucguuaagaugauggcccuccgggccaaaugucagggcuacgucauuuuuguaauuagccuuggaucgacgcggaaagaugauauggaagaauuggccucuuauccucuggaccaacaucuuauccagcugggaaggauacauaaaccagaucugaacuauauugccaaguuucugaagccauuccuuuauucagugcgacggggguucaaucaguacccacccccaaugcuugaggacgcuugccgccucauaaaucugggcggcgagaauauacagaacgauggauuccaguuuguuacagaacuccaagaggauuuuuugggcggaaacgguuucauuggacaggaacuaaauaguggccgagaguccccuuuugucaagaccgaggauaauggcagugauuaucugguauaccugcccucgcagauguuugagccucaaaaacugaugaucaauuaugagaaagaccagaaauccgccgaaaucgcaucccuuaccagcgggcacgagaacuacggcagaaaggaggagcccgaccauacauaugagccuggcgauguaagcuugcaggaauauuacauggacguggccuuucugaucgacgcaucucagagagugggaucugacgaauucaaagaggugaaagccuucauuacguccgucuuggauuacuuccacauugcuccuaccccuuugaccuccacacucggagaucgaguugcuguucugagcuacucaccaccuggguauaugccaaauacagaggaguguccugucuaucuugaguuugaucuggucacguauaacuccauucaccagaugaagcaccaucugcaagacucacaacaauuaaauggugacguguucauagggcacgcccuucaguggacaauugauaacgucuucgucggcacccccaaucuacgcaagaacaaagugauauuugucaucucugcgggagaaaccaauaguuuggacaaggacgugcuucggaaugugucucuccgggcuaaaugccagggcuauaguauauucguguuuuccuucgguccuaaacauaaugauaaggaacucgaagaguuagcuagucauccccuggaccaucaucuggugcagcugggccgcacccacaagccugauuggaauuauaucauuaaauucgugaaaccauucguccaccugauccggagggcaauaaacaaauaccccacugaagacaugaaggcaacaugcgugaauaugaccucaccaaaucccgaaaauggaggaaccgagaauacugugcuccugcugccaggaaucuacgaaauuaagaccgagaacggggaccuguuugaugaauucgauagccaagcgcagcaccuccugguacucgguaacaaucacuccucgggcagcgaaaccgccacugaucuuaugcaaaaacuauaccugcuguuuagcaccgagaagcuggccaugaaggacaaagagaaggcacaucuugaagagaucuccgcauuagugguggauaagcagcaggaaaaggaagauaaggaaauggaagcuaccgacauauag

SEQ ID NO: 5257 - RNA, 7848 nt, Artificial Sequence
  Description of Artificial Sequence: Synthetic coding sequence
augaaaaucuuacugaucauuuucgucuuaauuauuuggacagagacgcuggcagaccagucaccgggcccugguccagucuacgcugaugugguguuucucgucgauucuagugaucaucugggcccaaaaucauuuccauucgugaaaaccuucaucaauaagaugaucaacucucuucccaucgaggcuaacaaguacagggucgcgcuugcacaauauuccgacgaguuccacagcgaguuccaccugucuacauuuaagggucgcucuccgauguuaaaccacuugaagaagaauuuccaauuuaucggcggaagcuuacaaaucgguaaggcccuccaggaagcacacaggaccuacuuuagcgcuccaaucaauggccgagaucguaagcaauucccaccuaucuuagugguguuggccuccgcggaauccgaggacgaaguggaggaggcauccaaagcccugcagaaggacggaguuaaaaucaucuccguuggggugcagaaggcuuccgaagaaaaccugaaggccauggccaccagccauuuucacuucaaucugcgaaccauuagagaucucuccacguucagucaaaauaugacccaaaucaucaaagacguaacgaaauacaaggagggugccguggacgcugacaugcaagugcacuuuccuaucucgugucagaaagacagccuggcugauuuagucuuccucguugacgagucccuuggaaccggaggaaauuuacgacaccugcagaccuuucucgagaacauaacuaguuccauggacguaaaggaaaauuguaugcggcugggacugaugucauacucuaauagcgcaaaaacuaucagcuuucucaaaagcucaacaacacaaagcgaguuucagcaacagauuaaaaaucuaucgauccaggugggaaagucaaauacaggugcugccauagaucaaaugcgacgggaugguuucuccgaaagcuauggcucacgcagagcccagggggugccacagauagccgugcugguuacacaucguccaucugaugacgaggugcacgaugccgcacugaauuugcgccuggaagacguuaauguguucgcccucucaauccagggagcaaauaauacccagcucgaagagauugugucguauccucccgaacagaccauuuccacccuuaaaagcuacgcugaccuggagacauacucuacaaaauuucucaagaagcuucagaaugaaauuuggagccaaauuuccaccuacgccgagcagaggaacuuagacaaaaccgggugugucgauaccaaggaagcagauauccacuuucugaucgaugguaguagcucaauccaggaaaaacaguucgagcagaucaagcgguuuaugcuugaggucacagaaauguucucaauugguccugacaaaguucgaguggguguaguccaguauuccgacgacacugaggucgaguuuuauaucacugauuauucgaacgacauugaccucagaaaagcaaucuuuaauaucaagcagcucacagggggcacauauaccggcaaggcucuggauuacauacugcaaauuaucaaaaauggaaugaaagaucggaugucgaaaguaccauguuaccucaucguccuaacggacggaaugucuacagauagaguggucgagccagcaaagcgccuuagagcagagcaaaucaccgugcacgccguugggauaggggcagccaauaaaaucgaacugcaggaaaucgccgggaaggaagaacgcguuucuuuuggccagaauuucgacgcacuuaagucuauuaagaaugagguggugagggaaaucugugccgagaagggcugugaggauaugaaggcagacauaauguuccucguggacagcaguuggaguaucggaaacgaaaacuuccguaagaugaagauuuucaugaaaaaccugcucaccaaaauccagauuggcgcugacaagacucagauuggggugguacaauuuagcgacaaaacaaaagaagaguuucagcucaaccgguacuuuacccagcaggaaauuagcgacgcuaucgauagaaugucgcucaucaacgagggcacgcugacugggaaggccuugaacuuugugggacaguauuucacccacucgaaaggagcgcgacuuggggcaaagaaauuucucauccuuaucacagauggcguugcgcaggaugauguucgggauccugcaaggauacuucgaggcaaagaugugacgauauucagugucggcguauauaacgcuaaccgaagucagcuugaggagauuagcggcgacuccucccugguauuccauguggagaauuucgaccaucugaaggcccuggaacgcaagcugaucuucagggugugugcccugcaugacugcaaacgcauaacucuccucgauguaguguucgugcuggaccacuccggaaguaucaaaaagcaguaucaggaccacaugauuaaccucacuauccaucuagugaaaaaagccgacgugggucgggacagaguacaguucggagcucugaaauauucagaccagccaaauauacuguucuauuugaauacauacucuaacaggagcgcgaucauugaaaaccuccgcaagaggagagacacagggggcaacacuuauacagcaaaggcucugaagcacgcgaaugccuuguucacugaagaacauggaagcagaaucaagcaaaauguaaagcagaugcugauuguuauaacggacggagagagccaugaucaugaucagcugaacgacacggcucuggaauugaggaauaaggggaucaccaucuucgcugugggaguugggaaagcuaaccagaaggaacuagaaggaauggcggguaauaagaauaauacaauauauguggauaacuuugauaaacugaaagacguguucacuuuaguucaggaaaggauguguacggaagcaccugaggucugucaccuacaggaagcagaugucaucuuucuuugcgacggcucggaccgagugucaaacagcgauuuugucacaaugaccaccuucuuaucagaccugauugauaauuuugauauccagagccagagaaugaaaaucggaauggcccaguucgguucuaauuaccaauccauuauugagcugaagaacucccugaccaaaacucaguggaaaacacagauccagaacgugagcaagagcggagguuuccccaggauugacuuugcucugaagaaagucagcaauauguucaaccugcaugcagggggcagacgcaacgcugggguuccccagacacucgucgugaucacuuccggggauccucgauaugauguagcagacgcggucaaaacccucaaggauuuagguauuuguguuuugguccucgggauuggcgacgucuauaaggagcacuugcugccuauuacagguaauuccgagaagauuauuaccuuccaggacuucgacaaacuuaaaaacguggaugugaaaaaaagaauaauucgggagaucugucagagcugcggcaagacgaacuguuuuauggacaucgugguaggguucgacauuuccacgcauguccaaggucaaccacuguuucagggucauccucaauuggagagcuaucuuccugggauucucgaggauauuaguaguaucaagggggugucgugcggcgcaggcacugaagcacagguaucccuugccuucaaggucaacucggaucagggauuucccgccaaguuccagauuuaucaaaaagccguauuugacagccucuugcaagucaacgugagcggaccuacacaccugaacgcccaguuccugaggucuuuaugggauacuuuuaaggacaaaucugcaagucggggccagguacuucugauauucagugacggacugcaaagcgaguccaacaucaugcuggaaaaccaaucugaccgucuucgagaggccgggcucgacgcucugcuggucguuagucucaacaccacggcccaucacgaguuuucaucguuugaauucgguaaaagauucgacuaccguacccauuugacaauuggaaugagggaacuuggcaagaaguugucccaguauuugggcaacaucgcugagcggaccuguuguugcaccuuuugcaagugcccaggaaucccagguccacauggcacccgcggucugcaggcuaugaaaggcagccagggccuuaaaggaucaagaggacacagaggagaagacgggaacccuggugugaggggagauacuggaccacaaggugacaaaggaaucgccggaugccccggggcauggggccaaaagggacugaaaggauuuucugggcccaagggagggcacggagaugauggcauagaugggcucgacggggaagaaggaugccacgguuucccugguauuaaaggggagaagggggacccaggcagccaggggucaccaggcagucgaggagcgccaggccaguacggggagaaaggguuucccggugaucccgggaauccggggcagaauaauaacauuaaagggcagaagggcagcaagggcgagcaaggccgccagggucgcagcggucagaaaggagugcaggguucacccucaucucgcgguagccgugggagggaagggcaacgcggacugagggggguuucuggagagccuggcaauccagggcccaccggaacucugggagccgaaggguuacaggggccccaggggagucaagguaauccugggagaaagggggaaaagggaucucagggucaaaaggggccacagggaucgcccggauugaugggggccaagggaucaacugggagacccggccuguugggaaaaaaaggagagcccggacugcccggagacuuggguccugugggucagaccggacagagaggcagacagggcgauucagguauuccugguuauggccagaugggccgaaagggggugaaaggcccccggggcuuuccgggcgacgcaggccaaaaaggagacauuggaaaccccggcauaccagguggaccaggaccgaagggcuuccguggccuggcuuugaccgucgggcugaaaggggaggaaggaaguaggggccugcccggcccucccggccagcgugguaucaagggaauggcuggccaaccgguuuacagucaaugcgaccucaucagguuucugagggaacacucuccaugcuggaaggagaaaugccccgcauauccaacagaacuugucuucgcucuggauaacuccuaugacgugacggaagaauccuucaacaaaacacgggacaucaucaccuccauagugaacgaccucaauauucgcgagaauaacuguccggucggggcacgaguagcaaugguguccuacaacucuggcacuucauaucugauccgguggagugacuacaauaggaagaaacaguugcugcagcaacucagccagauuaaauaccaggacacaacugagccuagagauguugguaaugccaugcgcuucgugacuaggaaugucuuuaagagaacauacgcaggcgccaauguccgccggguagccguguuuuuuaguaaugggcagacagcuucuagaaguagcauuaucacugcaacuauggaguuuuccgcccuugacauuucuccaacaguguuugccuuugacgagagggucuuccucgaagcguuuggcuucgacaacacuggcacauuccaggugauccccgugccaccuaacggagagaaucagacacuugaaagauugcgucggugcgcgcuuugcuaugauaaguguuucccaaacgcgugcauccgggaggcuuuuuugccugaagauucuuacauggacgugguguuccugaucgacaauucaagaaacauugcgaaagacgaguucaaggcaguuaaagcccuaguaagcucagucaucgauaauuuuaauauagccucugauccauuaauuagugauucuggcgaccgaauugcccugcucucauauucacccugggagaguagccggcgaaaaauggguacagucaagaccgaguuugacuucaucacuuaugauaaccagcugcugaugaaaaaccacauacagacgagcuuucaacaguugaacggcgaagcaaccauuggcagagcgcuacuauggacgaccgagaaccucuuucccgaaacuccguauuuacgcaagcacaaagucaucuuugugguaucagccggcgagaauuaugaacgaaaggaguucgucaaaaugauggcccugagagccaagugucagggguaugugauauuugugauaucauugggcagcacuagaaaggaugauauggaagaauuagcaagcuauccucucgaucaacaccuuauucagcuuggacggauucauaagcccgaucugaauuauauugcuaaguuuuugaaaccauuccucuacagcguccggagagguuucaaucaguaucccccucccaugcuugaagacgccugccgacuuaucaaccuggggggggaaaacauccaaaacgacgguuuccaguuuguaaccgagcugcaggaagauuuccuuggggggaauggguucauaggccaagaacucaauucugggagagaguccccuuucguaaagacugaggacaacggcagcgauuaucugguguacuuaccuucucagauguuugaaccccagaagcucaugaucaauuacgagaaagaccagaaauccgcagagauugcuagccucacaucaggacaugaaaauuacggucggaaggaggagccagaucauaccuaugagcccggggacgugucgcuccaggaauacuauauggacguagcuuuuuugaucgaugccucacaaagagucggaucugacgaguucaaggaggucaaagcuuuuauuacuagcguccuggacuacuuccauaucgccccaaccccccucaccaguacacugggggaccgaguagcuguucucucuuacucaccuccugguuacaugcccaauacagaagagugcccgguguaucucgaauucgauuuggucacuuauaacuccauccaucagaugaaacaccaccugcaggauucccaacagcugaauggagauguguucauuggccacgcccugcaguggaccaucgacaauguguucgugggcaccccuaacuugcggaagaacaaagugaucuucgugauaucagccggagagaccaacucccuggauaaggauguucugcgcaacgugucucugagggccaagugucaggguuauuccaucuuuguguucagcuuuggcccuaaacacaacgauaaagagcuagaagaguuggccucacacccacuggaccaccaucuugugcagcuugggagaacacacaaaccggacuggaacuacaucaucaaauuugugaaaccguuugugcaccucauacguagggcuaucaauaaauacccaaccgaggacaugaaagcaaccugugugaauaugacaagcccuaaccccgagaaugguggcacagagaacaccguacuucuccugccaggcauauaugagauuaaaacugaaaauggggaucuuuucgacgaauucgacucucaagcacagcauuuguugguacuggguaauaaccacaguaguggguccgagacagcuaccgaccugaugcaaaaacucuaccugcuauucuccaccgagaagcuggcgaugaaggauaaagaaaaggcccaucuggaagaaaucucagccuuggucguagacaagcagcaagagaaggaggacaaggagauggaagccacugacauauag

SEQ ID NO: 5258 - RNA, 1674 nt, Artificial Sequence
  Description of Artificial Sequence: Synthetic coding sequence
auuggcagagccuugcucuggaccacagaaaaccuguucccugagacuccuuaccuucggaagcacaaagucauuuuugugguauccgccggcgagaauuacgagagaaaagaauucgugaagaugauggcuuugagggcaaagugucagggauauguuauuuucgugaucucccugggaaguacgagaaaagaugacauggaagaacucgcuaguuauccucuggaccaacaccugauacagcucgguagaauccacaaaccagaucuaaacuacaucgccaaauuccuuaagcccuuucucuauucuguccggcgcggauuuaaccaauauccaccgcccaugcuggaggacgcuugccggcucaucaaccugggcggcgaaaauauacagaaugauggguuccaauuuguuacagagcugcaagaggauuuccuggguggcaacgguuucauuggacaggaacugaacagcgggcgugaaucaccuuuugucaagacugaagacaacgguagcgacuaucugguuuaccuucccucccagauguucgaaccgcagaagcuaaugauuaauuaugagaaggaccaaaagucugccgagauugcaucucucacuucuggacaugagaacuacggccgcaaggaagagccugaucacacauacgagccuggggacgucucacugcaggaguauuacauggauguugccuuccuaaucgacgccucucagcgaguuggaucugaugaguuuaaagagguuaaggccuucaucaccaguguccuggauuacuuucacaucgcacccacgccucuaacaaguacccugggggauagaguagcuguuuugaguuacagcccaccaggcuacaugcccaauacagaggaguguccaguguaccuagaauucgaccuggugaccuauaauuccauccaccaaaugaaacaucaucuucaggacagucaacagcucaauggcgacgucuucauuggucacgcucugcaguggacaauugauaauguauuuguggggacaccaaacuugagaaaaaauaaggucauuuuugugauuuccgcaggcgagaccaacagucuggauaaagacgugcugaggaaugugagcuugcgcgccaaaugccagggguacagcauauuuguguucuccuucggacccaagcacaaugacaaagaacucgaggaacuagcuucgcauccucuagaucaucauuugguccagcucgggcgcacacacaagccugacuggaauuacaucauuaaauucgugaagcccuuuguacaucuuauucguagagccaucaacaaguauccaacugaggauaugaaagcaacaugcgugaacaugaccucuccuaacccagagaaugggggcaccgagaauacuguucuccugcugcccgguaucuacgagaucaaaaccgaaaauggcgacuuguuugacgaguucgauucgcaagcacagcaccuccuuguauuaggcaauaaucacagcuccgguucagagaccgccaccgaccugaugcagaagcuauaucuccuauuuucaaccgagaaauuagcaaugaaggauaaggaaaaggcacaccuggaggagaucagugcucuggucguugauaagcaacaggaaaaggaggacggcgaagacacucguucauccuag

SEQ ID NO: 5259 - RNA, 7581 nt, Artificial Sequence
  Description of Artificial Sequence: Synthetic coding sequence
augaaaauacugcugaucaucuucgugcuaauuaucuggaccgaaacucuagcagaucaaagcccuggucccggccccguauacgccgaugugguguuccuggucgauuccagcgaucaucuuggcccaaagucuuuucccuucgugaaaacauucaucaauaagaugaucaacucccuaccuauugaggccaacaaauaucguguagcacuugcccaguacagcgaugaauuccauagcgaguuucaucuguccacauucaaagggaggagcccuaugcuaaaucaccugaaaaaaaacuuccaguucauaggcggaucauugcaaauuggcaaggcccuacaggaggcucacagaacauacuucagcgccccaaucaauggcagggauaggaagcaguuuccacccaucuugguuguccuugccagugcggaaucugaggaugaggucgaggaagcuucuaaggcauuacagaaagauggcgugaagaucaucuccgugggcgugcagaaggcuucugaagaaaauuugaaggccauggcaacaucacauuuccauuuuaaccugcgcacaauccgggaccugucuacguucucccagaacaugacccagauuaucaaggaugugaccaaguauaaggagggggccguugacgcagacaugcagguccauuuccccauuagcugccagaaagacucacuggccgaccuuguuuuucugguggaugaaucauugggaacugggggcaaucugagacaccugcagacuuuccuugagaauauuaccuccucuauggaugugaaggagaauugcaugcgguugggccugaugaguuacuccaacuccgccaagacaauuuccuuccugaagagcuccaccacacaaucagaguuucagcagcagauaaagaaccuaucaauccaggucgggaaaagcaauacgggugcugccaucgaccaaaugcggagggauggcuucucugagagcuaugggucacgacgcgcucagggcguuccucaaauugcgguguuaguuacacacagacccagcgaugaugaaguucacgacgcugcauugaaccucagacuggaggauguaaaugucuuugcucucuccauccagggcgccaacaauacccaguuagaggagaucgucuccuauccacccgagcaaaccauauccacccugaagucauaugccgaccuugaaaccuauuccacuaaguucuuaaaaaagcugcagaaugaaaucuggagccaaauuaguacauacgcugaacaaagaaaccucgacaagacggguugugucgauaccaaagaggcugacauccauuuucucauugauggcucguccucuauccaggagaaacaguuugaacagauuaaaagauucaugcuggaggugaccgaaauguucucaaucggcccugacaagguaaggguggggguggugcaauauucugaugacaccgagguugaauuuuauaucacagauuauaguaacgauauugaccuccguaaggcuaucuucaacaucaagcagcugacuggcggcaccuacaccgggaaggcucuugauuacauccugcagaucaucaaaaacggaaugaaggacaggaugucuaaagugccaugcuaccugauuguguuaacugacggcaugaguaccgaccgcgucgucgagccggcaaaacgccucagagcugagcagauaaccguucacgcuguggggauuggugcugcaaauaagauagagcuccaggaaaucgcggguaaagaagaacgggucaguuucggccagaauuuugacgcacugaagaguauuaagaaugagguggugagggaaaucugcgcagagaagggaugcgaggacaugaaggccgauaucauguuccuagucgauuccucuuggagcaucgggaacgagaauuuccgaaagaugaagauauuuaugaagaaccuguugaccaaaauccagauaggggcugacaaaacccagauuggcgugguccaguuuucggacaaaaccaaagaggaauuccagcugaaucgcuacuucacgcagcaggaaaucuccgacgcuauugaucggaugagucuuaucaaugagggcacgcugacagguaaggcuuugaauuucgugggucaguauuucacacauucaaagggagccagauuaggggcuaaaaaguuucugauacuaaucacggacgggguggcccaggaugacguaagagacccugcccgcauucugcgaggaaaagacguuaccauuuuuuccgucggggucuacaacgcuaacagaucccagcuggaagagauauccggugacucaucucuggucuuccacgucgaaaauuucgaccaccugaaggcgcuggaacgcaaacugauuuuuagaguuugcgcucuacaugauuguaagcggaucacucuacuggacguuguauuugugcuugaucacucugggucuaucaagaagcaauaccaggaccacaugaucaaucuuacgauucaccugguuaagaaagccgaugugggucgugaccgaguacaguucggggcccuuaaauauucugaccagccaaauauucucuucuauuugaacacauacuccaauagaucagcaaucauagaaaaccugcggaaaagaagggacacaggcggcaacacauacaccgcgaaggcccucaagcaugcuaaugcccuguucaccgaggagcacgguagucgcaucaaacagaauguaaaacagaugcugaucgucaucaccgauggagagucccaugaucaugaccagcugaaugacacggcuuuagaguugcguaauaaaggcauaaccauuuucgccgugggugucggcaaagcgaaucaaaaagagcuggaaggaauggcaggcaacaagaacaauaccaucuacgucgacaacuucgacaaacugaaagacguguuuacucugguacaggagaggauguguaccgaggccccggaagugugccacuugcaagaggccgauguuauuuuccucugugacgguuccgacagggucuccaacagcgauuuugucacuaugacaaccuuucuuagcgaucucaucgauaauuucgauauucaaagccagaggaugaagaucggaauggcgcaguuugggucuaacuaucagagcauuauugaacugaaaaauucuuugacaaaaacccaauggaagacacaaauucagaacguuucuaagucaggaggguucccccgcauugauuucgccuuaaaaaaggugucuaacauguucaaccuccaugcggggggacggcgaaacgcuggggugccccagacucucguugucaucacuucaggcgacccacgcuacgacguagccgaugccguuaaaacucucaaagaucucggcauauguguucucgugcugggcauuggugacguuuauaaggagcaccuuuugcccauaaccggcaauagcgaaaagauuaucacauuccaggacuucgacaaacugaaaaauguggacguuaaaaagcgaaucauacgagagaucugucagucuuguggcaaaaccaauuguuuuauggacauagugguggguuucgauauuucuacgcaugugcaagggcagccucuguuccagggccacccccagcuggagagcuaccuccccgguauccucgaagacaucagcucgauuaaaggaguaaguugcggagcgggcacugaagcccaagugaguuuggcuuuuaaggugaacucugaucagggauuccccgccaaguuucagauuuaucaaaaggccguguuugacucacuccugcaggucaauguuagcggcccuacccaccuaaaugcccaguuccuuagaucccugugggauacuuucaaggacaaaucugcgagccgcggacagguccuguuaauuuucucugauggccugcaguccgaaaguaauaucaugcucgaaaaccagagugacagacugagagaagccggacuugacgcgcuccugguuguuucgcugaacacuacggcccaucacgaguucucaagcuucgaauucggaaaaagguuugacuacagaacccaucugacuauuggaaugagggagcuggggaaaaaacugucccaguauuugggcaauaucgccgagaggacaugcuguugcacuuuuuguaaaugcccuggcauuccuggcccccauggaacgaggggauuacaggcaaugaagggcagccagggacuaaaggggagccggggccaccggggggaagauggaaaccccggcgugagaggagauacugguccccagggggacaaaggaauugcuggaugucccggagcuugggggcaaaagggucugaaaggguucagcgggccgaagggagggcacggugaugauggaauugacgggcuggacggcgaagaagguugucaugguuuucccggcauuaaaggggagaagggugacccaggcucucagggaagcccaggaucuagaggagcaccaggacaauacggggaaaaaggauuuccuggggauccagguaauccagggcagaacaacaauauuaaggggcagaagggaucaaagggggagcaggguaggcagggccguucugggcaaaaagggguccaggggagcccuuccaguagggggucacgaggacgggagggccagcgugggcuuagaggagucucgggggagccaggcaaucccggcccaacugguacacuaggugcagagggccugcaggggccucaggggagccaggggaaucccgguagaaagggagaaaagggcucucaagggcagaaggguccacagggcagccccggguugaugggagccaaggguagcacaggaaggccggggcugcuuggcaagaagggggaaccagggcuccccggggacuugggucccgucggacagacgggucaaaggggccgccagggagacucaggcauacccggguauggccaaaugggaaggaaggggguaaaagggcccagaggauucccuggagaugcuggacaaaagggagauaucggaaauccaggcauuccaggcggcccagguccuaaagguuucagagguuuggcacuuacugugggcuugaaaggagaggagggaucaagggggcucccuggcccacccggacagagagguauaaaggguauggccgggcagccuguuuacucucagugugaccugauucgcuuccugcgcgagcauucucuaugcucacuggagaagugcccugccuauccuacugaacuagucuucgcgcuggacaauagcuaugaugucacugaggagucguuuaauaaaacacgcgauauaauuaccagcaucgugaacgaccugaauauaagagaaaacaauugucccgucggcgccagaguggcaauggugagcuacaacagugggacauccuaucugauucgauggucugauuacaacaggaagaaacaauugcuccagcagcugucgcagauaaaauaucaggacaccacugagccucgagacgucgguaacgcaaugagguuugugacacggaacguuuuuaaacggacauacgcuggagcuaacguuaggaggguugcaguuuuuuuuuccaacggucagacugccucuagaaguagcauaaucacugcuacaauggaauucucugccuuggacauuagccccacaguguucgcguucgacgaacgcguauuccucgaggcguuuggguucgauaacacaggcacguuccaggugauaccuguuccaccaaauggcgagaaccagacgcuggagagacuucgacggugugcucucuguuaugauaagugcuuuccaaaugccugcauccgcgaagcuuuucugccugaggacagcuacauggauguuguguuccugauugauaacagucgaaacauugcaaaagacgaguucaaggcgguuaaagcucuaguuuccucagugauugacaacuucaauauagccagcgauccucuuauuucagacuccggcgaccgcauagcacuccuaaguuacucaccuugggaaucgagcagacgcaaaaugggaaccguaaagacggaguuugacuucauuaccuaugacaaccaacuucugaugaagaaccauauccagacauccuuucagcagcugaacggugaagccacaauuggucgggcucuuuuauggacuacagaaaaccucuuuccugaaacccccuaccuccgaaaacacaagguaauuuucguuguguccgcuggugagaacuaugagaggaaggaguucgugaagaugauggcgcugcgagcgaagugucaagguuacgugauauuuguuaucucucuuggcucaacacguaaggacgauauggaggagcuagcuuccuauccccuagaucagcacuuaauucagcugggccgcauccauaagccagaucuuaauuauauugccaaguuccuaaaacccuuccucuacagugugcguagaggguuuaaucaguauccccccccaauguuagaagaugcgugccgacucauuaauuuaggcggugaaaacauccagaaugacggcuuucaguucguuacagaacuccaggaagacuuuuuaggcggaaaugguuucauaggccaggaauugaacaguggccgugaaucaccguucgugaaaacagaggauaaugguagugauuaccugguguaucugcccucucaaauguuugagccacagaagcugaugaucaauuaugagaaggaccagaagucugcagagauugccucucucaccucggggcaugaaaacuacggccggaaggaggagcccgaucauaccuacgagcccggcgacguuagccuccaagaguacuacauggacguggcuuucuuaaucgacgcaagccagcgugucggaucugacgaauucaaggaggugaaggcuuucauuacuucuguucuggacuauuuccacauugcgccgaccccgcugaccucuacccucggagaucgcguggcagugcuuagcuacucuccucccggcuacaugcccaauacugaagaaugucccguguaccuggaguucgaucugguuacuuauaauucuauccaccagaugaagcaucacuugcaggacucucagcaguuaaauggcgacguguucauuggccacgcacuccaguggaccaucgacaauguguucguaggcacgccuaaccugaggaaaaauaaagugauauucgugauaagcgcgggagagacgaauucacuggauaaggauguguugaggaauguuucccuccgggccaagugucaaggcuauagcaucuucguuuucucauuugguccuaaacacaacgacaaggagcucgaggaacuggcaucucauccucuggaucaccaccuagugcagcuagggcggacccacaagccggauuggaauuacaucaucaaguucguaaagccuuuugugcaccucauacgccgggcaauuaacaaauaccccaccgaagacaugaaagccacgugcgugaacaugacuagcccaaacccugagaacggaggcaccgagaacaccgugcuuugguag

SEQ ID NO: 5260 - RNA, 1332 nt, Artificial Sequence
  Description of Artificial Sequence: Synthetic coding sequence
aaccaauauccaccuccuaugcuggaggaugccugcagacucauuaaccugggaggcgaaaacauacagaacgacgguuuucaauuugugaccgaacugcaggaagacuuuuuaggggggaauggguuuauuggacaagaauugaacucaggcagagagucuccauucgugaagaccgaagauaacggaucagacuauuugguguaccugccuucacaaauguucgaaccacagaaacugaugauaaauuacgagaaagaucagaagucugccgagauugcuucacuuacuaguggccacgaaaauuauggccgaaaggaggagcccgaccauacauacgagcccggggauguuucauugcaggaauacuacauggacguggcguuucuuaucgacgcuucucagcgagucggcucagaugaauuuaaggagguuaaagccuucauuacuaguguuuuggacuacuuucacauagcccccaccccucugaccucuacccugggggaccgaguggcugucuugaguuacucuccacccggauauaugcccaacaccgaagagugcccuguguaccuggaguucgaccuuguuaccuacaauucuauccaucaaaugaagcaucaccuucaggauagccaacaacucaauggcgacgucuucauagggcacgcccuccaguggaccaucgauaauguauuugugggcacuccaaaccuaagaaaaaacaaagucauuuucgugaucuccgccggcgagacaaacuccuuggacaaagacgugcugaggaacgugucccuacgagcuaagugucagggguauuccauuuuuguguucucauucggcccuaagcacaaugacaaggaguuagaagaauuggccucccacccguuagaucaucaucuggugcaacuuggccggacucacaagccagacuggaacuacaucauuaaauuuguuaagcccuuugugcaucugauacgccgcgccauaaacaaauaccccacagaagauaugaaggccacuugcgugaauaugacuuccccgaaucccgagaacggugggaccgagaauaccguccugcuuuuacccggcauauaugaaauuaagacagagaacggcgaccucuuugacgaauuugacucucaagcacagcaucuguugguuuuaggaaauaaucauucaucaggcuccgagaccgccacugaccugaugcaaaaguuguaccugcuguuuagcacagaaaagcuggcuaugaaagacaaagaaaaagcccaccuggaagaaaucucugcucuuguggucgauaaacaacaggagaaggaagauuuauag

SEQ ID NO: 5261 - RNA, 6792 nt, Artificial Sequence
  Description of Artificial Sequence: Synthetic coding sequence
augaugcuucugauuuuauuccugguaauaauuugcagccacauaaguguuaaucaggauagcgguccagaguacgcugacgugguuuuucugguggauucgucagauagacuugguagcaaauccuucccuuucguaaagauguuuaucaccaagaugaucucuucacucccaauugaggccgauaaguacagaguagccuuagcacaauacagcgauaaacuucacagcgaauuccacuugucaaccuuuaagggccgaagcccuauguugaaccaucugcgaaagaauuucggauucauuggaggaucccuccaaaucgguaaggcccuacaggaggcacaccgaacuuauuucuccgcucccgccaauggacgggauaaaaaacaguuuccccccauucuggugguccuggcuaguagcgaaucugaagauaauguugaagaggcguccaaggcacuaagaaaagauggggucaaaaucaucucuguuggaguccagaaagccagcgaggagaaccugaaggccauggcuacaucgcaguuccauuucaaccucaggaccgugcgggaucuuaguauguuuagccagaauaugacucauaucauuaaggaugugauuaaauacaaggagggugccguugaugauauuuuuguggaagcuugucagggccccucaauggcagacgucguguuccuucuggauauguccaucaacggguccgaggagaauuucgauuaccugaaaggcuuccuugaagagucaguaucugcucuggauauaaaggaaaauugcaugcgggugggacuggucgccuauagcaaugagacaaaagugaucaacucacugucaaugggcaucaacaagucugaagugcugcaacauauacaaaaucugucacccaggaccggcaaagcuuacacaggagcugccaucaagaagcugaggaaggaaguauuuuccgcuaggaauggcuccagaaagaaucagggaguaccgcagaucgccguuuuggugacacaccgagacuccgaagauaacgucaccaaggccgccgucaacuugagacgggaggggguuacaauuuucacacuggggauugaaggagccuccgauacacagcuggaaaagauugcaucacacccugcggagcaauauguuuccaaacugaaaacguucgccgaccuugccgcccauaaucagacauuccucaaaaaacugagaaaccagauuacacacacuguauccgucuucuccgagaggaccgagacucugaaaucuggauguguugacaccgaggaagcugacaucuaccugcugauugauggaaguggauccacucaggcaacagauuuccaugagaugaagacuuuccugucugaggucguuggcauguuuaauaucgcaccacauaagguccgggugggcgccguccaguacgcggacagcugggaucuggaguucgagaucaauaaguauucgaacaaacaggaccuggggaaagcaauagagaacauccggcagaugggcggcaauacaaauaccggggccgcucugaauuucacacugagccugcugcagaaagcuaagaagcaaagagggaauaaggucccaugucaucuugucguccugaccaauggaaugucuaaagacagcauucuggaaccagccaaccgccuuagagaagagcacauccgcguuuacgcaaucggaauuaaggaggccaaccagacucagcugcgcgaaaucgcaggagaagagaagcgcguguacuacguccaugacuuugacgcacugaaggacaucaggaaccaggucguucaggagaucugcacggaagaagcauguaaggaaaugaaagcagacauaauguuccugguagauucauccgguucuaucggcccugagaacuucagcaagaugaaaacauucaugaaaaaucuggugucaaagucacagaucggcccagaucgaguucagauaggcgugguacaguuuucugacaucaauaaggaagaguuucaguugaacagguucaugucucagucagauauauccaacgcuaucgaccagauggcccauauuggccagacuacacugaccggaagcgccuuguccuucgugucucaauacuuuagucccaccaaaggugcccggccgaacauuaggaaguuccugauccugaucaccgacggcgaagcucaagauauaguuaaggaacccgcugugguccugcgucaagaaggcgugauuaucuauagugucgguguuuucggaagcaacguuacgcagcuggaggagauuucugggcggccugagaugguauucuacgucgaaaacuuugacauucuccaacguauugaggacgaccucguuuucggaaucugcucaccaagggaggagugcaagcguauagagguacuagauguggucuuugugauagacagcagcggcucuauugacuaugaugaguauaauauaaugaaggacuucaugauuggccugguaaaaaaggcagacguggggaaaaaucagguccgcuucggggcacugaaauaugcugacgacccugaaguguuguucuaccucgaugacuuugggacgaagcuggaggugauuuccguucuccagaacgaucaagccaugggggggucuacauacacagcagaggcauuggguuucuccgaucacauguucaccgaagccagaggcucacgacugaacaaaggugugccgcaggugcucauagucauuaccgauggugaaagccaugaugcugauaaacugaaugccaccgccaaagcucugcgcgauaaaggaauacuuguccuggcagucgggaucgauggcgcaaaccccguugaacuacucgcgauggccggcucaucagauaaguacuuuuucguugaaacuuuuggagguuugaagggaaucuucagugacgugacagcauccguguguaacucuucaaagguugacugugaaauagacaaagucgaccuggucuuucugauggaugguucaaccuccauucagccaaaugauuuuaagaagaugaaggaguucuuagccagcguggugcaagacuuugacgucucccugaaccgggugcgaaucggcgccgcucaguucucugacaccuaccaccccgaguucccgcuagggaccuuuauaggggaaaaggagauuuccuuccagaucgagaacauuaagcagaucuucgggaauacacacauuggggcugcacuucgggagguggaacacuacuuuagaccugauauggggucccgcauaaacaccggcacuccccagguucuucugguguugacugacgggcagucccaggacgagguggcucaggcagcugaagcccugcggcaucgggguauagauauuuacagcguaggaaucggugaugucgaugaccagcaauugauacagauaaccggcaccgccgaaaaaaagcugacuguucacaacuucgaugaacuuaagaaagucaacaagcgcaucguccggaacaucuguacuacugcaggcgagucuaacuguuucguggacguuguggugggauuugacgucucuacccaggaaaagggacagacgcugcucgaggggcaaccuuggauggaaaccuaccugcaagacauucugagggcgaucuccagccucaacggugugucaugugagguuggaacagagacacaggucagcguagcauuccaggucaccaacgccauggagaaguauucucccaaguucgaaauuuacuccgaaaacauacugaacagucugaaagauaucacugugaagggcccaagcuuguugaacgccaaccugcucgacucgcuaugggacacauuucagaauaaaucagcugcgagaggcaaagugguccugcucuuuuccgaugggcuagaugaugacguugaaaagcuagaacagaaaagcgaugaacugagaaaagaaggccucaacgcucucauuaccguugcgcucgauggaccugcugacuccucagaucuggcugauuugcccuacaucgaguucggaaagggcuucgaauauagaacacagcugucaauuggcaugcgagagcuaggaucucgccuuagcaaacaauuagugaacguagcugagcgaacauguugcugccuauuuuguaaaugcaucgggggggauggcacaaugggagacccugggccuccuggaaaaagagguccacccggcuucaaaggcagcgaaggauaucugggggaggagggaaucgcuggggaaaggggagcuccugguccaguuggggaacagggaacaaaggguuguuaugggacaaagggcccaaagggcaaccgcggacuuaauggccaggaaggggaagucggugagaacggcaucgauggacuuaacggcgaacaaggagacaauggccucccuggaagaaaaggggaaaaaggagacgagggaucucaaggaagcccaggaaagagaggcacacccggggacagaggugccaaaggacugcgcggggauccuggggccccuggcguagacagcuccauugagggcccuacuggguuaaaaggagagcggggacgacaaggaagacguggauggcccggaccaccagguacacccgguucuaggcggaaaacugcugcacacgggcgucggggacacacuggcccucagggaacagccggcaucccuggacccgauggucuggagggcucgcugggccucaaggggccacaaggaccucgcggcgaagccggagugaagggcgaaaaaggcgggguuggcuccaaggguccccaggguccccccgggccaggaggcgaagccgguaaccagggacgucucggcagccagggcaacaagggcgaacccggcgaccugggagagaagggggccguggguuuuccagggccccggggucugcaggguaacgauggguccccgggguauggcaguguugggagaaagggagccaaaggacaggaagguuuucccggcgaaucgggucccaaaggcgaaaucggagacccagguggccccggagagacaggccucaagggcgcucguggaaagaugaucagugcagguuugccuggcgaaaugggcucuccuggggagcccgggcccccuggccgcaaagguguaaaaggugccaaagggcuggcauccuuuucaacgugcgaauuaauacaguacguccgagaucgaucacccggccgacauggcaaaccggagugccccguacacccuacugagcuuguguuugccuuagaccacucgcgagacguaaccgagcaggaauuugagcgcaugaaagaaaugauggccuuucuggugagagauauuaaggucagggaaaauucuugcccuguuggcgcacauaucgccauucugagcuacaacucucacgcccgucaucucguccgguucucagacgccuauaagaagucacagcugcugcgagagauugagacuauccccuaugaacguucaucagccagccgcgagauuggucgggcuaugcgauucaucuccagaaacguguucaagcgaacucucccaggggcccacacccgcaaaaucgccacauucuuuuccagugggcagagcgcugacgcucauuccaucaccacagcagcuauggaauucggggcucuggaaaucauuccugucgugaucaccuuuuccaacguuccuucuguaaggagggccuucgcgauugaugacacgggcaccuuccaggucauugugguccccagcggggccgacuauauucccgcgcuggaacggcugcaacgaugcacguucugcuaugacguguguaagcccgaugcuucuugugaccaggcccggccacccccuguccagucuuauauggaugccgccuuucuccucgacgccagcaggaacaugggaucggcugaguucgaggacauucgugcuuuuuugggcgcccugcuggaucauuuugaaaucacucccgagccagagacauccgugacuggggauagggucgcacuucugagccacgcacccccugauuuccugcccaacacacagaaaucucccguuagagccgaguucaaucugaccacauauagaucaaagagacucaugaagagacacguucaugaaucagucaagcagcugaauggugacgcauuuaucgggcacgcucuccaguggacccucgacaacguguuccuguccacucccaacuugcgaagaaauaaggugauauucgugauaagugcgggugagaccucucauuuggacggggaaauacuuaagaaagagagccugcgcgccaagugucaaggauacgcucuguucguguucucauuaggcccuauuugggacgacaaggagcucgaggaucuggccucucauccacucgaccaccaucucguucaguugggccgcauccauaagcccgaccauucguaugguguaaaguucguaaaaucauuuauuaauucaaucaggagagcaaucaacaaauaccccccuauuaaucucaaaaucaagugcaaccgcuugaacuccauugauccaaagcaaccccccagaccuuuucguucuuucgugccuggcccucuuaaagccaccuuaaaggaagaugugcuccagaaggcuaaguucuuucaggacaagaaguaccugagucggguugcucggucuggccgggacgaugccauccagaacuuuaugagguccacaagucauacuuuuaagaauggaagaaugaucgagucagcaccaaaacagcaugauuag

SEQ ID NO: 5262 - RNA, 6792 nt, Artificial Sequence
  Description of Artificial Sequence: Synthetic coding sequence
augaugcucuuaauucuguuccugguuaucauuugcagccacaucaguguuaaucaggacagcggcccugaauaugcggauguugucuuccugguggauucgagugaccggcugggguccaaaagcuuuccauucgucaaaauguuuaucacaaagaugauuagcucccugccuaucgaagcagauaaauacagggucgcucuggcucaguacagcgacaaauuacauucagaguuucaccugagcacuuuuaaaggccgcucgccaaugcugaaucaucuacgaaaaaauuuuggcuucauaggcggaucccuccagaucggcaaggccuugcaggaagcucaccggacuuacuucucagcccccgcuaaugggagagauaagaagcaguuuccaccaauacuggucguucuagccuccagcgagagcgaggacaacguagaagaggccagcaaagcacucaggaaggauggagugaagaucaucucuguaggcgugcagaaggcaucggaggaaaaccugaaagcuauggccacaagccaguuccauuuuaaucucagaaccguucgcgaccugucgauguucucucagaauaugacgcacauaauaaaagacgugauaaaguauaaggagggugcuguggacgacauuuuuguagaggcuugccaagguccgaguauggccgauguagucuuccuguuggauaugucgauuaauggcagugaggaaaauuucgauuaccugaagggauuuuuggaggaaucagugagcgcauuggacauuaaagagaacugcaugcgcgugggccucguugcuuacucaaaugaaacuaaggucaucaacagccugucaaugggcauaaacaagucugaaguacuacagcauauccagaauuugagcccacggaccgggaaggcuuacacaggcgccgcaaucaaaaagcucagaaaggagguguucagugcucguaaugguucuagaaagaaucaaggagucccccagaucgccguccucgugacccaccgcgacucugaggacaacgugacuaaggccgccguuaaucuccggcgggaggguguaacuauauuuacccugggaaucgaaggggccagugauacgcagcuggagaaaaucgccucucacccugcagagcaauaugucagcaagcugaagacuuuugcugaccuugccgcgcacaaucagacauuuuuaaaaaaauuacggaaccagauuacacauacugugagcgucuuuagcgaacggaccgaaacacucaaaaguggcuguguggacacagaggaagccgauaucuaccugcuaaucgaugggagugguagcacccaggccaccgauuuucaugagaugaaaacauuucucuccgaagucgucgggauguucaacauugccccccacaaaguuagaguuggggccguccaguacgccgauuccugggaccuugaguucgagaucaacaaauacuccaacaagcaggaccucgguaaggcaaucgaaaacaucagacagaugggcggcaauacaaauaccggcgccgcacugaauuucacccuuucccugcuacagaaggcaaagaaacagagggggaauaaagugcccugccaccugguaguccugaccaaugggauguccaaagauuccauacucgagccugccaauaggcuacgcgaagaacauauacgcguuuacgcgaucggaauuaaggaggcuaaucagacacagcugagagaaaucgcaggcgaagaaaagagaguguauuauguccaugauuucgacgcauuaaaggacauucgcaaucaggucgugcaggaaauauguaccgaggaagcaugcaaagaaaugaaggcugacaucauguuucucguugauucgucuggauccauugggccugaaaacuucagcaaaaugaagacguuuaugaagaaucucgucucaaaaagucaaauuggacccgaccgaguccagauuggagucgugcaguuuagcgauauuaacaaggaagaguuucagcugaaucgauucaugagccagagcgacauuagcaaugcuauugaccaaauggcccauaucggacagaccacccuuacgggaagcgcgcucuccuucgucucucaauacuuuagccccaccaagggcgcacggccaaauauuaggaaguucuuaaucuugauuacagacggggaggcacaggauaucgugaaggaaccugccguggucuugcgccaagagggugucaucauuuacuccguugggguuuucggcucuaauguuacucaauuagaagaaaucuccggcaggccugaaauggucuucuacgucgagaacuucgacauucuacagagaaucgaggacgauuuggucuucggcauuugcaguccaagggaggaguguaagagaauugagguucuagauguggucuuugucauagacucguccgguuccaucgauuacgaugaauauaauauuaugaaggacuucaugaucggacugguuaagaaggcugaugucggcaaaaaccaggugcgcuuuggagcacugaaauacgccgacgacccugagguuuuguucuaucuagaugacuuugguacaaaacuggaggugauaucuguacugcagaaugaccaggccaugggagggagcaccuacacugcggaggcauugggguuuagcgaucauauguuuacagaagcaagaggaagucgacucaacaaaggggugccucaagugcugaucguuauuacagacggagagagucacgacgccgauaaacucaaugcuacugcgaaggcauuacgagauaaggguauucucguguuggcugugggaauugacggcgcgaacccuguggagcuccucgcgauggccgguucaucugacaaauacuuuuuuguggaaacuuucggugggcuuaaaggcaucuucuccgauguuacggccucggucugcaacagcagcaaaguggauugcgagaucgauaagguggacuugguauuucugauggacggaagcacuuccauucagcccaaugauuucaaaaaaaugaaggaguuucucgccucugugguccaggacuuugauguaucucugaacagggugcggauuggcgcugcgcaguuuuccgauacauaucacccagaguuuccgcuugguaccuuuauaggcgaaaaggagauauccuuccagauagagaacaucaaacaaauauuuggcaauacccacauuggcgcagcucuuagagaaguugaacauuauuuuagacccgacaugggaucccgcaucaauacaggcacaccucagguccugcucguccuuacugauggucagagccaggaugaggucgcucaggccgccgaagcgcugcgacaccggggaauugacauauauucuguagggauuggcgacgucgaugaucagcagcucauucagauuaccgguacugcugaaaaaaagcugacuguacauaacuucgacgaacugaagaaaguuaacaagaggauagucagaaauauaugcaccacggccggcgaguccaacugcuuuguggauguggucgugggauuugaugugagcacucaggaaaagggucagacccuucuggagggccagccuuggauggaaaccuaccuccaagacauucugagggccauuucuucguugaacgggguaucuugcgagguagggacagagacucaagugucgguagccuuccaagugacaaacgccauggaaaaguacucuccuaaguucgaaaucuauagugagaacaucuugaauagccucaaggauauuacaguaaaaggccccucgcucuugaaugcgaaccuccuugacagccugugggacacguuccagaauaagucggccgccaggggcaagguaguccugcuguucucugauggucuggacgacgaugucgagaaacuggaacagaaaagugacgagcuucggaaggagggguuaaaugcccugauuaccguggcgcucgauggaccagccgauuccucugaccucgcggacuuaccauacauugaauucggcaaaggguucgaauauagaacacagcuguccaucgguaugcgagaacuggggucccggcugagcaaacagcucgucaauguugcggaacggacaugcuguugccuuuucugcaaguguaucgggggggacggcacaaugggggaccccgggccccccggcaaacgagguccucccggcuucaagggaucggagggauaccugggggaggaggggauugccggggagcggggugccccagggccagugggagagcaggggacuaagggguguuacggcacuaagggcccuaagggcaaucgaggacucaauggacaggaaggugaggugggggaaaacgggaucgaugguuuaaacggagaacaaggcgauaacgguuuacccggacggaagggcgaaaaaggcgacgagggcucccagggcuccccgggaaaacgcggaaccccuggagauaggggugcgaaggguuuacgcggugaucccggcgcacccgggguggacucaucuauagaagggccuacaggacuuaaaggugaaaggggcagacagggccggcgcggcuggccaggccccccuggcaccccgggaucacggcggaaaacugcagcucacggacgacgcggccacacuggaccacaagggacagcugggauccccggcccugacggccucgaaggaucccugggguuaaaaggcccgcaggguccaaggggcgaggccgguguuaagggcgaaaaagguggaguuggauccaaggggccacaagggccacccggucccggaggcgaggcaggcaaccaggggagauuagggucacagggcaacaagggggaaccuggcgaccuaggggaaaagggggccguuggauucccggggccucgcggcuugcaggggaacgacggcaguccaggcuacggcuccguugguagaaagggagcuaagggucaggaaggcuucccuggggagucuggcccuaagggagagaucggcgacccuggcggcccuggugaaacaggacugaagggggcccggggcaaaaugauuagcgcuggccuccccggugagaugggauccccuggugagcccggcccuccgggccgaaaaggggugaaaggagcaaaagggcuagccucuuuuucuacaugcgaacugauccaguauguucgagaccguuccccuggucagcaucggaagccagagugucccguccauccuacagagcugguguucgcccuggaucacagccgugacgucacugaacaggaauucgagcggaugaaagaaaugauggcguuccuugugagagauaucaaaguaagggagaauucauguccagugggagcucacaucgcuauccugucauacaacagucacgcucgccauuuggucagguucucagacgccuacaaaaaaucgcagcuguugcgcgagauagagacaauccccuaugagagaucuuccgccucuagagaaaucggacgagcaaugcgguuuauaagcaggaauguguucaaaagaaccuugcccggcgcucacacgcgcaaaaucgcaacauuuuucaguaguggccagucggcagacgcccauucuauaacaaccgcugcgauggaguuuggagcuuuagaaauuauccccgugguuauuacuuucagcaauguuccuagcguucgccgggccuucgccaucgaugauacugguacguuucaagugauagucgugccuuccggagcugauuacaucccugcgcucgagcguuugcagagauguaccuuuuguuaugaugucuguaagcccgaugcaagcugugaucaggccagacccccacccgugcaaucguacauggaugcagccuuuuuauuagacgccagcagaaacaugggcagugccgaguuugaggauauucgagcguuucugggugcauuguuagaucacuuugagaucacacccgaaccagagacuaguguaacuggggauagggucgcccuccucucucacgcucccccggacuuucucccuaacacacagaagucccccguccgagccgaauucaaccugacaacuuaucgaagcaaaagacugaugaaaaggcaugugcacgaaucuguuaaacagcuuaacggcgaugcauucaucggacaugcucuucaguggacccuugauaacguguuucuuucaacccccaacuugaggcguaauaaggugauuuucgugaucagcgcaggggaaacaagccaccuagacggggagaucuugaagaaggaauccuuaagagccaagugccagggguaugcuuuauucguguuuagccuagggccaauuugggaugacaaggagcucgaagauuuggcuucucacccacuggaucaccaucuggugcagcuggguagaauccacaaaccggaucauuccuauggcgugaaguuuguaaagucguucauuaauucuauccggcgggcuauuaauaaauaucccccuauaaaccucaaaauuaagugcaaccgcuugaacucgaucgaucccaaacagccccccaggccguuccggagcuuugugccaggaccccugaaagccacguuaaaagaagacgugcuucagaaggcgaaauucuuccaggacaaaaaguaccuuucgaggguggcacgaucagggagagacgacgccauucaaaacuuuaugcgaucaaccucccauaccuucaaaaauggacgaaugaucgaaucagcccccaagcagcaugacuag

SEQ ID NO: 5263 - RNA, 5211 nt, Artificial Sequence
  Description of Artificial Sequence: Synthetic coding sequence
auggaacgguguagucgcugucauaggcugcuccuccucuugcccuugguccuuggacuguccgcagcuccuggcugggcaggagcgccccccgucgacgugcugcgggcccugcgcuuccccagucucccugauggcguaagaagagcuaaggggaucuguccugcugacguggccuaccggguagcacgaccugcccagcuguccgcucccacaagacaguuauucccugguggcuuuccuaaggauuucucucugcugacgguugugcgaacacgaccuggccuccaagcccccuuacugacucuauauagcgcucaaggagugcggcagcugggucuggagcucggaaggccuguaagguuucuuuaugaggaccagacagggagaccucaaccgcccucucaaccugucuuccggggauuaagccuggcugauggaaaguggcacaggguugccguggccgugaagggccagagugucacccugaucguggacuguaaaaaacgugucacgcgaccacucccaaggucagcuaggccuguucucgacacucacggugugauuaucuucggcgccaggauccucgacgaggagguuuuugaaggcgacgugcaggaguuggcaaucguucccggcgugcaggcugcauaugagucuugcgaacagaaggagcuugagugcgaggggggucaacgcgagcgaccacagaaccagcagccucacagagcccagcggaguccacaacagcagccaucaaggcugcacaggccacaaaaucaagagccucagagccagccuaccgaaucucucuacuacgauuacgaacccccuuauuacgacgugaugacaaccggaacgacucccgacuaccaggaccccacgccgggcgaagaagaagagauccuugaaaguagucuuuugccaccuuuggaggaggaacaaacugaccuccaggugccuccaacugccgaccgcuuucaggcugaggaauacggcgagggcgguacagauccuccagaggggccuuaugacuauacuuauggauacggagacgauuacagggaagaaacagaacucggcccagcguuguccgccgagacagcccauaguggcgcagcugcccacggccccagaggccugaaaggagaaaaaggagagcccgccgugcuggagccagggauguugguggaggguccuccaggcccagaagggcccgcaggucucauuggcccuccuggaauccagggcaaucccggccccguaggggacccuggagagcgcggcccccccggacgggccggcuuacccggauccgauggugccccuggcccuccaggaaccagccugaugcuaccauucagauucggaucaggaggcggagauaagggaccuguaguugcugcgcaagaagcccaggcucaggcaauccuccaacaggcuagguuagcacugcgaggucccccagguccaaugggcuauaccggacgcccuggcccccuagggcaaccgggcagcccaggauugaaaggagagucuggugaucugggaccacagggcccucggggcccccagggccuuaccggccccccggguaaagccggccgucgaggucgugccggggcugauggcgcucgagggaugccaggagacccaggcgugaagggggaccgaggcuuugauggacugccuggucucccuggggaaaagggccaccguggcgauacaggagcacagggucugccaggcccuccaggggaagauggcgaacguggcgaugacggggagaucggaccucgcggguugccuggggaaucggggccacgaggccuacugggaccuaaagguccgccagggaucccagggcccccaggaguccgcggcauggacgggccacaaggacccaagggaucucuggggccacagggugagccaggccccccgggucaacagggcacuccagggacacaaggacugccagggccucagggagccauuggaccucauggagagaaagguccccaaggcaagccuggacucccuggaaugcccggcuccgauggaccaccuggucaccccggcaaggaagggccuccagguacgaaagggaaccagggaccauccggcccacagggaccacugggauauccggggccaaggggggugaaggggguggacgggaucagaggccugaaaggccacaaaggcgagaaaggagaggacggguuuccaggauucaagggggauauugggguuaagggugacaggggggaggugggugucccaggaagccgcggcgaagauggcccugaaggacccaaaggaagaaccggaccuacuggcgacccagggccaccuggucuuaugggcgagaagggcaagcuuggaguuccaggccugcccggguauccgggcagacaaggucccaagggaucccucggauuuccgggauucccaggggcauccggagaaaaaggcgcucgcggccucagcggaaagagcggaccccguggggaacggggcccaacagguccuagaggucagcgcgggccaagaggcgcgacaggaaagucaggggccaaaggcacaucaggcggggacgguccccacgggccaccaggugagagagggcuuccaggaccccaggggccuaauggguuuccaggacccaaaggacccccuggcccuccaggaaaagaugggcuucccggacaucccggacaacgcggggaaguugguuuucagggcaagacaggccccccaggcccccccggcguugugggaccccagggagcugccggagaaacaggccccaugggggaacgcggucacccaggccccccuggcccucccggcgaacaaggccuacccgggacagccggcaaggaaggaacaaagggagauccgggaccaccuggcgccccuggcaaggacgguccugccggauugcgaggauuuccaggagaaagaggacugcccgggaccgccgggggaccgggacugaaaggcaaugaagggcccucugguccccccgggccagcuggcucgcccggcgagcgcggagccgcugguagcggggguccuaucggaccccccggccgaccugguccacaggggccccccggcgccgcuggagagaagggugugccuggagagaagggcccuauagggccaacugggcgagauggugugcagggcccagugggccugccuggaccggcagguccccccggcguagccggggaggauggggacaaaggcgaagugggugacccuggacagaagggcacaaaaggcaacaaaggggaacacgggccaccaggcccaccugggcccauuggcccagucggacagccuggugcugccggcgcugacggggaacccggugcucgcggcccacaggggcauuucggugcaaagggggaugaaggcaccagaggcuucaacggucccccuggcccuaucggccugcagggacuccccggcccuucaggcgaaaagggagaaaccggggacgucggucccaugggaccucccggaccaccaggaccgcgcggcccugcagggccaaauggagccgauggaccucagggcccccccggggggguugguaacuugggccccccaggcgaaaaaggcgaacccggggaaagugggagcccuggcauccagggggaaccuggugugaagggcccacguggcgaaagaggggaaaaaggagagagugggcagcccggggaacccgggcccccaggaccuaaaggcccuacuggcgaugauggacccaaagggaaucccggcccgguaggauuccccggcgauccgggacccccgggagaggguggcccccgcggacaggacggggcgaaaggagacaggggugaggauggcgagccagggcaaccuggcagcccaggaccuacaggagaaaaugggccacccggcccacuggggaagagagggcccgccggaucaccaggaucagagggucgucagggcggcaagggcgcgaaaggugacccgggagcgaucggcgcucccgguaaaaccgggccgguaggaccagcuggaccagcaggaaagccagggcccgacggccucaggggccugcccggaagcguggggcagcagggaagaccgggagccaccggccaggcuggcccacccggacccguagguccuccuggccugcccggccugagaggugacgcgggagcuaagggcgagaagggccaccccggccugaucggucucauagguccuccaggagagcagggagagaaaggagauagggguuuacccggcccacagggaaguccuggacaaaaaggggaaaugggcauacccggcgcuagcggucccaucggacccggugguccacccggucuuccgggcccggcgggaccaaagggagccaagggagcaaccggccccggcgggccaaaaggcgaaaaggggguucaagggccuccaggacauccugguccucccggggaagugauccaaccacugccgauccagaugcccaagaaaacccggcguuccguagacggcagccgccugaugcaagaagaugaagcaauaccaaccgggggcgcaccuggaucgcccggcggauuagaggagaucuucgggucucuggauagccugagagaggaaauugagcagaugcgaagaccuacaggaacccaggauucccccgccaggacuugccaggaucuuaaacucugccaucccgagcugccggacggcgaguauugggucgaccccaaucagggcugugcccgcgacgccuuuagaguguuuuguaacuucaccgcuggaggcgagaccugcguuacacccagagaugacgucacacaguucuccuauguagauucagaagguuccccggugggagucgugcaacuaacguuccugagacugcugagugugucagcccaccaggacgugucauauccuuguucgggagccgccagagacgggccauugcgccugcgaggggcaaacgaagaugaguugaguccagagacgucuccuuacgucaaagaguuccgagauggaugccagacccagcaaggacgcacgguccuagaagugaggacgccgguccuggagcaacuccccgugcuggacgccucuuucucagauuugggugccccuccacggcguggaggcgugcugcugggacccgucugcuuuauggguuag

SEQ ID NO: 5264 - RNA, 5148 nt, Artificial Sequence
  Description of Artificial Sequence: Synthetic coding sequence
auggagagguguagcaggugccaucggcugcugcucuuguugccccugguuuuggggcuuuccgccgccccuggcugggcaggugcuccgccuguugacgugcucagagcucuccgcuuuccaagccugccagacggaguuaggcgggcuaaaggaaucuguccggccgauguagcuuauagggucgcccggccagcacaguuauccgcaccgacucggcaacucuucccaggaggauucccuaaggacuuuuccuuguugacagugguacggacacgaccaggacuccaggccccacugcucacccuguauuccgcccagggcgugagacaacugggauuggagcugggcaggccugugcgcuuuuuauaugaagaccagacuggcaggccucagcccccuucucagccaguuuucagagggcugucuuuggccgacggaaaauggcauaggguagccguggcagucaagggacaguccguuacccugauagucgauugcaaaaagagagucacuaggccccugccacggagcgcccguccuguucuugauacccauggcgugaucauuuuuggagcacguaucuuggaugaggagguauuugagggcgaugugcaggaacuggcuaucgugccaggggugcaggcagcguacgaaucuugcgagcagaaagagcuugaaugcgaaggaggucagcgcgaacgcccacagaaccagcaaccccacagggcucagcggaguccucagcagcagccuagcagacugcauagaccacaaaaucaggagccccagucccagccaacugagagucuguacuacgacuaugaaccucccuauuacgaugugaugacuacagggaccacacccgauuaccaggaacaaacggaccuacaggugccaccaacugcagaucgcuuccaagccgaggaauacggcgagggcgggacugacccaccagaaggcccauacgacuacacuuauggauacggagacgauuaucgugaagaaaccgaguuggggcccgcacuaucugccgagacagcccauuccggugccgccgcgcacggaccgaggggccuaaagggggagaagggugaaccggcaguccuggagccugggauguugguugagggaccuccgggaccagaggguccugcugggcugauuggcccucccgggauucagggcaacccagguccugugggagaucccggagaacgcggccccccgggcagggccggccuuccugggagcgauggagcaccaggaccucccgggacuucacucauguugcccuuucgguucgguucgggggguggggacaaaggaccuguuguagccgcccaggaggcccaggcucaggccauccuucaacaagcgcgccuggcuuugcgaggucccccuggccccaugggguauacaggccgcccuggcccgcugggucaacccggcagucccggacugaaaggugagucaggcgaucugggcccacagggcccacgcggcccccagggacugaccggcccgccugguaaggccgggcgccgcggccgugcuggagcugacggcgcccgaggcaugccuggggaccccgguguaaaaggcgaucggggcuuugacggccuccccggccucccaggagagaaggggcauaggggggauaccggagcacagggccuucccggcccuccaggggaggacggcgagcggggugaugauggggagaucggcccgagggggcucccuggagagucugguccccgcggucuccucgguccaaagggaccacccggaauuccaggcccucccggugugcggggaauggacggaccucagggacccaagggaucauuagggccgcaaggggaaccaggcccccccgggcagcaagguacaccuggcacccaggggcugccaggaccucaaggagcuauugggccacauggugagaagggaccccagggcaagccaggccugcccggcaugccgggcagcgacggaccucccggacauccaggcaaagagggcccuccaggcacuaaggggaaucaaggcccgucagggccucaggguccacugggauacccagggccgagagggguuaaaggcgucgacgggauccggggccugaagggccauaagggcgagaagggcgaggacggcuuuccaggauucaaaggugacaucggcgugaaaggcgaccguggcgagguaggggugcccgguagucggggggaagacggaccagagggaccaaagggcagaacaggcccuacgggagauccggggccacccgggcugaugggcgaaaagggaaagcucggggucccaggccugcccggcuacccuggcagacagggacccaaaggcucccugggcuuuccaggauuccccggugccucgggugaaaagggcgcucguggauugucuggcaagucaggaccaaggggagaaagagggcccacaggacccagaggccaacggggaccacggggcgccacuggcaaaagcggcgcuaaagggacaagcgguggagauggcccucauggacccccuggagagcgcggucugcccgguccccagggccccaauggcuuuccuggcccuaagggaccucccgguccacccggaaaagacgggcugccagggcaccccggucagcggggcgaggucggauuucaggggaaaacaggcccuccuggucccccuggcguaguugguccucagggugccgccggggagacgggccccaugggugagagggggcaccccggaccaccuggaccuccuggagaacagggccucccugguacugcuggcaaagagggcacuaaaggcgauccagggccaccgggagcgcccggcaaggauggcccagcuggucuuagaggguucccuggagaacggggccugccaggcaccgcaggggggccuggcuuaaagggaaaugaggggcccucuggaccaccaggacccgcuggcucgccuggcgagaggggugccgcaggaaguggagggcccaucgguccacccgggagacccgggccccagggaccucccggagccgccggugaaaagggcguuccuggagagaaaggccccaucgguccuacagggcgcgauggcguucagggaccuguggggcuuccugggccggcgggcccccccgggguagcaggugaagacggugauaagggagaggugggagauccagggcagaaaggcaccaaagggaacaagggugagcacggaccgcccggaccgccuggaccaaucgggcccguugggcagccaggcgcagccggcgccgacggggaacccggcgcucgcggcccgcaggggcacuucggugcgaagggcgacgagggaacgagaggauucaacggcccaccagggccgauagggcuccagggucugccaggaccaaguggggagaagggggaaaccggcgaugucgggcccaugggcccuccgggcccuccagggccucguggccccgccgguccuaacggagcugacgguccccaggggccgcccggaggaguggguaaccugggcccccccggcgagaaaggcgagccaggagagucuggaucuccuggcauccaaggcgaaccuggggugaaagguccgagaggugaaagaggggagaagggugagagcgggcagccaggggagccaggacccccaggacccaaaggacccacuggagaugacggcccaaagggaaacccaggaccagugggguucccuggagacccuggcccccccggagaaggcggcccgcggggacaggacggagcaaagggagaccgcggggaagacggggagccuggacagcccggaagcccuggcccaaccggcgaaaauggccccccuggaccccuggggaagaggggcccugccggcucaccuggcagugaggggcgccaaggagggaaaggugccaagggcgaucccggcgccauuggugcaccugggaagacuggccccguuggacccgcaggccccgcugggaaacccggcccugacggacuccgcggacucccuggguccgugggacagcaggggaggccaggugccaccgggcaagccggccccccuggcccuguagguccuccuggucuucccggcuuaaggggugaugcuggcgccaaaggcgaaaagggccauccuggccuuaucgggcucaucgguccucccggcgagcagggugaaaagggugacaggggccugcccggcccucaaggcucucccggacagaagggcgagaugggcauuccgggcgcaucaggaccuauuggaccgggcggaccgccuggccuccccgggcccgcuggaccgaagggggcuaagggugcuaccgggcccggcgguccuaagggagagaaaggcgugcaggggccaccuggacaucccgguccaccuggagaggugauucagccucugcccauacaaaugccuaaaaagacgagacgaucagucgauggaagcaggcucaugcaggaagaugaggccauucccacuggcggugcuccagggagccccggaggacuggaggaaaucuucgggagcuuagauucccugcgugaggaaauagagcagaugcgaaggccgacuggcacucaggauaguccugcacguacuugucaggaucugaagcucugucacccggaacugccagauggcgaguauuggguggauccaaaccaaggaugcgcaagagaugccuucagggucuucuguaauuuuacagcagggggugagaccugugugacgcccagagacgacgucacccaauuuagcuacguggauagcgaaggcucuccugucgguguggugcagcuuaccuuccuaagacuucuaagugugagugcucaccaggacguguccuauccuugcagcggggcugcuagggacggcccccuuagacugagaggagccaacgaagaugaacugucuccagaaacuucacccuacgugaaggaguuuagagaugguugucaaacccagcaaggucggacugugcuggaagugagaaccccuguuuuagagcaacuuccaguguuagacgccucuuuuagugaucugggagcccccccaaggagaggaggcguguugcucggucccgugugcuuuaugggcuag

SEQ ID NO: 5265 - RNA, 4890 nt, Artificial Sequence
  Description of Artificial Sequence: Synthetic coding sequence
auggagagaugcucucggugucaucgacucuugcuucugcugccguugguuuuaggauugucagcugcgcccggcugggcaggugccccgccgguugacguuuugcgggcucucagguucccaucacugccugauggggugaggcgcgccaaggguauuuguccagccgacguggcauauaggguggcacgcccugcacagcuaucagccccaacacgucaguuguucccagguggcuuuccaaaagauuucucccugcuuacaguugugagaacccggccaggacugcaggccccacuuuuaacccuguauagugcccagggcgugcgucagcuagggcucgagcuuggucggccuguuagauucuuauaugaggaccagaccggccggccccaaccuccaucacagccaguguuccguggccuaucacuggccgacgggaaguggcacaggguugcuguggcugugaaagggcagagugugacgcucaucguugacugcaaaaagagagugacgcggccacuuccucgaucugcucgcccagugcuugacacacacggggugauuaucuucggagcucggaucuuagaugaggaaguguuugagggggauguccaggaacuugcaauugugccggggguucaggccgcguacgagucuugugaacagaaggagcucgagugugaaggcgggcaacgggaaagaccacagaaccagcagccgcaucgugcacaacgaucaccacagcaacagccuagccgccuccacagaccgcaaaaccaggaaccucaaucucaggcagcccauggcccccgcggacugaagggcgagaaaggcgaaccggccgugcucgaaccuggcauguugguagagggccccccagguccagaggggccugcugguuugaucgggccgccaggcauacaagguaaccccggccccguuggugaucccggagaaaggggucccccaggccgcgcaggacuucccggaagcgauggcgccccaggcccaccaggcacaagucuuaugcugccuuucagguucggguccggcggcggcgacaaggggcccguggucgcugcacaggaggcgcaggcccaggccauucuccagcaggccaggcuggcacugaggggacccccuggcccuaugggauacacuggucggcccgguccuuugggucagccugggucgccuggccucaaaggggaaaguggagaccucgggccacaggggccaagggguccccagggacugacaggcccuccgggcaaagcagggcggcgcgggcgcgccggagccgacggggcucgggguaugcccggggaucccggugucaagggggaucgaggcuuugacgggcuuccagguuugccgggagaaaagggacacagaggggacaccggugcacagggccuccccggaccacccggugaagauggagagcgaggcgacgacggggagaucgguccgagaggccugccgggggaauccggcccucgcggccugcuugguccuaagggacccccaggcaucccagguccccccggcgugaggggcauggacggaccgcagggcccuaaagggucccugggaccucagggagagccuggcccuccaggccagcaggggaccccaggcacucaaggacuccccgguccacagggagccauuggcccacacggggaaaaggggccucaggggaagcccggucuaccuggcaugccaggcucugacggaccaccaggccaccccggaaaggaggggccccccggcacuaagggaaaucaggggccaagcggaccgcaggggccacuugguuacccagggccccggggcgugaagggcgucgacgggaucagaggccugaaaggccacaagggcgaaaagggcgaagacggguuuccuggcuuuaagggcgauauuggcguaaaaggagauagaggagaggucggagugccugguucuaggggagaggacggaccagagggccccaaaggccgaacaggcccuacaggcgacccaggcccccccgggcucaugggcgaaaaaggcaaacuggggguccccggccuucccggguacccaggucgccagggcccaaaagguagccugggcuuccccggguucccaggugccagcggagagaaaggagccagaggacugucaggcaaaagugggccuagaggcgaacgcgguccaaccggaccacgcgggcagcgaggcccacggggagccacugguaaguccggcgcaaagggaacgagcgguggugacggaccacacgggcccccgggcgagagagggcucccaggaccucagggaccgaaugguuuucccggaccuaaaggaccaccaggaccccccggcaaagacggccuuccuggacaucccgggcagcgcggcgaaguggguuuccaaggcaagaccgguccgccaggcccgccaggagucguaggcccccaaggagccgcgggcgagacaggaccgaugggggaacguggccauccaggcccgcccggaccuccuggagagcagggccucccgggcaccgcaggaaaggaggguacuaagggagauccagguccucccggcgcaccuggaaaggauggaccugcugggcuacguggauucccgggcgaacguggacugccugguacagccggcggcccgggacugaaagguaacgaaggacccaguggaccgcccggucccgccgguucccccggagagcgcggugccgccggaucaggaggaccuauuggcccuccuggccggccuggcccacaggguccacccggagcagcaggcgagaagggcgugcccggagagaaagggccaauuggucccacuggcagggacggcgugcagggccccguuggucugcccgguccggcaggcccaccuggcguggcgggagaggauggugauaaaggagagguaggagacccuggacaaaaagggacaaaagggaacaagggcgaacaugggccuccaggaccuccggggccuaucgggccgguaggucagcccggagcagcuggcgcagacggggagccuggggccagggggccacaggggcauuucggugccaagggagaugaagguacucgcggguuuaacgggcccccgggcccaauaggucuccagggacugccagguccgaguggugaaaagggugagacaggugacguggggcccaugggcccaccagguccucccggcccccggggaccggccggccccaauggggccgacggcccgcaaggccccccuggagguguuggcaaucuggguccuccaggcgaaaagggcgagcccggugagucugggucgcccggcauucagggugaacccgguguuaaggggccacgaggugaacggggagagaagggcgaaagcgggcagccaggagagccaggcccccccggcccuaaaggcccuaccggcgacgacggucccaagggcaacccaggccccgugggauuucccggagacccaggacccccgggugaaggggggcccagagggcaagauggugccaaaggugaucguggcgaggauggcgaaccuggccagcccgguagcccuggcccaacaggcgaaaacgguccacccgguccacucgguaagagaggaccggccggaucuccugguucugagggccgacagggagguaagggagccaaaggcgaccccggggcuaucggugcuccuggaaagacagggcccgucgguccagcuggcccugcaggcaaacccgguccugauggccuuaggggacuaccuggauccguagggcagcagggacggccuggagccacaggccaggcugguccuccgggaccagucgguccaccgggccuacccggccugaggggggacgcuggcgccaaaggugagaagggccacccugggcucauuggccuuauagggccaccaggggaacagggugagaaaggggaccggggacuuccggggccacaggggaguccugggcagaagggggagauggguauuccuggggcaagugggccaaucggacccggggggccaccgggccuuccagggccggcagggccgaagggggcgaaaggagcuacggggccaggcgggcccaaaggcgagaaaggcguacaggggccuccagggcacccagggccaccaggcgaaguaauccaaccacucccuauacagaugcccaagaagacaagaaggaguguggacggcagcagacucaugcaggaggaugaagcaauucccacagggggggccccagggucaccgggcggccuagaggaaauauuugguucccucgauagccugagagaggaaauugagcaaaugagacgcccgacuggaacgcaggacuccccugcucggaccugucaagaucuuaagcugugucauccugagcucccugacggugaauacuggguggaccccaaccaggggugcgcgagggacgcuuucaggguuuuuugcaacuuuacagcuggaggcgagacuugcgugacuccccgcgaugaugucacacaguucuccuacguggacuccgaagguuccccagucggcgucguucagcugacuuuccucaggcugcugaguguuagugcccaccaggacgugagcuaccccuguagcggagccgcucgagacggcccucugaggcugcggggggcuaaugaagaugaauuaagcccggagacuucucccuaugucaaggaauucagagauggaugucaaacucagcagggaaggacugugcuggagguccgaaccccagucuuggaacagcucccuguuuuggacgcaaguuucuccgauuugggggcccccccaagacgcgguggcgugcuucugggcccuguauguuucaugggcuag

SEQ ID NO: 5266 - RNA, 4953 nt, Artificial Sequence
  Description of Artificial Sequence: Synthetic coding sequence
auggagcgaugcucacggugucaucggcugcugcuacuccuuccccugguucuaggucugagugcagccccuggaugggcuggcgccccaccaguugauguccugcgggcccugagguuuccuagucugccugacggcgugcggagagcaaaaggaauaugccccgcugaugucgccuaccgcguggcuaggccagcucaacucuccgcccccacuaggcaguuguuuccugguggguucccaaaagacuucagccuucugacggugguacgaacaaggccuggauugcaggcaccccuacucacguuguauagcgcacagggggugcgccagcuuggccuggaauugggccggcccgugagguuucuuuacgaagaucaaaccgggcggccgcagccucccucccagccugucuuucggggccugagccuugcugauggaaaguggcaccgcguagccguggccgugaaaggacagaguguuacccuaaucguugacugcaagaaaagggugacaagaccucugccccgcagcgcccgccccgucuuggauacccauggagugauaaucuuuggcgcccggauccuggacgaagaaguguucgagggggauguacaggagcuagccaucgugccgggcguccaggccgcuuaugaaagcugugagcaaaaggaguuggagugugaagggggucagcgcgagcguccccaaaaucagcaaccacaccgugcccagcgcucuccccaacaacagcccagccgacugcauagaccucagaaccaggaaccucaaagucaggacccuaccccuggcgaggaggaggaaauccucgagagcucguugcucccaccacuggaggaagccgcucacggcccccgcggguugaaaggagaaaagggagaacccgcaguccuggagcccggcaugcugguggaaggcccucccggcccugaaggcccagccggccuuaucgggccacccgggauucaaggaaacccgggccccgucggugacccuggagagaggggaccacccgggcgagcuggucugccaggaagcgacggcgcaccaggcccucccggaacaagcuugaugcugcccuuccguuuugguucgggugggggugauaaagggccugucguggcugcccaggaagcacaggcgcaggccauccuccaacaggcucggcuggcgcuacgcggcccaccaggaccuauggguuauaccgguagacccggaccacuuggccagccaggcucaccaggacugaagggcgaauccggugacuugggaccccagggcccucguggcccucagggauuaacuggcccucccggcaaggcgggcaggagagggagagccggggccgacggagccaggggcaugcccggcgacccagggguuaaaggagauaggggguucgacggguuaccaggccuuccuggcgagaaaggccaccgcggggauacaggagcccagggccucccaggcccacccggcgaggacggcgagcguggagacgacggggaaaucggaccucgggggcuuccaggcgaaucaggaccccgcggccugcugggccccaagggcccacccggcaucccagggccaccuggcguucgggggauggauggcccacagggcccuaagggaucguuagguccccaaggagagccuggcccuccagggcaacaaggcacccccggcacccagggccugcccgguccucagggugcuauagggccucacggggagaaaggaccgcagggcaagccaggacugccgggcaugccaggaagugacgguccuccagggcacccugggaaagaaggaccuccuggcaccaaaggcaaccaaggcccuucuggcccccaagggccucugggguauccugggccacgaggcguuaaagguguggacgguauccgaggucugaaagggcauaaaggcgaaaaaggggaggaugguuuuccaggauuuaagggcgacaucggcguuaaaggggauagaggagaggugggggugccugggucuaggggugaagacgguccagagggcccaaagggacgaaccggcccaacaggagacccgggaccccccgggcucaugggagaaaaagggaaauugggaguccccggacuaccaggauauccuggacgacagggaccaaaagggucacucggguuucccggguuucccggcgcaaguggcgagaaaggggccaggggccugagcgguaaaaguggcccuaggggcgagagaggacccaccggaccaagagggcagagggggccaagaggcgccacugggaaaucgggggcuaagggaacgucuggaggagacggaccucacgguccuccuggagagagaggcuugccagggccucaaggccccaacggcuuccccgggccaaaagggccccccggccccccagguaaagacggauuaccaggccacccagggcagagaggcgaaguugguuuccaggggaagacgggaccuccggggccuccagguguggucggcccacagggggccgccggagaaacuggccccaugggcgagcguggacaccccggcccccccggcccaccuggugaacagggguugccagggaccgcuggaaaagagggcacaaagggggaucccgguccuccaggagcaccgggaaaggauggccccgccggacugcguggcuucccuggcgagagaggccucccuggcacugccggaggcccuggccugaaaggcaaugagggaccuucaggccccccaggcccggccggauccccgggagagcggggagccgccgguucaggcgguccuauuggcccuccuggacgucccggcccacaggguccaccuggagcagcuggcgaaaaagggguacccggggagaaaggaccaaucggacccaccgggcgggacggaguucagggccccguuggucucccuggcccugcagggccucccgguguggcaggggaggauggggacaagggcgaagucggugacccuggucagaaaggcacuaaaggcaacaaaggagagcacggaccccccggacccccgggccccauugggccgguagggcagcccggagccgcaggcgcugauggggaacccggggcuaggggaccacagggccacuucggcgcaaagggggacgaaggaacucguggauucaacgggccuccugguccaaucggucugcagggacuuccaggccccucaggagagaaaggagaaaccggcgacguuggcccuaugggaccuccaggaccuccaggcccacgggguccugccgggcccaacggagcugacggcccccaggggccaccugggggggugggcaaccugggccccccaggcgaaaagggagaaccuggggaaucagggaguccaggcauucagggugagccgggcgugaaggguccccgcggugagaggggugaaaaaggcgaaucaggacagccaggggaaccagguccaccagggccaaaaggacccaccggagacgauggcccaaaaggaaauccuggacccgucggauuuccgggcgacccagggccucccggggaaggcggaccgagaggucaagacggcgcaaaaggcgaccggggagaggauggcgaaccugggcagcccggauccccuggcccaacgggcgaaaacggaccacccggaccucuggggaaacgcgggccagcaggcagucccggcagcgaagggcggcagggggggaagggugcaaaaggugaccccggugccaucggcgccccuggcaagaccgggccugugggaccugccgggccugccggcaagcccggcccagacgggcugcguggccuuccgggcagugugggccagcaggggcggccaggggccacugggcaagcagguccaccaggaccggugggcccuccuggucugccggggcuaagaggcgacgcaggagccaaaggcgagaaagggcacccaggauugauuggguugauuggcccuccaggcgagcagggagaaaagggugaccgaggucugccagguccucaaggguccccugggcagaaaggugagauggguauuccaggggccaguggccccauuggcccuggaggcccaccaggucuacccggccccgccgguccuaaaggagccaagggggcaaccgguccaggcgggccaaagggggagaaggguguacagggcccgccagggcauccgggacccccuggagagguuauccaaccccucccgauucagaugcccaaaaagacccgccguucuguggacgggagccggcuaaugcaagaggacgaggcuaucccuacagguggcgcccccgguuccccuggaggacuggaggagauuuuuggcucacuggacucucugcgggaggaaaucgagcagaugcggcggcccaccggcacccaggacucccccgcucggacgugccaagauuuaaaacugugccacccugaacugcccgacggagaguauuggguugaccccaaccaggggugcgcacgggacgccuucaggguauuuugcaacuuuacggcugguggagaaacuugcguuacuccaagggacgacgugacacaauuuucuuaugucgauagugagggcucuccagucggcguggugcagcuuacuuuucugagguuacuuucugugucggcccaucaggaugucagcuaccccugcucuggugcugcacgugacggaccucugcggcugcguggagccaacgaggaugagcugagcccagaaacaagucccuacguaaaggaauuucgugauggcugccagacacagcaagggcggaccgugcucgagguucgaaccccagugcuugagcagcugccaguucuggacgcuuccuucucugaucucggcgcucccccucgcaggggcggcguacuccuaggucccgucugcuuuaugggguag

SEQ ID NO: 5267 - RNA, 4968 nt, Artificial Sequence
  Description of Artificial Sequence: Synthetic coding sequence
auggagaggugcagcaggugccaccgccugcugcugcucuuaccacugguacuuggacuuuccgcugccccaggcugggcuggagcaccccccguggacguuuugcgcgcgcucagguucccuagucugccugauggagugaggcgggcaaaagggauuugcccugcugacguggcauaucgggucgcacgaccagcacagcugucugcuccuacccggcaacuauucccggguggcuucccuaaagauuuuucucuauuaacggucguuagaacgcgcccuggucugcaggcuccccugcugacccuguacucugcacagggcgugcggcaguugggauuggaauuggggcgcccagugagguuccuguaugaagaucagacaggucgaccacagccaccuucucagccaguguuucgaggccuuuccuuggccgaugggaaguggcaucguguugccgucgcagugaagggacagagcgugacccucaucguagauugcaaaaagcgagucacgcggccucugccacgcagcgcuaggccagugcuagauacacacggggucauuaucuucggugcgcgaauucuggaugaagaagucuuugagggugauguccaggaguuggcaaucguccccggcgugcaagcugcuuacgagucuugcgaacagaaggaacuugaaugcgagggcggacagcgugaaagaccacaaaaccagcaaccccaucgcgcgcagcggucuccccagcagcagccuucacgucuccauagaccgcaaaaccaggaaccccagagccagccaacggagucucuguauuaugauuacgaaccccccuacuaugacgugaugacuacuggcacuacaccagacuaccaggcugcccacggacccagaggccuuaaaggcgaaaaaggagagcccgcuguucucgagcccggcauguugguggagggucccccuggccccgaaggaccagcgggacugaucggccccccuggaauccagggaaaucccgguccugugggagaccccggagagcgcggcccaccagguagggccggccugccaggcagcgacggggcucccggcccucccggcacuucguuaaugcucccuuuccgcuuuggguccggugggggggacaaggguccaguggucgcagcccaagaggcccaggcacaagcaauuuugcaacaggccagauuggcccugcgugggcccccgggcccuaugggcuacaccgggcggccaggcccacugggccagccgggcagcccaggacucaaaggggaaucuggagacuugggaccucaaggcccucggggcccgcaaggcuuaaccggaccaccuggaaaagccggccggaggggccgagcuggugcggauggcgcgcggggaaugcccggggaccccggcguuaaaggagacaggggauuugacggcuugccaggguuacccggagaaaagggucaucgcggggacacuggcgcgcaaggacucccaggacccccaggcgaggacggagagcgcggggaugauggggaaauuggaccucgcggcuugcccggggaauccggaccgcgcggucuccucgggccuaaggguccuccaggaauuccuggcccacccggagucagaggaauggauggcccucagggaccaaagggaucucucggcccucagggagaaccaggacccccaggucaacaagggacgcccggaacccagggacuaccugguccacagggcgccaucgguccccauggagagaaagguccucaaggaaagccagggcugccgggcaugccggggagugacggcccuccaggccauccuggcaaagaggggccacccgguaccaaggggaaucagggacccucaggaccccaaggcccucuggguuaucccggacccaggggagucaaaggcgucgauggaauaaggggccugaagggccauaaaggggagaaaggagaggacggguucccuggcuuuaagggcgacaucggugugaagggcgacagaggcgaaguaggagugccuggcagccguggcgaggacggaccugagggcccuaaagggaggaccgggccaaccggugacccaggaccgcccgggcugaugggagagaaaggaaaguuaggggucccaggccuccccggcuauccuggacggcagggcccaaagggcucacuggguuucccaggauuccccggcgcgucuggcgagaaaggugcccggggguuguccggcaagucgggcccucggggggagaggggaccuacagggccccgaggacagcgcggcccuaggggagcaacaggaaaaucaggagcuaagggcacauccggaggggaugggccccauggaccuccuggcgaaagagggcugcccggaccacaaggcccgaacgguuucccgggucccaagggcccccccgggccgccaggaaaagacgggcugccagggcacccugggcaacgcggggagguaggguuccaaggaaaaacuggaccgccaggcccucccggaguggucgguccccaaggcgcugcaggagaaacaggcccuaugggcgagcgcggccaccccggcccacccggcccacccggcgagcagggacugcccggaaccgccggcaaagaggggacaaagggagacccagggccucccggggcgccaggaaaggaugggccagccggccuccgcgguuuccccggugagagggggcucccuggaaccgcgggagggccugggcuuaagggcaacgagggcccuaguggacccccagggcccgccggguccccuggugaacggggggcagccgggagcgggggucccaucgggcccccuggaagaccugggccacaggggccaccaggcgcugccggagagaagggagugcccggcgagaagggcccuauagggccaacuggcagagacggcgugcagggaccagugggauugccuggcccugcugguccuccaggaguggcaggagaggacggcgacaagggagaagugggagacccaggacagaaaggcaccaagggcaauaagggcgagcacggaccaccuggaccgccuggaccuaucggccccgugggacagcccggagcagcuggcgcggacggggaaccaggagcaaggggcccccagggccacuucggggccaaaggggaugaagguacacguggguucaacggaccaccagggccaaucggccugcaggguuugccgggacccucuggcgagaagggcgaaacuggggacgugggaccaaugggaccccccggcccuccugggcccaggggcccagcagggccgaacggagccgauggaccacaaggaccccccggcggagucggcaaucuagguccucccggcgagaagggugaaccuggugaaagugggagucccggcauccaaggcgagccaggcgugaaaggaccacggggagagaggggugagaagggcgagucuggucaaccaggcgaaccaggcccuccagggccaaaagggccuaccggggacgacggcccuaaaggcaacccaggcccaguaggguuccccggagauccugggccaccgggugagggcgggccuaggggacaggauggcgcaaagggggauaggggagaggacggugagcccggacagccagggucaccagggccaacgggcgaaaacggcccaccugggccuuuggggaagcgcggcccugccggcucacccggauccgaaggacgacaaggcggcaaaggcgcuaaaggggaucccggcgcgauaggcgccccagggaagaccgggccuguggguccagcaggacccgcugguaagccugggccugauggucugcgaggccugccaggguccguugggcagcagggccgcccgggagccacuggacaagccggcccaccaggccccgucgguccaccuggucugcccggacugcgaggggacgcaggcgcaaagggagagaagggucauccagggcugauaggucucauuggaccaccuggcgaacagggggagaaaggagaccgcggucuuccaggcccacagggaagccccggacagaaaggagagaugggcauccccggggcaucuggacccaucggucccggagguccucccggccuccccggcccugcuggaccaaaaggagcgaagggcgcuacaggaccaggcgggccuaagggggagaaaggaguccagggaccaccaggacauccuggcccuccaggcgaggucauucagccacugccaauccagaugcccaagaaaacuaggcgguccguagacggaucuaggcuuaugcaagaggacgaagccauuccuaccggaggugcuccagguagcccuggcggucuggaggaaaucuuuggcagccuagacagccugagggaggagauagaacagaugagaagaccaaccggcacccaggacuccccugcucguaccugucaggaucugaaguugugucauccagagcuacccgauggugaguacuggguggacccaaaucagggaugugccagagaugcguuuaggguguucugcaacuuuacugccgggggugaaacaugcgugacucccagagaugaugucacucaguucuccuauguugauucugaaggcucuccuguuggcgugguccagcugacguucuuacgcuugcucuccgucagcgcgcaucaggaugugaguuauccgugcuccggcgccgcacgggacggcccuuuacgccuuagaggagccaacgaagacgagcucagccccgagacuucucccuacguuaaggaguuccgugaugggugccaaacccagcagggccgaaccguacuagagguacgaacucccguauuagaacaacugccagucuuggacgccaguuuuagugaucugggcgcgccuccgcgucgaggcggaguacuccuggguccugucuguuucaugggguag

SEQ ID NO: 5268 - RNA, 5070 nt, Artificial Sequence
  Description of Artificial Sequence: Synthetic coding sequence
auggaaagaugcuccagaugccaccgccuccugcugcuucugcccuugguacugggccucuccgcagcucccggcugggcuggcgcacccccagucgacguccugcgugccuugcgguuucccaguuugcccgauggaguaagaagagcaaaggggauuuguccugccgauguagcguaccggguggcucggcccgcccaacugucugcuccaaccaggcaauuguuccccggaggcuuccccaaggauuuuucacugcugacgguaguacgaacacguccaggccugcaggcaccucuucugacuuuguacucagcccaagggguacgucaacugggacucgagcuggguagaccggucagauuucuguaugaagaccagacaggcaggccccagccuccaagucagcccgucuuucgcggucuuucucuugcagaugggaaauggcaccgcguggcuguggcugugaagggccaaucugugacacuuaucguugacuguaaaaagcgugucacuagaccauuaccacgauccgcccgacccguuuuggauacacauggagucauuaucuuuggcgcccgcauuuuagaugaggagguguuugaaggugacguccaggagcuggcaauugugccaggcgugcaggccgcuuaugagucgugugaacagaaagaacuggagugcgagggaggacagcgagagaggccacagaaucaacaaccacaucgagcucaacgauccccgcaacaacagccuagcagauugcaccgaccccaaaaucaggagccucaaucacaggaacaaacugaccugcaggugccgccaaccgcagacagauuucaggcagaggaguauggugaaggcggaaccgauccacccgaaggcccuuacgauuauaccuauggcuacggcgacgacuaccgugaggaaaccgaguugggucccgcucuaucagcagagacagcacacucaggugccgccgcccacggcccuaggggacugaagggugaaaagggcgagccugcuguguuggaacccggaauguugguggaggguccuccuggcccagagggaccggccggccucaucggcccacccggcauccagggaaacccuggucccgugggcgacccaggagaaagggggcccccugggcgggcuggucuuccuggaucagacggcgcuccuggaccuccagggaccagccucaugcugcccuuuagauucggcaguggaggcggagauaaggguccugucgucgccgcucaggaggcccaggcacaggcuaucuugcaacaggcacggcuggcacuccgggggccucccgggcccaugggauacaccgggcguccagggccucucggucagccaggcaguccuggccuuaagggggagucgggcgaucugggcccccaggguccccgaggcccucaaggguugacugggcccccuggcaaggcuggacguaggggcagagcuggagccgacggagcacggggcaugccaggggacccuggcgucaagggagacagaggguucgacgguuuaccaggauuaccaggcgaaaaaggucaucgcggagacacaggcgcucaggggcugcccggcccccccggcgaagauggagagagaggagacgacggggagaucgggcccagaggucugccaggcgagaguggucccaggggucuguugggaccaaagggccccccaggaauccccgggccucccgggguacggggaauggaugggccacagggccccaaagguucccugggaccucagggagaaccugggcccccgggacagcaaggcacacccgggacucaaggcuugccggggccccagggcgcgaucggaccucauggggaaaaaggcccucagggcaagccaggucugccaggcaugccugguuccgaugggccacccggccauccuggcaaagaaggcccgccuggcaccaagggaaaucagggucccagcgggccgcaggguccgcugggguauccuggaccccguggugugaaaggcguagaugguauaagaggguugaaggggcacaaaggggagaaaggugaggacggauuucccggguuuaagggugauaucggagugaaaggagacaggggugaagugggcgucccuggcucuaggggggaagacggccccgaaggcccaaaaggacgcaccggcccuaccggagacccuggcccgcccggucucaugggcgagaaagguaaacucggaguuccgggacuacccggguaccccggaaggcagggccccaaagggucucuuggauucccuggguucccgggugccucaggugaaaaaggagcgcggggacuuagcggcaagagcggaccaagaggcgaacggggaccaaccggcccucgaggucagcgcgggccucggggggcaaccggcaaguccggcgcgaaagguacuagcggcggcgacgguccucacgguccucccggggaaagagggcuccccggaccucagggucccaacgguuuuccuggaccaaaaggacccccgggcccaccuggcaaggacggguugccaggucacccaggucaacgcggggaggucggauuccaggggaagaccggcccaccuggaccacccggcguaguugggccccaaggagccgcaggagagacagggcccaugggggaaagggggcaucccggaccuccagggccaccaggagagcagggcuugccggggacggcagguaaagaaggcacuaaaggugacccuggaccaccuggcgcccccggaaaggacggccccgccgggcugaggggguuuccuggagagaggggacuacccgggacugcaggcggcccagggcuuaaaggcaacgagggaccaucuggcccccccggacccgccggaucucccggagagagaggggcagccggauccggagggcccaucggacccccaggacgcccuggaccucaaggaccuccaggggccgcaggagagaagggagucccaggcgaaaaagggccuaucgguccaaccgggcgugaugggguccaaggcccagugggacuuccugguccagcaggaccucccgguguggcaggcgaggacggcgacaaaggcgaagugggagacccaggucaaaaaggaacaaaaggcaauaagggggagcacggccccccagggccccccgggccuauaggaccugucggacaacccggcgccgcuggagcggauggcgaaccaggcgcccggggcccgcagggacacuuuggagccaaaggagacgagggcacccgcggauuuaauggaccccccgggccuaucggcuugcagggucugcccgggcccucuggcgagaagggugagacuggggauguaggcccgauggguccgccugggccacccgguccccggggaccagcagguccuaacggagccgaugggccucagggaccaccaggcggcgucgggaaccugggcccaccgggagaaaagggagagccaggggagagcgggagcccugggauucaaggugaaccuggggugaaaggcccuagaggcgagcggggagaaaagggggagaguggccagcccggcgaaccggguccacccggaccuaaaggucccacuggggacgaugggcccaaagguaacccaggcccggugggcuucccgggcgaccccgguccccccggggaagguggccccaggggacaggauggagcuaagggcgacagaggcgaagauggagagccaggccaaccuggaucuccuggcccaacgggugagaaugggccuccagguccucuggggaagcgaggucccgccgguagcccugguagcgaaggacggcaggggggaaaaggagccaagggcgacccuggcgcuaucggugcuccugggaagacuggccccgugggacccgccggaccagcggguaaacccgggcccgacgguuugaggggcuugccaggcucaguggggcagcagggcagacccggagcuacugggcaagcggggccgccuggccccgugggcccgccuggccugcccggauugcggggagaugcaggcgccaaaggcgaaaaaggucauccuggucucauugggcugaucgggcccccaggagaacaaggcgagaaaggcgacagaggucugcccggaccucagggcuccccuggccagaaaggggaaauggggauucccggggcaagcggcccaaucggucccggcggccccccgggucuccccggacccgcaggcccuaagggggccaaaggagcuacgggaccaggaggcccuaaaggugagaaggggguacagggcccucccgggcacccaggcccgccuggagagguuauccagccuuuacccauacagaugccaaaaaagacaaggagauccguggauggaucacggcucaugcaagaggaugaggcgaucccaaccggaggggccccuggaucaccuggaggccuugaggaaaucuucgguucacucgauucucugcgggaggagauugaacaaaugagacgcccaacuggaacgcaggacuccccagcuaggaccugucaggacuuaaaacugugucauccugagcugccagauggcgaauacuggguggacccuaaucaggguugcgcucgcgaugccuucagaguuuucuguaauuuuaccgccgguggcgagacuugcgugaccccuagagaugauguuacgcaauuuucauacguggauucggagggaagcccugucggcgucguucagcuuaccuuccugcgacuguugagugugagugcccaucaggacguaucuuaccccugcucuggggcggcaagggacgguccccugcgacugagaggagcaaaugaagaugagcugaguccugagacaagcccauacgugaaagaauuucgagauggaugccagacacagcagggaagaaccguguuggaggugagaacaccagugcucgagcagcugcccgugcuggaugcgucuuucagugaucugggcgccccaccucgccgcggaggcguucuguugggacccgucugcuucaugggcuag

SEQ ID NO: 5269 - RNA, 5133 nt, Artificial Sequence
  Description of Artificial Sequence: Synthetic coding sequence
auggaaagguguagcaggugucacaggcugcuauugcugcugccccuuguccugggcuugagcgcagcaccuggaugggccggagcacccccaguugauguucugcgcgcccugcgcuucccuucccugccggacgguguaaggcgcgccaaggggauuugccccgcugaugucgcuuaccgaguugcgcgaccagcucaguuaagugcaccuacaagacaacuguucccuggcggcuuucccaaggauuuuucccugcuuacaguugugcgcacgagaccaggccugcaagcgccccuacugacauuguacucugcccaggggguccggcagcugggucuugaauugggcaggcccguucguuuccucuaugaggaccagaccggucgcccacagccucccucucaaccggucuuuaggggccuaucucuggccgacggcaaguggcaucgagucgcuguggcugugaagggucagucggucacccugaucguggauuguaaaaaacgggugaccaggccccugcccaggucagcccgccccguacuggauacccaugguguaauuaucuucggcgcccgcauccuugacgaggagguguucgaaggggaugugcaggaacuagcgauugucccuggagugcaagccgcauacgaaagcugugaacagaaggagcuugaaugugagggcggacagagagaacggccacaaaaccagcaaccccaccgggcacaaaggagcccucagcagcagccuucucgucuccaccggccucagaaccaggagccccaaagucaggaccccacccccggcgaggaagaggagaucuuagaauccucccuccugccaccccuugaggaggaacagaccgaccugcaggugccacccacagcagaccgguuucaagcggaggaauauggggaggguggcacugauccccccgaggguccuuaugacuacaccuauggauauggcgacgacuaccgcgaagagacugaacugggacccgcucucucagcggagacagcucacuccggagccgcagcucacggcccuagaggacucaagggggagaaaggcgagccugcuguuuuagagcccggaaugcugguugagggcccaccaggcccugaggguccagcaggccuuauaggaccuccgggcauucaggggaauccuggcccuguuggcgacccaggcgaacguggcccacccgggcgagccggguugccaggguccgauggcgcccccgggccacccgggacuucacugaugcugccuuuccgauucgguucaggggggggcgauaagggacccgugguggcugcacaagaggcccaagcccaggccauccuucaacaggcacggcuggccuuacgcggaccgcccggaccuaugggcuacacaggccggccaggcccacugggacaaccuggcagcccuggccugaaaggggagaguggugaucuuggaccacagggccccagggggccccaaggccugaccggaccccccggcaaagcgggaagacgaggcagagcuggggccgauggggcacgcgggaugccaggagacccgggagugaaaggagaccgaggcuucgacggccugcccgggcuuccaggugagaaaggucaccggggcgacacuggcgcgcagggacugccuggcccacccggggaagacggagaacggggagacgacggagagauuggcccucgcggacugcccggugaaucaggaccacggggacuccuggggccaaaagggccuccagguauaccugguccaccugggguccguggcauggauggaccacaagguccuaaggggucgcucggcccgcaaggagaaccaggcccucccgggcaacaggguacucccggcacucagggccugccaggaccacagggcgccauugggccacacggggagaagggcccccaaggcaagccaggucuuccaggaaugccagguagcgauggcccaccgggccaucccggaaaagagggcccacccggcacaaaaggcaaccagggccccucagggccacagggaccacugggauauccaggcccccgaggagugaagggcguggacggcaucagaggacucaagggccauaagggggagaagggugaagauggauuccccggauucaaaggcgauauuggagucaagggcgacaggggcgaagugggcguucccgguucccgaggggaggacggcccugaggggccgaaggggcggacuggcccaacaggggaucccgggcccccaggucugaugggcgaaaaggggaagcucggugugccaggauugccugguuaccccgggcgucaaggccccaagggcaguuuaggguuccccggauuuccuggagccaguggugagaaaggggcccgcggcuugucaggcaaaucuggaccccggggggaaaggggcccgaccgggccgcgcgggcagagaggacccaggggcgcaaccggaaagucuggagcaaaagguacaaguggcggcgauggaccacacggccccccuggugagcgugggcuuccagggccccaggggcccaauggcuucccugggcccaaaggaccuccuggaccacccggcaaagaugggcuacccgggcauccuggacaacgcggcgaggugggauuccaggguaaaaccgguccgccuggucccccaggcgucgucggcccucaaggggccgcaggagagacagggccuaugggcgagcggggacaccccgguccgccugggcccccaggugaacaaggcuugccaggaacugcaggcaaagagggcacaaaaggcgaucccgggccccccggggcuccagggaaggauggacccgcugggcugcgugguuuuccaggcgaacggggucugccgggcacggcuggcggaccuggucuaaaagggaacgagggaccaaguggaccgcccggacccgcgggcucacccggggagagaggcgcugcgggauccggagguccuauuggaccuccaggacgaccaggcccacagggacccccaggagccgcuggcgagaagggaguuccaggggagaagggccccauaggcccuacuggccgagauggaguccagggcccagugggacugccaggccccgccgguccaccuggagucgcgggggaagauggugauaaaggagagguuggcgaccccggccagaagggaaccaaagggaacaaaggagagcaugggccuccugguccgccagggccaauaggucccgugggccaaccuggcgcugcuggcgccgacggcgaaccuggcgccagagguccacaggggcauuucggggccaagggagacgagggaacccggggcuuuaacggccccccuggcccaauuggccuccagggauuaccaggaccaagcggagagaagggcgaaacgggagauguugggcccaugggcccuccggguccaccaggcccccgcgggcccgcaggacccaauggcgccgacgguccccagggccccccugguggcgugggcaaccucgggccuccaggcgaaaaaggagaaccuggagagaguggaucccccgguauccaaggagaaccaggcgucaaggguccuaggggcgaaaggggcgaaaagggggagagcggccagccaggcgagccuggccccccggggccgaagggacccacuggcgacgauggucccaagggcaacccaggcccggucggguuuccaggugacccuggaccaccaggggagggcggaccuagagggcaggauggugcgaaaggcgacaggggcgaggacggcgagccgggucagccagggagcccuggaccuaccggagagaauggccccccuggaccgcuuggcaaaagaggcccugcugguaguccaggcagcgaggggagacagggaggcaaaggagccaagggagacccgggcgcaauaggggcucccggaaagacaggcccaguggggcccgcaggaccggcaggcaaaccgggccccgacggacuccgcggacugccgggcagcgugggccaacaggguaggccuggcgcuacgggucaagccggaccuccuggcccuguggguccuccgggacugccaggacugagaggggacgccggagcaaagggggaaaaaggccaucccggauuaauuggucugaucggcccaccgggagagcagggagaaaagggcgaccgcgguuugccagggccacagggcucaccuggucaaaaaggcgaaaugggcaucccaggggccucagguccuauuggccccggcggcccacccgggcugcccggcccagcaggacccaaaggggcaaagggugcgacugggccuggaggccccaaaggagaaaaaggaguccaaggaccccccggucacccagguccuccuggcgaaguaauccaaccucuacccauccagaugcccaaaaagacgcgaaggucuguggacggcagccgucuaaugcaggaagaugaggccauucccacaggcggcgcuccaggcucuccgggcggccuugaggaaauuuuugguagucucgauagcuuacgcgaggaaaucgagcagaugcggcggccaacagggacacaggacucgcccgccagaacaugucaggaucugaaauugugccacccggagcugccagacggcgaguacugggucgauccuaaucaggguugcgcaagagacgccuuuagggucuucuguaauuuuacagcaggcggagaaacuugcgugacuccccgugaugauguaacgcaauuuucauacguggacuccgagggcucuccgguaggcguggugcaguuaaccuuucuccgacuguuaagcgugucugcucaccaggauguguccuaccccugcucuggcgcugcgagggacggcccuuuaagacuucgcggcgcuaacgaggacgaacuuagucccgaaacuagcccuuacgugaaggaguuccgcgacggaugccagacucagcaaggccggacggugcuggaggugagaacacccgugcuggagcagcugcccguccuggacgccagcuuuucagaccuuggugcaccaccaagaaggggaggcguccuguugggccccguguguuucaugggauag

SEQ ID NO: 5270 - RNA, 873 nt, Artificial Sequence
  Description of Artificial Sequence: Synthetic coding sequence
auggagagaugcuccaggugccaccgucucuuauugcuuuuaccuuugguguugggucugucugcggcacccgggugggccggcgccccuccaguugacguccuccgagcccugcguuuuccguccuugccagauggugugagacgugccaaaggcaucugucccgcugacguggcauaucgcguagcuagacccgcccaguuguccgcuccuacucgucaguuguuccccggcggcuuuccuaaggauuuuucccuacuuacagugguacgaacucgcccgggguuacaggcuccgcugcugacacucuacuccgcccagggagucaggcagcuaggacuagaacugggcagaccggugagauuucuuuacgaagaucagacuggacgcccacagccgccaucccaaccaguauucagggggcuaucacuggcagaugggaaauggcaucgcguugcuguagcggucaagggucagagcguaacacuaaucgucgauugcaagaagagagugacucggccucugcccaggucagccagaccagugcuggacacucacggcgucaucauuuucggggcacguauauuagacgaggaagucuucgagggcgacguccaggaacuggccauaguacccgguguacaagcugccuacgaguccugcgagcagaaggaauuagagugugaagguggacagagagagcgcccacagaaccaacagccgcaccgggcccagcgaucuccacagcagcagccuucccggcugcaccgaccccaaaaucaagagccucagucacaagucagagagcugggugagcccccgucagccgcucauccuagagagggccgccacccggguaucucacccccauag

SEQ ID NO: 5271 - RNA, 921 nt, Artificial Sequence
  Description of Artificial Sequence: Synthetic coding sequence
auggacuggcgcgcuagugaagcguggauggugccacgggcucccaaaggcgccugggauccccgcgaaagccaagacuugcuggacaauagagccccacuggguccccgagucuuucccgguccuagaguucccuccgcgcucauggagcggcgggugcuuaagggaagucagggaaguccugccugccccggaccgcccggugaggugauccagccgcucccgauccaaaugccaaaaaaaacaagaagaucuguggacgggucucgucugaugcaggaggaugaggccauccccaccggcggcgccccaggcagcccagguggacuggaagaaauuuuugggucauuagauagucugagagaagagauugagcaaaugagacgucccaccggcacgcaggauaguccagcuaggacuugccaggauuugaaguugugucauccugagcugccagauggcgaguauuggguagacccaaaucaagguugugcaagggaugccuuccggguguuuugcaacuucacugcagguggagagacguguguaacuccacgggacgaugucacgcaguucagcuacguggauagcgaaggguccccugucggcguugugcaacugacguucuuacgguuacucaguguguccgcacaucaggauguuucuuauccaugcagcggugccgcccgagaugguccgcuccgacugcgaggggcgaacgaggacgaacugucacccgaaacaucacccuacgugaaggaauuuagagaugggugucaaacgcagcagggccguacaguacuugaggugcgaacccccgugcucgaacagcuucccguacuggaugcuucuuucuccgaccucggugcuccucccagaagagguggcgugcuucuggggccuguguguuucaugggcuag

SEQ ID NO: 5272 - RNA, 5031 nt, Artificial Sequence
  Description of Artificial Sequence: Synthetic coding sequence
auggagcgcuguucuagaugccacaggcugcucuugcuucuuccccucgucuugggacuuagugcugcccccggcugggcaggggcaccuccuguggaugugcugcgggcucuaagauuuccuagccugccugauggcgugcguagagcgaagggaauaugcccagccgauguggcuuaccgaguagcucgcccugcacaguuguccgccccaacucgccagcucuuuccgggcggauuucccaaggacuucagccuccugaccguagugagaacuaggccaggcuugcaagcuccccugcugacucucuacuccgcacagggagugagacaacuugggcuagagcucggcaggcccgucagguuccuguaugaagaccaaaccggacgaccacagccaccuucccagcccgucuuuagaggauugucuuuggcagaugggaaauggcaucgugucgcagucgcaguuaagggccagucugucacccugauaguugauuguaaaaagagaguaacacguccccugccacggagcgccaggccgguucuagauacccauggugugauuauuuucggagcaagaauccuggacgaggagguuuuugagggagauguccaggaacucgcuauuguccccggcguucaggcggcuuacgagagcugugagcagaaggagcuggagugcgagggcggacaaagagagcguccucagaaucagcaaccucaccgugcacagcguagcccgcagcaacagccaagccgccuacaccgaccucagaaccaagagccucagagucagcccaccgaaagccucuauuaugauuacgagccuccauauuacgauguaaugacgacuggaacaacccccgauuaucaagauccgacucccggggaggaggaggaaaucuuagagucaucacuguugccaccguuagaggaagcugcacacgguccucgcgggcucaaaggcgaaaagggugaacccgcaguccuagagccaggaaugcugguggagggccccccagguccagagggaccugcaggccugauagggccuccaggcauucagggaaauccagguccagucggcgaccccggcgagagagguccccccgggcgagcuggguugccaggauccgacggcgcuccaggaccuccaggcaccagccugaugcugccauuccgguuugggucgggaggcggcgauaagggucccgucguagccgcccaggaagcccaagcacaggcuauucuccagcaggcucgcuuggcccuacgaggaccaccaggaccaauggguuacaccggaaggccagggccccucgggcaaccagguucccccggacugaagggggagagcggagaccugggaccccagggaccccguggaccacagggcuugacaggccccccgggcaaagcuggaaggagagggagagcuggagcagacggagcucgaggaaugcccggcgacccaggcgucaaaggggaccggggauucgauggccugcccggucugccaggggagaaaggucaucggggagauacgggagcucaagggcuccccggaccaccaggagaggauggggaacgaggcgaugauggagaaauaggcccucguggacucccaggagaaagugggcccagaggacuacuggggcccaaagggcccccaggcaucccaggaccgcccggugugcgggggauggauggcccgcagggcccaaaagggucuuugggcccgcaaggcgagccagggccaccgggccagcagggcacccccggcacgcaagggcuuccgggcccacagggagccaucggaccccauggggagaagggcccucagggaaagccgggacucccagggaugccagguuccgacgggccucccgggcacccuggaaaggagggcccaccaggcaccaaagguaaucagggaccaagcgggccccagggaccucugggcuacccuggcccaagggguguuaagggcguugaugggaucagagggcugaaggggcacaaaggcgagaaaggugaagauggcuuccccggguuuaagggugauaucggagugaagggcgaucgcggugaagugggagugccaggcucucggggagaggacgguccggaggggccuaaaggccguacugggcccacuggcgacccuggcccacccggacuuaugggcgaaaaaggaaaguuaggaguaccuggccugccgggcuacccagggcgucagggucccaagggauccuuggguuuucccggguuccccggagcaagcggagaaaagggcgcucgggguuuguccgggaagagcggaccaaggggagaacggggcccaacugguccgaggggucagcgcgggccacgcggcgccaccgguaagucaggagcaaaagggacuagcggaggagacggcccucacggccccccuggugagcguggccucccagguccgcagggcccaaacggcuuccccggcccgaaaggaccaccuggcccccccgguaaggauggacugccaggccacccaggucaacgcggagagguaggguuccaggguaagacagguccacccggaccuccuggugucgugggaccccagggcgcggcaggcgagacuggcccuaugggggaaagaggacaucccgggccacccgggccuccuggcgagcaagguuugccagggaccgccgguaaagaggggacaaagggggacccugguccuccgggcgcccccgggaaggacggaccggcuggccugaggggauuuccuggcgaaagagggcugccagggacugcaggaggccccggucuuaagggaaaugaaggccccagcggcccaccgggccccgcagggucuccuggcgaacgaggcgccgccggguccgguggccccaucggcccgcccgggagaccgggaccucagggaccgccuggggcggccggugaaaaggggguuccaggagaaaagggaccgaucgggcccaccgguagggaugguguccaaggaccaguuggacugccgggcccagcugggcccccaggcgucgcuggagaggacggagacaaaggcgaagucggugacccaggacagaaggguacaaagggaaacaagggcgaacaugguccuccugguccacccggacccaucggccccguuggccagcccggagccgcaggggcggacggugagccgggcgcucgcgguccacagggccauuuuggcgccaaaggagacgaaggcacaagggguuuuaauggcccaccuggacccaucggucuacaagggcugccgggcccaagcggcgagaagggcgaaacuggagaugucgggccuaugggacccccagguccaccugguccuagaggcccugcugggccuaacggggccgauggaccucaagguccaccugguggcgucggaaaucucggacccccaggcgagaaaggggaaccgggcgagagcggguccccagggauacagggcgagccaggugucaaaggccccagaggggaaagaggcgagaaaggcgaauccggccagccuggagaaccagggccgccugguccgaagggacccacuggugaugauggcccaaaggggaauccuggccccguuggauuccccggagauccaggaccaccaggagaaggagguccaagagggcaggacggagcgaaaggugaccggggugaggacggcgaaccuggacagccgggcucucccgggccaaccggggagaacgguccucccgguccucugggcaaaaggggaccagccgggaguccuggcuccgaggggcggcaagguggcaaaggugccaaaggagauccaggggcuauuggagcaccaggcaagaccgggcccguagggcccgcuggcccugccgggaaaccuggacccgauggauuaaggggccuacccgggagugucggccagcaggggcgccccggggccaccggacaggccgggccaccggggccugucgguccucccggccuucccggguuaaggggcgacgccggugccaagggggaaaaaggccaccccgggcucaucggccuaaucgggccccccggcgagcagggcgaaaagggcgacaggggacugccugggccacaaggaucacccggacagaagggcgagaugggcauuccuggcgccuccgguccgauuggcccaggagggccgccgggucuuccuggcccugcagggccaaagggagccaaaggcgccacaggcccuggugggcccaagggagaaaaaggcgugcaggggccgcccggccaccccggcccuccaggugaagucauccagccacuuccaauacagaugcccaagaaaacucggcguucuguggacggaagcagguuaaugcaagaggacgaagcuauccccacuggcggcgcgccggggucacccggcggauuagaagaaaucuucgguagcuuggacucauugagggaagaaaucgagcagaugcgaagaccuacuggaacacaggauagcccugcuagaacaugucaggauuugaagcucugucauccggaacugcccgauggcgaguacuggguugaucccaaucagggaugugcccgcgacgcuuuucgaguuuuuugcaauuuuacagccgggggcgaaacaugugugacaccucgcgaugaugucacacaguucaguuauguugacuccgaagguagccccgugggagugguucagcuaacauucuugcgacugcucucuguaagcgcacaucaggacgucagcuauccuugcucuggggccgcccgagacggaccuuugagacugagaggcgccaacgaagacgagcucucuccugagaccucccccuacguaaaagaguuucgagauggaugccagacucagcagggccguacaguuuuggagguucggaccccggugcuggagcaacugcccguccucgacgcaagcuucucagaccuuggggcucccccacgccguggaggugugcuccuggggccugugugcuuuaugggauag

SEQ ID NO: 5273 - RNA, 4953 nt, Artificial Sequence
  Description of Artificial Sequence: Synthetic coding sequence
auggagagguguucccgcugucaccgacugcuguuacugcugccccuagugcucggguuauccgcggcucccggaugggcuggggcucccccagucgauguucucagggcacugcgguuucccagcuugcccgauggaguccgcagggccaagggcauuugccccgccgacguugccuaucgcgucgcacgcccugcccaacucucagcucccaccagacaguuguuucccggcggcuucccuaaggacuucagccuacuaaccgugguccggacccgaccgggacuacaggcucccuugcugacacuguacagugcacaggguguacgacagcucggguuagaacugggaagaccaguacgguuccuguaugaggaccagacagggagaccccagccuccuucucagccaguguucaggggucugucuuuagcugauggaaaguggcaccggguggcuguggccguaaagggccaguccgugacacuuauagucgauugcaaaaaacgugucacacggccccuaccaagguccgcccggccagugcuugauacucacggggugauuaucuuuggagcacguauuuuggacgaagaaguguucgaaggcgacguccaggagcucgcuauugucccuggugugcaggccgcuuacgaaagcugcgagcagaaagagcuggagugcgaaggaggacagcgcgaacggccccagaaucaacaaccacaccgcgcucaaagaagcccccagcagcaaccuagccggcuucauagaccgcagaaccaggagccacaaucccaggacccaacuccuggagaggaggaagaaauccuggagagcagccuucuccccccucucgaagaggccgcucauggaccaagaggccugaagggggagaaaggugagccagcugugcuggaaccaggaaugcuuguggagggacccccaggcccagagggcccugccggccucaucggcccgcccggcauccaggggaauccugggccagucggagaccccggcgaacggggccccccugguagagcuggucuccccggaucggacggugccccugguccuccagggaccucucugaugcucccguuccgauuuggguccggugguggcgacaaggggccgguggucgccgcgcaggaggcucaggcgcaagcgaucuuacagcaagcccgacuggcucugcgggggcccccuggccccaugggcuacacggggcguccgggaccauuagggcaaccaggaagccccggccucaaaggcgagagcggggaucuagguccucaagggccccgcgguccucagggcuuaacaggcccaccuggcaaggccgggagaagggggcgggcuggggcggauggugcgagaggaaugcccggcgaucccggugugaaaggcgauaggggauucgaugggcugcccggacuuccuggggaaaaggggcacagaggagauaccggcgcccagggcuugccuggaccucccggcgaagacggagaacgcggagacgauggagagauaggaccucguggguuaccuggugaauccggcccaagaggauugcucggacccaagggcccaccaggcauuccaggaccuccuggggucagaggaauggacggaccucaaggcccuaaaggaagccugggcccccagggcgagccaggccccccaggacagcagggcaccccaggcacucaaggucugcccgguccucagggcgcaauaggaccucacggcgagaagggaccacaggggaaacccggccuaccugguaugcccggcucugaugggcccccuggccauccaggcaaggaagguccccccggcaccaaaggcaaccagggaccauccggcccacaggggcccuugggguaccccgggccgaggggcgucaagggaguggacggcauccgcggccuuaaaggucacaagggugaaaaaggcgaggaugguuucccaggguucaagggugauauuggcgucaagggcgacaggggugagguggguguccccggcuccaggggagaagacgggccugaggggcccaagggcaggaccgggccaaccggagacccaggaccuccuggacuaaugggagagaaggggaaacucggcgugccuggccugcccgguuaccccggcaggcaagggccgaaaggaucucugggcuuuccgggguuucccggagccuccggggagaagggagcaagggggcucagcgggaaaaguggacccagaggggaacggggaccuacgggcccucgaggccaaaggggaccgcgcggggccaccggcaaaaguggagcgaaaggaacaucugggggugacggcccacacgguccacccggggagcgggguuuaccugggccucagggucccaauggcuuuccuggaccuaaaggucccccugggcccccuggaaaagacggacugccuggacaccccggucagcguggcgaaguaggauuucagggcaagacgggaccgccagggcccccagggguuguggguccccagggggcugcuggagagacaggaccaaugggugagcggggacaucccgggccccccggaccccccggcgagcagggacugcccgguaccgcugggaaagaaggcacaaaaggugacccuggaccaccuggggccccugggaaggaugguccugccggccucagggguuuuccuggcgagcgaggauuaccugggacugccggcggacccggacugaagggaaacgaagggccauccgggccuccuggaccugcuggcuccccuggggagcgaggggccgcgggaagugggggcccgauuggcccgcccggacgacccgguccucaagggcccccaggugcagcaggcgagaagggggugccaggggagaagggcccuauuggacccaccggcagagacggugugcagggacccgugggcuugccaggaccagcugggccacccggcguggcuggcgaagauggugacaagggagaggugggcgacccgggccagaaagguaccaaaggcaacaagggagaacaugggccccccgguccgcccggaccuaucggccccgucggacagcccggggccgcuggcgcggauggcgaaccuggggcucgcggaccucagggucauuuuggggcuaaaggagacgagggcacucgcggcuucaacggaccaccugggccaauaggacugcaaggccucccgggaccauccggagaaaagggagagacgggcgacgugggcccuaugggacccccagguccaccggggccccgcggacccgcgggcccaaauggagccgauggaccacagggccccccaggcggcguggggaaucugggcccgccaggagaaaagggggaaccuggggagagugggucuccagguauccagggcgaacccggagugaaagguccaaggggugagcggggagagaagggcgaguccggccagccgggagaaccagggccaccuggcccaaaagguccaaccggggacgacgggccuaaaggcaacccggggcccgugggguucccaggugaccccggacccccgggcgagggcggcccuagaggucaagauggggccaaaggagaccgaggugaggauggcgagccaggucaaccugggucacccggcccaacaggagaaaauggaccgccaggaccccuuggaaagcgcggccccgcuggcucccccggaagcgagggacgccaggguggaaagggcgccaaaggagauccuggcgcuauaggcgccccagggaagaccgggccagugggcccugcuggcccagcugguaagcccggccccgacggacugagggguuuacccggguccgugggccagcagggaagaccuggcgcgacaggucaggccgguccacccgggcccgugggaccuccgggauugccuggauugaggggagaugcuggcgcuaagggcgagaaaggccauccaggacuuaucggucucauuggaccaccaggugaacagggggagaaaggggaucgagggcugccagguccccaggggucuccuggccaaaagggagagaugggaauacccggagccucaggaccaaucggaccuggcgguccgccugggcugcccgggcccgcuggacccaaaggcgccaaaggagccacagguccagguggcccgaaaggcgaaaaggguguucagggcccccccggccauccaggaccuccaggcgaggucauccagccccuucccauacaaaugccaaagaagaccaggcgcuccguggauggcagccgucuuaugcaggaggaugaggcgaucccaacugggggugccccugguaguccagggggccuggaggaaaucuuugguucucucgauucucugcgggaggagaucgaacaaaugagacggcccaccggaacucaagauagcccugcacgaacaugucaggauuugaagcuuugucaccccgagcuuccugacggugaguauuggguggacccaaaucagggaugcgccagggacgccuuucgaguauuuugcaacuuuacugccggaggcgagacuugcgugaccccaagagaugacgucacucaguucuccuacgucgauuccgaaggcagccccguuggagugguacaguugaccuuucuccgcuuauugagugucagugcccaucaggaugucaguuauccuuguuccggggccgcccgggauggcccacuuagacugaggggcgcgaaugaagaugagcucucuccagaaaccagccccuacgucaaggaauuucgcgacggaugucagacucagcaaggccgcaccgucuuagagguacguacccccgugcucgagcaacuuccaguucuggacgcaagcuucucugaccuaggcgcgccuccucggagaggaggagugcugcuugguccagucuguuucaugggauag

SEQ ID NO: 5274 - RNA, 873 nt, Artificial Sequence
  Description of Artificial Sequence: Synthetic coding sequence
auggagcgaugcucuaggugucauagacugcuucugcugcugccccugguucugggacuuuccgcggcaccugguugggcgggggcuccucccguggacgugcugagagcccugagguuucccucccuccccgauggcgugcggcgcgccaaggguaucugcccagccgacguugccuaccgcguggccagacccgcucagcuuuccgccccgaccagacaacucuucccaggcgguuucccuaaggauuuuagcuugcucacggugguaagaacuagaccagguuugcaagcuccacuuuuaacucuuuacagcgcacagggcgucagacaacuggggcuggaacugggacggccggucagauuccuguacgaagaccagacaggaaggccccagcccccaagccagcccguuuuuagaggcuugucucucgccgacggcaaguggcauagaguagccguggccgugaagggacagucuguuacucucaucguggacuguaagaagcgcgugacccgaccauuaccaagaucugcucgaccugugcuggacacacacggcguuaucauuuuuggagcgcgcauccuggacgaagagguuuuugaaggagacgugcaggagcuagccauagugccuggagugcaggccgcuuacgaauccugugagcagaaggaacuugagugcgaagggggccagagggaaagaccucagaaucaacagccccauagagcccagcgauccccacaacaacaacccagcaggcuccaccggccucagaaucaggaaccgcaaagccaggucagagaacucggcgagccuccaucugccgcccaccccagggagggacggcacccagguaucagccccccauag

SEQ ID NO: 5275 - RNA, 1875 nt, Artificial Sequence
  Description of Artificial Sequence: Synthetic coding sequence
auggagcgcugcagccggugucaccgacuccuccuucuguuaccccucgugcugggcuuaucugccgcccccggcugggccggagcuccaccaguugaugucuugagagcacugagguuucccagcuuaccugacgggguccgacgggcaaaggggaucuguccagccgacguagcguaccgcguggcgagaccagcccaguuaucggcuccuacccgucaguuguuccccgguggguuccccaaagacuucucucucuuaacggugguucggacccgaccuggacuccaggccccccuucugacacucuauuccgcacaggggguuaggcaacugggccuagagcucgggcgcccagucagguucuuguaugaagaucagaccggcaggccucagccaccaucccaaccaguuuuccgcggguuaucccuggccgacggcaaguggcaccgcguugcagucgcugugaaaggccaguccgucacacucauuguagauuguaaaaaaagagugacccggccguuaccuagauccgcccgccccguacuugacacucacggaguuauuauuuucggugccaggauccucgacgaggaggucuuugagggcgauguacaagaguuggcuauaguacccggcguccaagcugcauacgagucuugugagcagaaggaacucgagugugaaggcggccagcgcgagcgaccacagaaucagcaaccgcaucgcgcccagcgaaguccucaacagcagcccuccagauugcacagaccccagaaucaggagccacaaucccagccaacugaaagucuauacuacgauuauaagccccccuauuacgaugugaugaccacaggcaccacuccugauuaucaggauccaacuccuggcgaagaggaagagauucuugagaguucccugcugccgccgcuggaagaagagcagaccgacuuacagguuccaccaaccgcagaccgauuccaggcggaagaguauggcgagggcggcacagauccaccagagggccccuaugacuacaccuauggauauggggacgauuauagggaagagacagaacugggaccagcauuaucagcagaaaccgcacacuccggagcugcagcccauggaccccgcggccugaagggagagaagggcgaaccagcugugcuagaaccaggaaugcucgucgagggaccuccugguccugaaggaccagccgggcuuauugguccaccuggaauucaggggaauccaggccccgucggagacccuggggaacgagggccuccagggcgcgccggucugcccggcagcgacggugccccagggcccccaggaaccagucuuaugcuuccauuccgcuuugguucaggcgggggggacaagggaccugugguugccgcccaggaagcccaagcccaggcuauucuccagcaggcccgucuggcgcuuagagggccucccgggccuaugggcuauacugguagaccaggcccccuugggcaaccgggaucuccaggguugaaaggggagaguggugaucucggaccucagggcccacggggcccacagggccuuacagggccuccuggcaaggcagggcgccgggggcgcgcuggggccgacggggcacgggguaugccaggcgacccuggcguaaagggugacagaggauucgacgguuugcccggcuugccgggagagaaaggccaccgaggcgauacaggggcccagggccugccagggccuccaggcgaggacggugagagaggggaugauggggagauuggcccucgggggcugccgggcgaaaguggcccacgcggccuccuagguccaaaggggcccccagggauuccaggcccacccuag

SEQ ID NO: 5276 - RNA, 1875 nt, Artificial Sequence
  Description of Artificial Sequence: Synthetic coding sequence
auggagagauguucuagaugccacaggcuccuucuguugcugccacugguacugggccugucagcggccccaggcugggccggggcaccuccaguagaugugcuuagggcccuccgguuccccucucucccagauggagugcgccgagcaaaggggaucugucccgcugacguugcguaucgcgucgcuaggccugcacaguuaagcgccccaacucgccagcucuuuccuggcggcuucccuaaggauuuuucacugcucacagucgucagaacccggccuggucuucaggccccucugcucacccucuauagcgcucagggggugcgccagcucggauuggaacuuggcaggcccguuagguuccuguaugaggaucagacaggcaggccccagccgcccucucaacccguauuucguggccuguccuuggcugaugguaaauggcacagggucgccguggcaguaaaaggucagucugucacuuuaauuguggauuguaagaagcgcguuacucgcccccugcccagaucugcuaggccgguucuggauacccacggcguaauuaucuuuggugcuagaaucuuagacgaggaggucuuugaaggugauguucaagagcuagcuaucgucccaggcguccaggccgcauaugaaucuugcgaacaaaaggaacuggaaugcgaaggcggccagagagagagaccacaaaaucagcaaccucacagggcucagcgcagcccacagcaacagccuuccagguugcauagaccccagaaccaagaaccgcagucucagcccacugagucccuguacuacgauuaugagccgccuuacuaugacgugaugacuacagggacgacccccgacuaccaagacccaacacccggggaagaggaagagauucucgagagcuccuuauuacccccguuagaggaagaacagacggaccuucaggugcccccuacugcugacagauuucaagcggaggaguacggugaaggugggacagacccgccagaagggccauacgauuauaccuacggcuacggagaugacuauagagaggagacagaacugggcccugcccuuagugcggagacagcccauaguggagccgcagcucacggcccucgcggacugaaaggcgaaaagggggagcccgcuguccuggaaccugguaugcugguagaaggacccccgggcccggagggcccagcgggacugaucggaccuccuggaauucaggguaacccugggcccgucggcgacccaggugagagggguccgcccggcagagccggguugccgggaagugauggagcaccagggccccccgggaccagucuuaugcuacccuuuagguuuggaucaggugguggagacaaggggcccgugguugccgcacaggaagcccaggcccaggcaauccugcagcaggcgcgccuggcccuucggggaccuccagggccgaugggcuacaccggucguccagguccucuuggacagccaggcaguccugguuugaaaggcgagucuggagaccugggcccacaggggccucgggguccgcaggggcuuacuggucccccggguaaggcagggcggagagggagagcuggcgccgacggcgcuagggguaugccuggggacccaggugucaagggagaucgaggcuucgaugggcugccuggcuugccuggcgagaaggggcacaggggagacacaggagcccagggcuugccagguccuccaggcgaggacggagaacguggugacgauggcgaaauagguccgcgcggccugcccggugaaagcggaccaagaggcuuguuaggaccgaaaggacccccuggcauaccugggccgccuuag

SEQ ID NO: 5277 - RNA, 5031 nt, Artificial Sequence
  Description of Artificial Sequence: Synthetic coding sequence
auggagcgaugcucucguugccaucgguugcuacugcuacugccccugguccuuggguugagugcagccccaggaugggcaggugcaccacccguggaugugcugagagcccuccgcuuucccucccugcccgacggcgugcggcgggcuaagggaaucuguccagccgacguugcauauaggguugcuaggcccgcccagcuuuccgccccuacucggcaguuauucccgggggguuuccccaaagacuucagcuuacucaccgucgugcgcacacgacccggccuucaggcaccccuucuuacccuauacagugcccagggugugcggcaguuaggccucgaauuaggccggccaguccgguuuuuguacgaagaccagacuggacgaccccagccaccuagucagcccgucuuccgcggcuugucccuggccgacggaaaguggcauagggucgccgucgcaguuaaaggccagucugucacccuaaucguagacugcaagaaaagggugacucgacccuuacccaggagugcgagacccguccuugacacacacggugucauaaucuuuggagccaggauccucgaugaggagguuuucgaaggcgaugugcaggaauuggcaaucgugcccgguguacaggccgccuacgaaagcugcgagcagaaggaauuggaaugcgaggggggucagagagaaaggccccagaaccaacaaccucaccgagcccaaagauccccccagcagcagccuagucgcuugcaucggccccagaaccaggaaccucagagucagccgaccgagagucuuuacuacgauuauaaaccaccuuacuaugacgucaugacaacaggaacgaccccagacuaucaggauccaaccccaggcgaggaggaggaaauccucgaaagcagccugcugccaccauuggaggaggccgcccauggcccgaggggacugaagggcgaaaagggugagccggcugugcucgaaccuggcaugcugguggaagggccuccaggcccggagggacccgcaggcuugauagggccaccagguauccaaggcaaucccggaccugugggugacccgggggagagagggccaccuggacgcgcgggccugcccggcucagacggcgcgccaggcccaccaggcaccagccucaugcuccccuuccgcuuuggguccggugggggcgacaaaggcccagugguggccgcgcaagaagcacaggcucaggccauucugcagcaggcucgguuggcacugaggggcccgcccggucccauggguuacacaggucgcccuggcccucucggucagccuggcucccccggccucaaaggugagagcggugaccuggguccccaaggcccccggggcccucagggguugacugggccgccuggcaaggccggccgacgcggucgggcaggagccgauggcgccagaggcaugccaggggacccgggugugaaaggcgaccgaggcuuugauggccuuccaggacuaccaggagaaaaagggcacagaggggacacaggagcccagggccugccggggccaccgggagaggauggagaacgaggcgacgauggugagaucggaccacgcggccuacccggcgaaucagguccuaggggucuguugggcccaaaaggaccaccagguauuccaggcccucccggagugaggggcauggauggaccccagggcccaaaagguucccuaggcccgcagggggagcccgguccgccaggacaacaggggacuccaggcacccaggguuuaccugguccccaaggggcaaucggaccccacggugaaaagggcccacaggguaagcccggucuaccuggcaugccgggcucagacggaccuccugggcacccgggcaaggagggcccaccugggaccaaagguaaccagggaccuucuggaccucaaggcccucugggguaccccgguccaaggggcguaaagggcguugauggaauucggggcuugaaggggcacaagggugagaaaggagaggauggauuccccggauuuaagggcgauauuggcgucaaaggcgauagaggggaggucggcgucccaggaagccgcggcgaagaugggccagaaggacccaagggccguacuggacccaccggcgauccagggccccccggacuuaugggggaaaaagggaaacugggcgugccgggccugccaggcuacccuggcagacaggguccgaaaggcucucucggcuuccccgguuuucccggcgcuucaggggagaaaggggcucgcggccugagcggaaaaucuggaccaaggggcgaacgcgggccaacugguccaagaggacagaggggaccccgcggagcgacuggaaaaagcggcgccaagggcacuuccgggggcgauggcccacauggcccuccaggcgagcgaggucugcccgggccacagggucccaacggauuuccuggcccgaagggcccccccggacccccugguaaagauggauuacccggacauccugggcagcgcggagaagugggcuuccaggguaagaccggaccaccugggccaccgggcgucguggggccucaaggagccgcaggagaaacggggccaaugggcgagagggggcaucccggaccaccuggacccccuggagagcaggggcugccaggcacagcuggcaaggaggggacgaaaggggacccuggaccaccuggagccccgggaaaggacggaccagccggccugcgaggauuccccggugaacgaggacuacccggcacagcuggcgggccuggguugaagggaaaugagggcccuucaggccccccuggaccugccgggagcccgggugagaggggagcagcugggagcggagggcccauuggaccgccugggcgcccaggcccucaaggcccucccggcgccgcuggggagaagggcguccccggggaaaaaggaccgauuggcccuacuggcagggacggagugcaaggaccugucggacugcccgggccugccggaccgcccggcguugcaggagaggauggugauaagggggagguuggcgacccagggcagaaaggcacaaaaggcaauaaaggcgagcacggaccucccggcccaccaggaccaaucggcccaguggggcaaccaggugcagccggugccgauggugaacccggugcucguggcccccagggacauuuuggggcgaagggcgaugaggggacccggggauucaacggcccccccggccccauuggccugcagggacugccaggcccauccggugagaaaggcgagaccggugaugugggcccuaugggcccaccaggaccgcccggcccucggggccccgcaggcccaaacggggcggacggaccccaagggccucccgggggcguggggaaucugggcccccccggcgagaaaggcgagccaggugaaucaggcucaccgggaauccaaggcgagcccggaguuaaggggccaaggggcgaacgcggcgagaagggugaaucagggcagcccggggaacccggaccucccgggccaaaagggcccacaggcgaugacggcccuaagggcaauccaggacccgugggauucccaggagauccgggcccuccaggggaaggcgggccgaggggccaggauggcgccaaaggggauagaggugaagacggcgaaccuggccagccagggagccccggacccacgggggagaauggccccccaggaccucuaggcaaacggggcccggccggcagucccggaucugagggucggcaggggggaaagggcgcgaagggugaucccggugcaauuggcgcuccaggcaagacaggaccagugggacccgcuggccccgccggcaaacccggucccgauggcuuacgaggguugccugguuccguaggccaacagggccguccaggugcuacaggacaggcugggccucccggcccugugggaccuccagggcugcccggacucagaggugacgccggugcaaaaggcgaaaagggccauccaggccugauuggccugauugggccucccggcgagcagggagagaaaggcgaccgaggguugcccgguccccagggaagccccggucagaaaggcgagaugggcauuccuggagcaucuggacccaucgguccuggggggccuccaggguugccaggcccagcugggccaaagggcgcuaaaggcgcgacaggcccaggcggacccaaaggagaaaaaggggugcaaggaccacccgggcaucccgguccccccggugaagugauccagccauugcccauucagaugcccaagaaaaccaggaggucuguggacggcagcaggcugaugcaggaagacgaggccaucccaacggggggcgcuccagguagccccggggggcuugaggagauuuucgguucucuggauucccuacgcgaagagaucgaacagaugcggcggccaacaggcacacaagacucucccgcaagaaccugucaagaucucaagcugugucaccccgaacugccugauggggaguacuggguagauccaaaccaagggugcgcccgugaugcauuuagaguguucugcaauuuuacugccggaggggagacaugcgugacuccuagagaugacgucacccaauuuaguuauguggauuccgagggauccccaguuggagucgugcagcuuacuuuuuugcggcugcuguccgucagugcacaccaggacguaucguaucccuguaguggggcugcuagagacggaccacugcgcuugcguggagcuaacgaggaugagcucaguccugaaaccucuccuuacguaaaagaguucagagaugggugccagacucaacagggaaggaccguacuugaggugcgcacccccguacucgaacagcugccuguccuggacgccaguuucuccgaccuuggagcgccaccaagacgcggcggggugcuucugggaccaguuugcuucaugggguag

SEQ ID NO: 5278 - RNA, 5133 nt, Artificial Sequence
  Description of Artificial Sequence: Synthetic coding sequence
auggagcggugcagcaggugccacagauuguuguuguugcugccacuugugcugggccugucugccgcucccgggugggcaggggccccgcccguugacguccugcgcgcucugagauuuccuucacuaccggacgguguccggcgggcuaaaggaaucuguccagcagacguggcuuaucgcguugcccgaccugcacaauuauccgccccuacacggcagcuguuucccgggggcuuccccaaggauuuuucacuacucacgguggugagaacacgccccggacuucaagccccccuacucacacuguacucugcacagggagugagacagcugggauuggaguugggccgccccgugagguuucucuacgaggaccagaccggcagaccccaacccccuagucagcccguguuucgaggccucucccuugccgauggaaaguggcaccgcguugcagucgccgugaaaggucagucagucacguugaucguagauugcaagaaaagagucacaaggccccucccaagguccgcaaggccgguucuugauacacacggcgugaucaucuuuggagcacgcauccucgaugaggaaguuuuugaaggcgaugugcaagagcuggcuauugucccaggcgugcaggcugccuacgaaagcugcgaacagaaagagcuagagugcgaaggcggacagcgagaacggccacaaaaccagcagccccauagagcccagagauccccccaacagcagccuagucgucuucacagaccccaaaaucaggaaccccaaagucaggauccaacccccggcgaagaggaagagauucuugaguccagucugcugccaccacuggaggaagagcagacugaccugcagguaccccccacggccgacagauuucaggcagaggaguacggcgagggagggaccgacccacccgaaggccccuacgacuauacauacggauacggcgaugauuaucgagaggagacggaguuagggccggcccuuagcgcugagacagcacauagcggggcagcugcacacgguccucgaggucuuaaaggugaaaagggcgaacccgccgugcuggaaccggguaugcuaguggaaggaccucccggaccugaggguccggcugggcuuaucggaccuccaggaauccagggcaaucccggaccugugggcgacccaggggagcggggccccccugggagagccggucugccagggagcgauggggccccaggaccucccggaaccucacugaugcuccccuuuagauuuggaagcggagguggugauaagggacccgugguggcggcacaggaggcccaggcacaggccauccugcagcaggccagacucgcucugaggggcccccccggccccaugggguauacagggcgcccgggcccacuggggcaaccagguucgcccggcuugaagggggaaagcggugacuugggcccacaaggaccccgcgguccucaaggcuugaccgggccacccggcaaggcagggagacgagguagggccggcgcggacggcgcaagagggaugccaggugaucccggcgucaaaggagaucgcgguuuugauggcuugccagggcugccuggagagaagggacacagaggugacacaggugcgcagggacucccaggaccccccggcgaggauggggagcguggcgaugacggcgagauugggcccaggggucugcccggcgagagcggcccccggggcuugcugggcccaaaaggcccucccggcauacccggcccucccggaguucgcgggauggacgguccacagggccccaaaggaagccucggcccgcagggggagccgggaccccccggacagcagggaacuccaggaacccagggccugcccgggccacaaggugccaucgguccgcauggagaaaaaggaccucagggaaagccuggucugccagguaugccugguuccgacgggccuccugggcauccaggaaaggaaggcccgccuggcacaaaaggaaaucaaggcccaagcgguccgcagggaccacugggguauccaggaccgcggggggugaaggggguggacgguaucagggggcugaaaggucauaagggagagaagggagaggauggauucccaggauucaagggcgauaucgggguaaagggagaucgaggcgagguuggggugccaggcagccggggugaagacggucccgaaggcccuaagggacggacgggccccacuggcgauccagggccgcccggguuaaugggggaaaaagggaaacugggaguuccagggcuuccgggauauccuggacggcaagguccuaagggcagucucggauuuccagguuuccccggggcaucuggugaaaagggcgcucgagggcuuucaggaaaguccgguccuagaggugaacgcggaccaacgggcccucgcgggcagcgaggcccccguggagcaacuggcaagagcggcgcaaaggguaccucuggcggagacggcccacacggaccccccggagaaagaggccuccccgguccacaagggcccaacggguucccuggaccaaaggggccaccggguccccccggcaaagauggacugcccgggcaucccggacaacgcggugaaguaggcuuucaaggcaagacagggccgccgggcccucccggagucgugggcccccagggggccgccggugaaacagggccgaugggcgagagaggccacccuggcccgcccggaccacccggugaacaggggcugccagggaccgcuggaaaggaggggacaaaaggcgacccugggcccccgggcgcuccuggcaaggacggccccgccggcuuaagaggguuccccggggagcgcggguuacccgggaccgccggagggccagggcugaaaggcaacgagggucccuccggaccacccggucccgcaggcucgcccggugaacgcggggcugcaggaagcgggggccccauagggccucccggcaggccggggccacaagggcccccaggugcugcuggcgagaaagggguucccggcgagaaaggcccuaucgggccaacaggacgggacggcguucaagggccuguuggccucccaggaccggccgguccacccggcguggccggggaggauggugauaaaggggaggugggggacccuggccaaaaaggcacuaaggggaauaagggugagcacggacccccgggcccccccgggccuauuggcccagugggucaacccggggccgcuggagcagauggcgaaccaggcgcucgcggcccccagggccauuuuggagccaaaggcgacgaggggaccagaggcuucaacggacccccuggaccgauugggcuucaaggacugcccgggccaagcggggagaagggagagacuggcgaugugggccccaugggacccccuggucccccuggaccgaggggacccgcuggccccaacggcgcagauggcccacaagggccacccgguggcgugggcaaucuggguccaccaggagaaaagggcgagccaggggaaucuggcucccccggcauacagggugaacccgggguuaaggguccaagaggagaacgcggagagaagggcgagagcggccagcccggcgaaccagggccccccggcccaaagggaccuacaggagaugauggcccuaaggggaacccuggaccggugggcuuuccaggagacccggguccuccuggcgagggggggccaagaggccaggacggcgcaaaaggcgacagaggggaggauggcgaaccuggucagccgggcagucccggaccaacaggugagaacggcccuccugguccucugggaaagagaggucccgccgguucuccaggaagugaaggucggcagggggggaaaggagccaagggcgaucccggagcaauuggggcacccgguaaaaccggucccguagggccagccggaccugcuggcaaaccugguccagauggccugaggggacugccuggcagugugggccagcagggcagaccaggggccaccggacaggcaggaccuccuggcccaguggggccaccuggccugccgggacugaggggagacgccggagcaaagggugagaagggccauccuggacuuauuggacuuaucggacccccaggcgaacagggggaaaagggggaucggggccugccggggccccaggggucacccggucagaaaggagagaugggaaucccgggggcuagcggucccaucgggccggguggaccacccggacugccaggcccggcaggcccgaaaggagccaaaggcgcaaccggaccagggggaccuaaaggcgagaaaggcguccaggggcccccuggucaucccggcccacccggggaggugauucagccgcucccaauucaaaugccaaaaaagacucgcagaucagucgaugguagucguuuaaugcaagaagaugaagcaauccccacagggggugccccagguucacccggcggccuggaggaaaucuucggaaguuuggacaguuuacgggaagagauagagcagaugaggagacccaccggcacccaagauucgccugcccggacaugccaggaucuuaaacuaugucacccggagcuucccgauggggaauauuggguugaucccaaucaggggugcgcuagagaugcauuccgaguuuucuguaacuuuacugccgguggcgagacuugugucacgccuagagacgacguuacccaauucucauauguggacucagagggaucaccuguuggcguuguucaguugacuuuccuaagacuccucuccgucucagcccaccaagaugugucuuaccccuguuccggagcugcccgggacggcccacugcgacugagaggugccaaugaggacgagcuaucacccgagacgucaccauacguuaaagaguuucgggauggaugccagacacagcagggccguacagugcuggaggugcggacucccguuuuggagcagcuacccgugcuggacgccuccuucucagaccucggggccccucccagaaggggaggagucuugcucggcccagugugcuucaugggcuag

SEQ ID NO: 5279 - RNA, 5211 nt, Artificial Sequence
  Description of Artificial Sequence: Synthetic coding sequence
auggaaagaugcucaaggugucacagacugcuccugcugcucccucugguccuuggccuaagugccgccccaggaugggccggugcacccccugucgaugucuuacgagcccuccgcuuuccuucacucccugacggugugaggcgcgcgaaggggaucugccccgccgaugucgcuuauaggguugcucgacccgcccagcugucugccccaacgaggcagcuuuuuccuggcgguuuuccaaaggauuuuucucugcuuaccgucguccguacucggccggggcugcaagcaccucugcucacucuguauagugcucaggggguucggcaacugggguuggaacuaggccgccccguccgcuucuuguaugaggaucagaccggucgaccccagcccccgucacaaccugucuuucggggucugagucuggcagacggcaaauggcaccgaguggcgguggcuguuaaagggcagucuguaacacugaucguggauuguaagaaacgcgucaccaggccccucccccgcucugcucguccagugcuggacacacacggcguaauuaucuuuggagcccgcauccucgaugaagagguauucgaaggagacguacaggagcuagcaauaguccccggcguucaggcagccuaugaauccugcgagcaaaaagaauuggagugcgaaggggggcagagggagcggccucagaaccagcagccgcaccgggcccagaggucgccucagcaacagccgucaaggcuccacaggccucagaaccaagagccucagucccagcccacagaaucacucuacuacgauuauaagccuccauacuacgacgucaugacaaccggcaccaccccagacuaccaagauccaacucccggggaggaagaggagauucuggagucuagucuccugccuccccucgaggaagagcagacugaucuccaggugccuccuacggccgaccgguuccaggcugaggaauacggugaaggcggaacagacccuccugaagggccuuacgacuacacauacggguacggugaugauuacagagaggagacagaguugggcccggcccuuucggccgaaacagcucacagcggagcagccgcgcacggcccgaggggguugaaaggggagaagggggaaccugcaguacucgagcccgggaugcucgucgaggguccacccggaccugagggaccagccgggcugaucggaccaccaggaauucagggcaaccccggucccguuggugauccuggcgagcgaggccccccaggccgcgcuggucucccagggagcgauggagcacccgggcccccggggacaucucugaugcucccauuucgguuuggauccggugggggagauaagggaccaguuguggccgcacaagaggcacaagcccaggccauccugcagcaagcucgccuugcguugcgggggccuccuggaccaaugggauacacuggaagacccggaccucugggccagccaggcagccccggccucaagggagagagcggcgaccuugggccucagggaccucgcggcccccagggcuugacagguccccccgggaaagcuggccggaggggccgagccggggccgauggagcccgaggcaugccgggcgauccagggguaaaaggcgacaggggauuugauggacucccaggacugccaggagagaaaggccaucggggcgacacaggagcucaaggucugcccggacccccgggggaagauggagagagaggcgacgauggugagauugggccucggggacugccaggagaaucugggccucggggauuacuugguccuaagggcccaccggggaucccuggaccaccaggaguacgcggcauggacggaccgcaggggccaaaggggagccuuggcccccaaggugaaccaggcccgcccggacagcaggggacuccgggaacucaggggcugccaggaccucagggagcuauugggccccacggggagaaaggaccccagggcaagcccggacugccuggaaugccgggauccgaugguccaccagggcauccggguaaggaaggaccccccgggacuaaggggaaucagggaccgucuggaccacaagggccacuuggauacccugguccccgaggcgugaaagguguggacggaaucaggggacugaagggacacaagggggagaaaggggaggacggguuucccggauucaagggcgauauugguguaaaaggagacaggggggaggugggcguuccggguagccgcggagaggacggcccagaaggaccuaagggaagaacugggcccacgggagauccaggcccuccugguuugaugggagagaaggggaaacucggaguccccgggcugcccggauacccaggucgccaaggucccaagggcuccuugggauuucccggcuuucccggggccagcggugaaaaaggagcucggggccugagcggaaagucugggccuaggggcgagcggggucccaccggcccuagaggacaaagagggccucggggcgccacaggcaaaucuggcgcgaaagguaccucggguggcgauggcccacacggaccgccuggagagagagggcuuccgggaccucagggccccaacggauucccuggcccaaaaggccccccaggacccccuggcaaggauggcuuaccaggacacccagggcagcgaggcgaaguaggcuuucaagggaagacgggcccuccgggaccuccuggcguaguugggccccagggcgcggccggagagaccggaccuaugggggaacgaggccacccaggcccaccgggcccgcccggggagcagggccugccugggacugccgggaaagaggguacgaagggggaccccgggccacccggcgccccaggaaaggacgguccagccggacuacgaggguucccgggagaaaggggccugccagguacugccggcggaccaggacugaagggaaacgaaggccccaguggaccaccuggacccgccggaucucccggagagcgcggggccgcugguuccggggggccaaucgggcccccaggcagaccgggcccccagggcccccccggugccgcaggagagaagggcgugccaggggagaaaggcccuauuggcccuaccgggcgugacgguguccaggguccugugggccugccgggacccgcaggcccaccaggcguggccggcgaagacggagauaagggagaggugggagacccuggccagaaggguacuaaaggcaauaaaggagagcacggccccccaggcccuccugguccaauuggcccugucgggcagccaggggccgccggggcggauggcgagccgggagcacgcggcccacaggggcacuuuggggcaaaaggcgacgagggaacuagagguuuuaaugggccucccgggccuauuggguuacaaggucuaccuggaccaucaggggaaaagggagagacaggcgaugucggccccauggggccuccagggccccccggcccgcgcgggccagccgguccaaauggcgcagauggcccacagggacccccugggggcguugguaaccuggggccaccaggcgagaagggcgaaccuggcgaaagcggcuccccugggauucagggagagccuggcguuaaagggccucggggggagagaggcgaaaagggcgaaagcggucaacccggcgaacccgguccacccggcccgaagggacccacaggugaugacgguccaaagggaaacccuggcccgguggguuuuccuggugacccuggaccccccggugagggggggcccagaggacaggacggagccaagggcgauagaggagaggacggagagcccggucagcccggcaguccagggccuacaggggaaaacggaccaccugggccacuugguaagaggggccccgcugggaguccaggcucagaaggacgacaaggcggcaagggugcuaaaggugauccaggggcgauuggagcccccggcaagacagggccugucgggccggccgggccugccggcaagcccgguccugauggcuuaagaggucugccuggaaguguuggccagcaagguaggcccggcgcaacugggcaggccggcccuccugggcccguggggccgccgggauuaccaggcuugcgcggugacgcaggcgcgaagggcgagaagggacauccuggucugaucgggcuuauaggaccgcccggagagcagggagagaaaggcgaucggggacuacccgggccacaggguagccccggccaaaagggcgagauggggaucccuggugcuuccgggccuauuggcccugguggaccuccugggcuaccaggcccagccgggccaaaaggcgcaaagggugcaaccggccccggugggccuaaaggcgagaagggagugcagggacccccgggacauccaggcccaccuggcgaggugauccaaccccugccaauucagaugccgaagaaaacacggagaagcguugacggcagccggcugaugcaggaggacgaagccauuccgacuggaggagcccccgguaguccugggggguuggaggaaaucuucgggagccuggauucucugcgcgaagagaucgagcagaugcgacgccccacaggcacccaggauucaccagcgagaacaugccaggaucugaagcugugccacccagaacugcccgauggagaauacugggucgacccuaaccagggcugugcucgcgaugccuuccguguuuucugcaauuuuacagcugguggggaaacaugcguuacaccacgggacgaugugacgcaguuuucauacguggacucagaagggaguccugugggagucgugcaacugacauuccuaagacuguugucagucucggcacaucaagacgugucauauccuugcaguggugccgcucgagauggaccccugcgauugagaggggccaaugaggaugaacugucgccggagacuucccccuauguuaaggaguuuagggacggaugccagacucagcaggguagaacuguucuugaggucaggaccccaguguuggaacagcucccuguccuggacgcaucuuuuucugaucugggcgcccccccaagacggggagggguuuuacuggguccgguuuguuucaugggcuag

SEQ ID NO: 5280 - RNA, 5070 nt, Artificial Sequence
  Description of Artificial Sequence: Synthetic coding sequence
auggagagauguucuagaugucauagacuucugcuuuugcuuccuuugguucucggguugucugccgcgccuggaugggcgggcgcuccuccaguggauguccugagagcgcuccgcuucccuucccugccugacggcgugagaagggcgaaggggaucugcccagccgauguggccuaccggguagcacgcccagcgcagcuuagugcccccacucgacaacuguuucccggaggauucccuaaggauuucucccuccuaacaguggugcgcacgaggcccggccugcaggcuccgcugcugacccuguacucugcgcagggugugaggcagcucggucuggaacuuggucguccuguaagguuucucuacgaggaccagacuggcagaccacagccuccaucucagccaguguucagagguuuaagccuugccgauggaaaauggcaccgcguggcgguggccgucaagggccaaagcgucacguugaucguggacuguaaaaagcgggugacucguccuuugccccgcucugcccgucccguguuggacacgcacgguguaaucaucuucggcgcccggauccuugacgaggagguguucgagggagacguccaagaacucgccauuguucccggagugcaggccgccuacgagagcugugaacagaaagaauuggagugcgaagguggccagagggagcggccgcagaaccaacaaccgcaccgcgcccagcgcuccccacagcagcagccaucgagacugcauagaccgcaaaaucaagaaccacagucucaggagcagacggaccugcagguuccacccacagccgaccgguuucaagccgaagaguacggggaagguggaaccgauccacccgagggaccuuacgacuacacuuacggauacggagaugacuaucgggaggaaaccgagcugggucccgcccuuucugcagagacagcucacucuggggcggccgcccauggaccuagggguuugaaaggugagaagggggagccugccgugcuugagccugguaugcucgucgagggcccucccggaccugaggggccagcuggcuugaucggaccccccggaauucaaggcaacccugggcccguuggagacccaggagaaaggggcccuccugguagggcugggcugccuggcuccgacggcgcucccggaccacccggaacauccuugaugcuaccuuuuagauuugggucgggcgguggugauaagggccccguggucgccgcccaggaagcccaggcccaggcaauucuccagcaggccaggcucgcacugcgcgggccuccagggcccaugggauauaccggucggcccgggccccugggccagccuggcucccccggccugaaaggggagucaggcgaccuggggccucagggcccaaggggcccucaggguuugacaggccccccuggaaaggcgggacggaggggacgggcuggcgcagauggcgcacgggggaugcccggggauccuggcgugaaaggagauaggggcuuugacggacugcccggauugcccggcgaaaagggccacaggggugauaccggugcacaaggucuaccggggccccccggcgaggauggcgagcguggcgaugacggcgaaauaggaccacggggacucccaggcgagucuggcccucgcggacugcugggaccaaaggggccucccgggauccccggccccccuggcgugcguggcauggacggcccucaagggcccaagggcagccuggggccacaaggagagccagggccuccuggucagcagggaacaccaggcacucaagggcugcccgguccacaaggagcaauaggaccccacggcgaaaaaggcccucaggggaaacccggacuccccggaaugccugggucagacggcccccccggucaccccggcaaagaagggccaccgggcaccaaagggaaccaggggccaucagggccgcagggcccgcuuggauauccagggccccguggggugaaggggguggaugguauacgcggccucaaagggcauaagggcgagaaaggagaagauggauuuccuggcuucaaaggggacauugggguuaagggggaccguggcgaggugggagugccaggcagucgcggugaggauggcccugaggguccuaagggcagaaccggaccgaccggggacccgggcccgccgggguugaugggcgagaaagggaagcugggugucccugggcugccaggcuauccagguagacagggaccuaagggcagucuuggguuuccaggcuuucccggcgcuagcggagagaagggcgcacguggauuaagcgggaaauccgguccaaggggugagcgcgggccaacggggccccgcggacagcguggcccacguggagcuacaggcaagucaggggcaaaaggaacuagcgggggcgauggcccacacggaccacccggugagcgcggucuuccaggcccccaaggucccaacggcuuuccagggccaaaggguccuccggguccuccagggaaagauggucuaccagggcacccaggccagcggggcgaaguugguuuucaaggcaaaaccggcccuccaggcccuccaggagugguuggaccacagggggcugcuggugaaacuggcccaaugggagagcgcggccacccaggccccccagggccuccaggcgaacagggccucccgggcacugcuggcaaagaaggaaccaaaggagacccugggcccccuggcgcucccggaaaagacggcccugccggacuccguggcuuccccggggaaagaggucugccuggcacugcugggggaccaggucucaaggguaaugaagguccuucuggaccucccgguccugcuggcagucccggugagcgaggggccgcggguaguggcggcccuaucgguccucccggacgucccgggccccaggguccucccggcgcugcuggcgagaagggcgugccuggggagaagggaccaauuggacccacaggccgcgacggcgugcagggacccgucggccugccaggaccggccggaccucccggugucgcuggggaggauggagacaagggugagguuggugauccgggacagaaagggaccaagggcaacaaaggagagcacgggccaccaggcccgccuggacccauugggccuguggggcagccuggagcggccggggcggacggagaaccaggggcaagagggccccagggccacuucggagccaagggggaugaaggaacccgaggauuuaauggccccccggggcccaucgggcugcagggguugcccggcccuaguggagagaaaggagaaacuggcgauguagguccgauggggccuccugguccaccgggcccacgggggcccgccggacccaacggagcugacgggccacagggaccucccgguggagucggcaauuugggccccccuggugagaagggcgagcccggggaaagugguuccccaggcauucagggugaacccggggugaaggguccaaggggcgagcggggagagaagggagaguccggacaaccuggcgaacccggaccuccgggaccaaaggggccuacaggggaugacggaccuaagggcaauccaggacccgucggguuccccggagaucccggcccaccaggagagggugguccuaggggucaagacggagccaaaggagaucggggugaagacggcgaaccugggcagccuggaucuccuggcccgacuggugagaauggcccgccuggcccucugggcaagcgagggccagcagggagcccuggaagugagggucgucaaggcggaaaaggcgcgaagggugaccccggggcuauuggggcgcccggaaaaacuggucccguaggcccugccggacccgccggaaagccaggccccgauggacugagaggauugcccgggucugucggacagcaaggaagacccggugcaacaggccaagccggucccccaggaccagugggcccaccaggacucccuggacugcgcggagacgcuggugcuaagggcgagaagggucacccaggguuaaucgggcucaucgggccaccuggagaacaaggggaaaaaggagaucgagggcugccaggaccacagggauccccaggccaaaagggugagauggguaucccgggggcaagcggaccuaucgguccuggcggcccuccgggccucccggggcccgcaggaccgaaaggcgcuaagggugcaaccggcccaggcgggccaaagggcgagaagggcguccaggguccaccaggacacccaggcccaccuggcgaggucauccaaccccuaccuauccaaaugccaaagaaaacgcgccgcucuguagacggcucucgccuuaugcaggaggacgaagccaucccuacugguggggcucccggaaguccaggaggccuugaagagaucuuugggagucucgacuccuuaagagaggagauugagcagaugaggagaccuacuggaacucaggauucaccagcacguacuugucaggaccuaaagcuuugucacccagaauuacccgacggagaguauuggguggacccuaaucagggaugugcccgagacgccuuccgggucuuuugcaauuuuaccgcugggggggagacaugcguaacuccuagagacgauguuacucaguuuucuuacgucgacucagagggaagcccugugggagucguacagcugacauuccuuaggcugcuguccgucagcgcccaccaggauguuuccuaccccugcagcggugccgcaagggaugggccuuugaggcugcggggagccaacgaagacgagcuguccccagagacaucccccuauguaaaggaauucagagaugggugccagacacagcagggaagaaccguuuuagaagugaggacgccaguucuugagcaauugccugugcucgacgcgagcuuuuccgaucugggggccccuccaaggcgaggagguguguugcucggcccugucugcuuuaugggguag

SEQ ID NO: 5281 - RNA, 921 nt, Artificial Sequence
  Description of Artificial Sequence: Synthetic coding sequence
auggauuggcgcgcuucagaggcuuggaugguuccaagggccccgaagggcgccugggacccacgggaaucccaagaccugcuugacaaucgugcuccuuugggaccuagaguguucccuggaccccgcgugcccuccgcacugauggaaagaagagugcugaaggggucacaaggaucuccugccugcccaggcccuccaggcgaaguuauucagccucugcccauccaaaugcccaaaaagacccggcgcagcguugacgggagucggcucaugcaggaagacgaagccaucccgacaggaggggccccuggaagccccgggggacuggaggagaucuuuggaucccucgauucccugcgcgaggaaaucgaacagaugcgaagaccaaccggcacacaagacucgcccgcccgcaccugucaagaccugaaacucugccacccugaacucccugauggugaauacuggguagauccuaaccaaggcugcgcuagggacgccuuccgcguguucugcaauuuuaccgcuggcggugaaacaugcgugacaccaagggacgacguuacucaguuuagcuauguggacucagagggaucaccugucggcguggugcagcuuacuuuucuuagacuccuuucuguaagugcccaucaagacguuucguacccuuguuccggugcggcccgagacggaccccuucggcugagaggugcuaaugaagaugaauugucuccagagaccucuccuuaugugaaagaguuccgugacggcugucaaacccaacagggccguaccgucuuagaaguuagaacaccaguucucgaacagcuaccugugcuugacgccuccuuuagugaccucggggcuccuccccgcagaggcgguguguuguuggguccuguguguuucaugggauag

SEQ ID NO: 5282 - RNA, 4890 nt, Artificial Sequence
  Description of Artificial Sequence: Synthetic coding sequence
auggagagguguucucggugucacagacuccucuuacuguugccauuaguguugggauugucagcagccccuggcugggcaggcgccccuccuguggaugugcuucgugcccuucgguuucccagccuuccugauggagugagaagagcuaaaggcauauguccagccgacguggcguaucguguugccagacccgcccagcugagcgcuccgacccggcaacuguucccaggagguuuucccaaggacuucagcuugcugacugugguaagaacucggccagggcugcaagccccacuguugacccuguacagcgcccagggcguaaggcaacugggccucgaguuagggcgacccgucagauuucuguaugaggaucagacuggcagaccgcaaccuccaucacagcccguuuuucguggccuaucacuugcugacgggaaauggcaucgggucgcagucgcggugaaaggacaguccgucacccugaucguugauugcaaaaaacgggugaccaggccccugccuagaagcgcccggccagugcuggacacacacggagucaucauauucggagcaaggauccuugaugaagaggucuucgagggcgaugugcaggagcuugcaauagugccuggggugcaggccgcauacgagucaugugagcagaaggaguuggaaugugagggaggacagagagaacgaccccagaaucagcaaccacaucgcgcacagcgaaguccccagcaacaacccucccgccugcacagaccacagaaucaagagccucagucacaagcugcucacgguccucgaggcuugaagggagagaaaggggagcccgcaguccuggaacccggaauguugguugaggguccccccggccccgaaggccccgcagggcucaucgguccaccaggaauucaaggcaaccccggcccugucggugacccuggagaaaggggaccacccgggcgcgcaggacuucccggguccgauggggcucccgguccuccgggaaccucacuuauguugccauuccgauuugggaguggagggggcgauaaggggccugucguugccgcgcaggaagcgcaggcccaagccauccuccaacaggcucgcuuggcccugcggggcccgccuggccccaugggauauacuggacggcccggaccccugggccagccagguaguccgggccugaagggggaauccggugaucucggcccccaggguccccgugggccccagggacugacaggaccaccagguaaagccgggcgcagggguagggccggagccgacggagcacgggggaugcccggcgaccccgggguuaaaggagaccgcgguuucgauggccuucccggacuucccggugaaaagggccacaggggcgauacuggcgcccagggucugccgggaccaccuggggaggacggagagagaggcgaugacggugagauugggccacggggucuaccaggcgagucugggccucgggggcuccucggucccaaagggcccccuggaauuccuggaccuccagguguucgcggcauggaugggccccaggggcccaaaggaagucugggaccacaaggcgaaccaggaccucccggccagcagggaaccccuggaacucaggguuuaccuggcccacagggggcaaucgguccucacggcgagaaaggcccucaaggaaaaccugggcugcccggcaugccaggaagcgacggcccgccaggucacccaggaaaagaaggcccucccggcaccaagggaaaccagggccccuccggcccucagggcccacugggguaccccgguccacggggcgugaagggaguggacggcaucaggggguuaaagggucauaaaggcgaaaagggcgaagacggcuuuccaggcuuuaaaggcgacauagguguuaaaggcgauagaggcgaggugggcgugccuggcagcagaggcgaggacggaccugaaggaccuaagggaagaacaggaccaacuggugaucccggccccccgggccucaugggcgagaaaggcaagcuggggguucccgguuuaccugguuaucccggucgucagggucccaagggcagccugggguuccccggauucccaggugccuccggugaaaaaggcgcacgcgggcugagcggaaaaucuggcccacggggggagagagguccuaccggaccaagaggccaacguggcccacgcggggcuaccgggaagucaggcgcaaaggggacuucuggcggagacgggccccauggcccaccgggcgaaagaggacucccuggcccucagggccccaauggguuuccuggaccuaaaggucccccaggaccaccuggaaaggauggccuucccggacaccccggucagcggggcgaaguuggguuccagggcaagacagggcccccuggacccccuggugugguugggccacagggcgcugcaggagaaaccggcccuaugggggagcgugggcacccuggucccccugggccaccuggagaacagggccugccgggaacagcuggcaaagagggaacaaaaggggacccgggccccccaggagcuccgggcaaagaugggccggccggucucagagguuuuccgggggaacggggccuucccggcaccgccgggggacccggccucaagggcaaugaagggcccucaggaccacccgggcccgcagguucuccuggcgaaaggggagcagcuggcuccgggggacccaucggcccgccagggaggcccgguccgcagggaccaccaggagccgcaggcgagaaaggagucccuggcgagaaaggaccgauuggacccaccggaagagacggcguucagggccccguuggacuaccgggaccagccgggccccccggcguggcuggcgaagacggcgauaaaggggaggugggagacccaggccaaaagggcacuaaaggaaacaaaggcgagcaugggccacccgggccucccggaccuauuggcccuguuggccagccuggggccgccggugccgauggagagccuggagcacgagguccacagggacacuuuggugccaagggagacgagggcacccguggcuucaauggacccccugggccaaucggucugcaggggcugcccgguccaucuggugagaaaggcgaaacuggagacguugggccaauggguccaccagggccuccaggaccaagggggcccgcagguccuaacggcgcagacggcccucagggccccccugggggcguugggaaucuugggccaccuggggaaaagggcgaaccaggcgagagcggcucaccaggaauacagggagaaccuggcgugaaaggaccccgcggcgagcggggggaaaagggugaaucuggccagccgggagagccaggaccacccggaccaaaagguccaaccggagacgacggccccaagggcaauccagguccaguuggguuuccgggagauccuggcccaccgggggaaggcgggccccguggccaagauggggcaaaaggagaucgaggggaggacggggagcccgggcaacccggaucaccuggcccaacuggcgaaaacgggcccccagggccucugggcaaacgagggccggcuggcagccccgggagugaagggcggcaaggggguaagggcgcaaagggcgauccuggugcaauaggcgcuccuggaaaaaccggucccgucggccccgccggaccagcuggcaagccgggaccagacggacugcggggccucccaggcucagucggucaacaggggcgaccgggcgcaacgggucaagccggcccaccuggaccgguugguccacccggccucccggggcugaggggcgacgcaggcgcaaagggagagaagggccauccuggacuuaucggcuugauuggaccuccaggugaacagggagagaagggggacagaggucuacccggcccucagggaagucccggucagaagggugaaaugggaaucccuggggccagcggcccgauugggccagguggacccccuggacucccaggcccagccggcccaaagggggcaaagggagccaccggucccgguggcccaaagggagagaaaggaguucaggggcccccaggucacccuggaccuccaggcgaggugauccagccucugccaauucagaugcccaagaagacccgccggaguguggacggaucucgucugaugcaggaagaugaggcaauaccuacgggcggcgcccccgggaguccaggaggacuugaggagauuuuuggcagcuuggacagccugcgcgaggagauugagcagaugcggagaccuacuggaacucaggauagccccgcucgcacuugucaggaccucaagcucugccacccagaacuaccggauggcgaguauuggguggaucccaaucagggaugcgcccgggaugccuucagaguuuuuuguaauuuuacggccggcggugagacuugcguaacuccccgcgaugauguuacccaauucucuuacgucgauagcgaggggaguccaguaggaguugugcagcugacauuucugcgccuccuuagcguaucugcucaccaggauguuagcuacccuugcagcggugccgcuagggacggcccguuacgucugaggggggcaaacgaagaugaacucagcccugaaacauccccuuaugugaaagaguuucgcgacggcugccagacacagcagggaaggacugugcuggaaguaaggacuccugugcuggaacaguugccaguccuugacgccuccuuuuccgaucuuggagccccaccucgcagaggcggcguauugcuugggcccguuuguuuuaugggauag

SEQ ID NO: 5283 - RNA, 5148 nt, Artificial Sequence
  Description of Artificial Sequence: Synthetic coding sequence
auggagagguguagucguugccacagacugcuccuucuacugcccuuaguucucggacucucugcggccccugggugggcuggcgcacccccagucgauguucugagggcccugagguuuccaucccuacccgaugggguuagacgggccaaaggaaucugucccgcagauguggcauauagggucgcuagaccagcucagcuaagcgcuccaacacggcagcuuuuccccggcgguuucccuaaggacuuuucucuacugacaguggugcgaaccagaccaggucugcaggcuccacugcuaacgcucuauuccgcucagggagugagacaguugggccuagagcuggguagaccggugcguuuucuauacgaggaucagacaggaaggccacaaccccccagccagccuguguuccgagggcugagcuuagcagacggaaaauggcaccgaguggcaguugcugugaaaggccagucuguuaccuugauugucgacugcaaaaagagagucacucgaccccuuccuaggucagccagacccgugcucgauacacauggaguuaucauauuuggcgccagaauccuggacgaggagguuuuugagggcgaugugcaggaauuggccauugugccuggcguccaagcagccuaugagucaugugagcagaaggaauuagagugugagggcggacagcgcgagaggccacaaaaccagcagccacaucgggcacagcggagcccacagcagcagccaagccggcugcaccgaccucaaaaccaagaaccucagucucaacccacggaaagucucuacuaugacuacaagccccccuauuacgauguuaugacgaccggaacuacuccagauuaucaggaacaaacugaccuccagguaccuccgacagcagacagguuccaggcggaagaguacggugaaggcgggaccgauccacccgagggacccuaugauuacaccuacggguauggcgaugauuaccgugaggaaacggaacucgggcccgcuuugagcgcugagacagcccacaguggagcagcagcacaugggccgcguggucugaagggagagaagggagagcccgcagugcuggagccugggaugcucguggagggacccccaggacccgaagggccagccgggcugaucgggccgcccggcauucaagguaaucccggcccagucggcgauccuggcgaaagagguccuccuggcagggcuggccucccaggcagcgauggcgcgcccggccccccagguaccagccuuaugcugcccuuucgguuugggucuggggggggagacaagggaccagugguggccgcccaagaggcccaggcucaggcaauucugcaacaagcucggcucgcccuccgggguccacccggaccaaugggguauacagggagaccuggcccucuggggcagccagguucuccugggcugaagggagaguccggagaucuuggcccucagggaccgcguggaccacaggggcugacggguccuccaggaaaggcggggcgccggggccgggccggugcugacggugcucggggaaugccgggagauccaggcgugaagggcgaucggggauuugauggacugccagggcugccaggcgaaaaaggacacaggggagauaccggggcccagggacuaccaggcccccccggugaggacggcgaacgaggcgaugauggugagauagggccacgcggucucccaggggaauccggcccuagaggacuucuugggccaaagggaccuccuggaauccccggcccccccggcgugcgcggcauggauggcccccaaggcccaaagggcagcuuaggaccucagggugagcccggcccaccuggucaacagggcacaccugggacgcaggggcugccagguccccagggggccaucggaccccauggcgagaaggggccccagggaaagcccggguugccuggcaugccuggaucugauggacccccuggccauccagggaaggaggggcccccaggcacgaaaggcaaccaaggcccuuccggaccacaggguccacugggcuauccugggccucgaggagugaaagggguagauggcaucagaggccugaagggccacaagggagagaagggcgaagacgguuuuccaggcuuuaaaggggauauuggagugaagggggaccggggggagguggguguuccaggaucccggggcgaagauggaccugagggcccuaaaggccgcacgggaccaacuggggacccaggccccccagggcugaugggcgaaaaagggaagcuuggugugccuggucugccaggcuauccagguagacagggucccaagggguccuugggguucccaggguucccuggcgcuaguggagaaaagggagcgaggggcuugucaggcaagagugguccaaggggagaaagaggcccaaccggcccuagaggccagagagguccucggggggccaccgggaaaucuggagcgaaaggcacuagcggcggagauggcccacacggaccaccgggugagagggguuuaccugggccucaaggcccuaauggauuucccggaccaaaaggcccgccgggcccuccuggcaaagacggcuuaccagggcaucccggucagcgcggagaagucggcuuccagggcaaaacugggcccccugggccccccggcguaguaggaccucagggugcugcaggagaaacaggcccuaugggugagcgcggccacccuggcccgcccggaccacccggugaacaagggcugccaggcacggccggcaaagagggcacuaagggcgaucccgggccuccgggggcaccuggaaaggauggaccggccggacugcgcggauuccccggagagcgcggccugccagggaccgcagggggucccgggcuuaaaggaaaugaaggccccagcggcccucccggcccagcaggaagcccaggggaaagaggcgccgccgggaguggugggccaauuggaccuccugggcgaccagguccucagggcccgccuggcgccgcaggcgagaaaggggucccaggugaaaaaggacccaucggaccgaccggacgcgacggggugcaggggccugugggccugcccggccccgcuggccccccggguguggcuggggaggauggagacaaaggagaagugggcgacccuggccagaaaggcaccaagggcaacaagggagaacauggcccgccagggcccccagggccaaucgguccagugggacaaccuggggcugccggagcagacggggagccaggugcacgaggcccgcaaggccacuuuggcgccaagggugacgagggcacaaggggcuucaacggacccccuggccccaucggucuccagggccugccgggccccaguggcgagaaaggagagacaggagauguggguccaaugggaccaccuggaccaccagguccaagaggccccgccggcccgaauggcgccgacgguccgcaaggaccaccuggcggagugggaaaucuggggccaccuggcgaaaagggagagccaggggaauccggcagcccgggaauucagggcgaaccaggggucaaaggaccucggggagaacgcggggagaagggcgagagcggccagccuggggagccuggaccacccggacccaaaggccccacaggcgacgacggaccuaaggguaaccccgguccuguugguuucccuggagauccggggccacccggggaagguggaccucggggacaagauggugcgaaaggcgaucggggcgaagauggagagccuggccagcccggaaguccugguccgacgggcgaaaauggcccuccagggccucuggggaagagaggcccggccgguagccccggaucagagggccggcagggaggcaagggcgcuaagggugaccccggcgcuauaggcgccccaggcaaaaccggcccuguagggccugcuggcccagccggaaaaccugguccugauggucugaggggacugccugggucaguuggccagcaggggaggccuggggccaccggccaggcaggcccccccgggccaguggggccuccuggacuucccggauugcggggggacgcaggugcuaagggagagaaaggccaccccgggcuaauuggccugauuggcccgccuggggagcagggcgaaaagggcgauagggguuugcccgggccucaaggcuccccaggucagaaaggugaaaugggcaucccaggagcgaguggucccaucggacccgguggaccuccuggccugcccggcccagcagggccaaaaggcgcaaaaggagccacggggccuggcgggcccaaaggggagaaaggggugcaagggccuccgggccauccagggccacccggcgaagugauucagccccucccuauccaaaugcccaaaaagacucgcagaucuguagacggaucccgcuugaugcaggaagacgaggcuaucccuacaggcggugcuccggggucccccgggggauuagaggagauauuuggcucucucgacuccuugcgugaagagauugagcagaugcgccguccuacaggaacacaggacagcccagcccggacuugccaggaccugaagcugugccaccccgaauuaccggacggagaguauugggucgacccgaaccaagguugcgccagggaugccuuucggguguuuuguaauuuuacugcaggcggggaaaccugugugacccccagggaugacguuacucaauuuuccuaugucgacuccgaaggcucucccguugguguggugcagcugaccuuuuugagacugcuuuccgugagcgcacaucaggaugucucauacccuugcucaggagcagcucgcgacggcccccuacgguugcgcggcgcaaaugaagacgagcucagcccagaaaccuccccauaugucaaggaauucagagaugggugucagacccaacaggguagaacugugcucgagguccguacacccgugcuugagcagcugcccguccuagaugcauccuucucagaucuaggcgcuccaccccgcagaggagguguuuugcuugggccugugugcuuuaugggcuag

SEQ ID NO: 5284 - RNA, 4968 nt, Artificial Sequence
  Description of Artificial Sequence: Synthetic coding sequence
auggagcgcuguucucggugucaucgucugcuucuacuucuaccucugguuuuaggccuaagugccgcaccgggcugggccggcgcgccacccguggacguguugagagcacuccguuuuccuucacugccagaugggguccgacgggccaaggggauuugcccagcugacguggcauaucgaguugcaagacccgcccagcuauccgcgccuacucgccagcuauuccccggcgguuuuccgaaagauuuuagucuccuuacagugguucgaacgagaccugggcuucaagccccacuauuaacucuguauagugcccagggugucagacagcuuggccuugaacugggcagacccgugcguuuuuuguaugaggaccagacaggcaggccccaaccuccuucacagccugucuuccggggucugagccuggcugacggcaaauggcaucgcguagcuguggcgguuaagggccagagcguaacucugaucguggauugcaagaagagagugacuagaccccuccccagaucugccagaccuguucuugauacacacggcguuaucaucuucggcgcccggauacuugaugaagaaguguucgaaggagacguccaagagcuggcaauugugccaggggugcaggcugcuuaugaaucgugugagcagaaagagcuggagugcgagggcggacagagggagcggccccaaaaucagcagccgcaccgggcucagaggucuccccagcaacagccuucaagacuacaccggccacagaaccaagaaccgcaaagucagcccacagagagccuguauuacgauuacaagcccccuuacuacgaugugaugacaacaggcacaacgccagauuaccaggcagcucauggcccuagaggccucaaaggagagaaaggcgagccagcuguguuggagccaggcaugcuuguggaggggccucccggcccugaaggaccugcaggccugauuggaccucccggcauucagggcaauccaggaccagugggggacccuggagagcguggacccccgggccgcgcuggacucccuggcuccgauggcgcuccgggcccaccagguacaagucugaugcuaccguuccguuuugguucuggcggaggggauaagggcccugugguugcugcucaggaagcccaggcucaagcuauccugcagcaggcccgcuuggcgcugcgcggcccuccagguccgaugggauacaccggucgcccaggcccgcuuggccagccgggcaguccggggcuuaagggugaaucuggagaccuugguccgcaggggccgagagguccccaggggcugacagguccuccugggaaggccggucguaggggacgcgcaggugccgacggcgccaggggaaugccaggggaucccggagucaaaggugaccgugguuuugacgggcucccaggguugccaggcgagaaagggcacagaggcgauacuggcgcucagggccuacccggaccaccuggcgaggauggcgaacgcggggacgacggcgaaaucggaccaagaggccugccaggggaguccggcccccgcggucuucucgggcccaaagggcccccugggaucccaggacccccuggugucagagggauggacggcccacaaggcccuaaaggcucacuuggcccacagggggaacccgggccuccugggcagcagggcacaccagguacccaggggcugccaggcccccagggggccauuggcccucauggagagaaaggaccccaaggaaaaccaggcuugccugggaugccaggcucugacggaccaccgggacauccagggaaggaagguccgccugggaccaaaggaaaucagggccccucaggaccccaggggccucuuggcuacccuggcccaagaggagugaagggugucgaugggauucggggacugaaagggcauaaaggcgagaagggcgaggauggauuuccgggguucaagggugauaucggcgugaaaggggauagaggagaggugggcgugccuggguccaggggagaagacggcccagaaggcccaaaaggaaggacaggacccacgggugacccgggaccaccaggccuuaugggcgaaaagggaaagcucggggugcccggccucccaggguacccugggcggcagggaccuaagggcagccuuggguuucccggguucccuggugccucgggggaaaagggagcccgggggcuguccggaaaaucgggcccuagaggcgagagggggccaacagggccgaggggacagcgggguccacguggggcaacaggcaagagcggcgccaaaggcacuuccgggggagacggaccucauggaccaccuggcgaaaggggacugccuggcccccagggacccaacggguuuccugguccuaaggguccuccggggccuccugggaaggauggacugccuggacaccccgggcagcgaggagaggugggguuucagggcaagacuggaccgccaggaccaccagguguuguggguccucagggagcugcuggagaaacugguccaaugggggagcgugggcaccccgggcccccuggcccccccggcgagcaggggcucccaggcacagccggaaaagaggggacuaaaggggacccaggaccucccggggcacccgggaaagacggccccgccggacuucgcggcuucccaggggagagaggucugccuggaacagccggugggcccggacucaaagggaacgaaggcccaagcggcccaccuggacccgccggcucacccggcgagaggggggcggcuggcagugggggucccauaggcccuccugguagaccaggcccccagggcccucccggggccgcaggugagaagggagugccaggagagaagggaccuauuggucccaccggacgggauggaguacagggacccgugggguuacccggcccugcaggcccccccggugucgccggcgaggacggcgacaaaggcgaaguaggagauccuggccagaagggaacuaaagguaacaaaggagagcacggcccacccgggccaccagguccuaucggaccugugggccagccgggcgccgccggggccgauggagagccuggggcacgcggcccccaaggucacuucggcgcaaagggugaugagggaacccguggcuuuaaugguccuccaggcccuaucgguuugcagggacugccggggccgagcggcgaaaagggggagacgggugacgugggaccaauggguccaccugggccuccaggacccagaggaccagcuggcccuaacggugcagauggaccacaggguccuccuggcgguguuggcaaccuuggacccccuggugagaagggagagcccggugagucaggguccccaggaauacagggcgaaccuggaguuaaagggccacgaggggaacgaggugaaaaaggagaaucuggccagccaggagaaccaggaccaccaggucccaaggggccgacuggcgacgauggcccaaaggguaacccuggcccugugggcuuccccggagacccugggccgccaggggaaggaggcccccgagggcaggacggggccaaaggcgaccgaggagaagacggggagccuggucagcccgggagcccgggcccuacgggggagaacgggccaccaggcccuuuaggcaagcgcgguccagccggcucaccgggaagcgaggggcggcagggggguaaaggcgcuaagggggauccuggugcuauuggcgccccugggaaaacuggacccgucggcccagcuggcccugcaggcaagccaggaccagauggccuucgaggauugccaggaucuguuggccagcagggucgcccaggcgcaacaggucaggcaggcccuccugggccugugggcccucccgguuugccuggccuaaggggcgacgcaggagccaagggggagaagggacauccgggucucaucggccugauagggcccccaggugagcagggagaaaaaggggauagaggccuuccuggaccucaaggcagcccgggacagaaaggggaaaugggcauuccgggggccuccggucccaucgggccagggggcccaccaggcuugccaggccccgcaggaccaaaaggagcaaagggugccacuggucccggcggaccuaaaggcgaaaagggggugcaagggccccccggccacccaggcccgccaggggaagucauucaaccacugcccauccagaugccaaagaagacacggcgaucagucgauggaagucgccuuaugcaggaagacgaggcaaucccaaccggaggcgcuccaggaucucccggcgggcuggaggagaucuucggcucccuggacucauuaagggaggagaucgagcagaugagacggcccaccggcacccaggauuccccugcuagaacaugucaagaucuuaaauuaugucaucccgaauuaccagacggcgaguauugggucgaccccaaccaagguugugcuagagaugcguucagaguguucuguaacuucacagccggcggagaaaccugugucacuccgcgcgacgauguaacucaauucaguuauguagauuccgagggguccccuguggggguaguccaacuuacuuucuuacgccucuugaguguguccgcccaccaggaugucuccuacccuugcuccggagccgcccgggauggaccacugaggcugcgcggagccaacgaggaugaacucucucccgaaacuucuccuuacguaaaagaguuucgggacggcugccagacucagcagggcaggacuguccuggaagugaggaccccaguucuugagcaacucccgguguuggaugcuagcuucucagaucucggugcuccuccuaggcguggcggaguacuccugggacccgucuguuuuaugggauag

SEQ ID NO: 5285 - RNA, 9192 nt, Artificial Sequence
  Description of Artificial Sequence: Synthetic coding sequence
augcgcagcaggcugcccccugcacucgcagcccuuggcgcagcacugcuccuguccucaauugaggcagaagucgaucccccaagugaccuuaauuucaagaucauugaugagaacacagugcauaugucuugggcaaagccaguggauccaauugugggcuaccguauuaccguggaucccacuaccgauggacccaccaaggaguuuacacucagcgccucuaccacggaaacccucuuaagugagcuggugcccgagaccgaauaugucgugacgaucacaucauacgaugagguggaggaaaguguccccgucaucggccaauuaacuauucagacugggucuagcaccaagccaguggagaagaaaccagggaagacugagauacaaaaaugcagugucagcgcuuggacugauuuaguguuccuugucgacgggaguuggucugucgguagaaacaacuuuaaguacaucuuggacuucaucgccgcccuaguaagcgcuuuugauaucggcgaagagaagacucgagugggugucgugcaguacagcuccgacacuagaaccgaguucaaccuuaaccaguacuaucagcgggacgaguugcuggcggccauaaagaagauccccuacaagggggguaauacaaugacgggcgaugcaauugauuauuuagucaaaaauacguuuacagaauccgcuggggcccggguagguuucccgaaagucgcaauaauuauuacagacggcaaaagccaggaugaaguggaaauuccugcgagggaauugaggaacguggguguugagguguucucacuggggaucaaagccgcagacgccaaagagcucaaacaaauagccaguacgccuucauugaaccacguguuuaauguagcaaauuuugaugccaucguagacauacagaaugaaauuaucagucaggucugcuccgggguggaugagcaacugggcgagcuggugucaggcgaggaggucgucgagcccccuagcaacuugaucgccauggaggucuccagcaaauaugugaagcucaauuggaacccaucccccuccccugucacuggcuauaaggucauacugacuccaaugacagcagguucgagacagcacgcacuauccgucgguccacaaacgacaacgcugucggugagggauuuguccgcugauaccgaauaccagaucucaguguccgcaaugaaggguaugacgaguagcgaaccuaucagcauaauggaaaaaacacaacccaugaaggugcaagucgaaugcuccaggggcguggauauaaaagcugauaucgucuuucucguggauggcuccuacucgauuggaauagcuaauuucguuaaagugagagcauuucuggaggugcuugugaagagcuucgagauaagcccaaacagggugcagaucucucuuguccaauauagccgcgauccacacaccgaguuuacccugaagaaguuuaccaagguagaagacaucaucgaggccaucaauaccuuuccuuacagggguggaagcaccaacacuggaaaagcaaugacauacguaagagagaagauuuucguacccucaaaaggcagccgguccaacgugccuaaagugaugauucuuaucacugauggaaaaagcucugaugccuuuagggacccagccauuaaguuacggaacucugauguggagaucuucgcagucggcgucaaggacgccguaaggucggaauuagaggcgauagcuuccccacccgccgaaacccauguguucacuguggaggacuucgaugccuuucagcguauuucauuugaauugacacagagcauaugucuuagaauugagcaagaacucgcugcaauaaaaaagaaagcuuacgugccuccaaaagacuugucauuuagugaggugacaagcuacggguuuaagacgaacuggucucccgccggcgagaauguguuuuccuaccacaucacauauaaggaggcugcaggagaugacgagguaacugucgucgagcccgcaagcuccacgucagucguguuaucuucacucaaaccagaaacucuguauuugguuaacgugacugccgaauaugaggacggcuuuucaauaccccuggcuggcgaagaaacaacagaagaggugaagggcgccccuagaaaucucaaagugacugaugagaccacggauuccuucaaaaucacauggacccaggcaccgggcagagugcucagguaucgaauuauuuaucgaccaguggcaggcggugaauccagagaggucaccacaccucccaaccagaggagaagaacacucgaaaaccugaucccugauacgaaguacgaagugagugugauccccgaauacuuuucggguccagguacccccuugacaggaaaugcggcaaccgaggaagucagaggcaauccccgcgauuuacguguuagcgacccaaccacgaguacuaugaaguuaaguuggagcggugcgcccggcaaggugaagcaguaucugguuacguacacccccguggcuggcggugaaacccaagaggugaccguaagaggagauacaacaaauacgguguugcaggggcugaaggaggguacacaguacgcucucagugugacagcccucuaugcaucuggggccggcgacgcucucuuuggggaagggaccaccuuggaggaacgcgguucaccacaggaccucgucacaaaggauaucacggacacuagcaucggggccuacuggaccucagccccugggauggugcgaggauaucgcguuucauggaagagccuguacgaugacguugacaccggggagaagaaccuuccagaagacgcaauccacacaaugauugagaaccugcagccggagacaaaguaccgaauuuccguuuucgcaacuuacagcagcggcgagggagagcccuuaaccggggacgcuacgacugaacugagucaggauucuaagacacugaagguggacgaagaaacagaaaacaccaugagggugacauggaaaccagcgccaggaaaggugguuaauuaucgcguggucuacagaccccaugggagaggcaagcagaugguugcaaaggugccgccaaccgucacaagcacugugcugaagagguuacagccgcagaccacauaugacauuaccgugcuccccauuuacaaaaugggggagggaaaacuacggcagggguccgggacaaccgccagcagguuuaaaucuccaaggaacuugaaaaccuccgauccuacaaugucauccuuccgagucaccugggagcccgccccgggagaggugaaaggcuacaaagucaccuuucacccuacaggggaugauaggcggcugggcgagcuuguggugggaccuuacgacaauacugugguccuggaagaacuccgggccgggacuacguacaaggucaacguguucggcauguuugaugguggcgagaguagcccacuggucggccaggaaaugacuacgcucagugauaccaccguaaugcccauccuauccagcgggauggagugucucaccagggccgaggccgauauagucuuauuaguggacgguucauggagcauaggccgggccaauuucaggacugucagguccuucauaucccgcauuguugagguguuugacaucggcccuaagcgagugcagauugcauuggcccaauauagcggggacccaagaacagaauggcagcugaaugcccauagggauaaaaagucccugcugcaggcuguggcaaaccucccuuauaagggcggaaauacccuuaccggcauggcgcugaauuuuauuaggcaacagaauuuccgaacucaggccggaaugaggccucgggcucgaaagauuggaguguugauuacagacggaaagucccaggacgacguggaagcuccuagcaagaaauugaaggacgaaggcguggagcuguucgcaauuggcauuaagaaugccgacgaaguagagcuaaaaaugauagccacugaccccgaugauacccaugcguacaacguagcggacuuugaaucuuuaucacggaucguggaugaccugacaaucaaucucugcaacagcgugaagggacccggcgaccuggaggccccgucaaauuuggucauuucugagcggacccauagauccuuucgggugagcuggacuccccccuccgauuccguggaucgguauaaaguggaauauuacccugugucggggggcaagaggcaggaguuuuacguuucuagaauggagacaagcacagugcugaaggaccucaagcccgagacagaauaugucgucaacguguacagcgucguggaggacgaguauagugagccccugaaggguaccgaaaaaacccucccgguuccuguugugucguugaacaucuaugacgucggacccacaaccaugcacguacaguggcagcccguugggggugcaacaggcuauauucuuucauacaagccggugaaggacacagagccuacuaggccuaaagagguccgacugggcccaacagugaacgauaugcaacugacagaccuggugccgaacacagaguaugccgugacggugcaggcugugcuucaugaucuuacuucugaaccagugacuguacgggaagugacacuuccucugcccagaccccaggaucugaagcugcgugaugugacccacaguacgaugaacguuuuuugggagccugucccuggaaaagugcggaaauacaucgugcgauacaagacuccugaagaagauguuaaggaggucgagguagauagaagugagacuucaacuucccucaaagaccuguuuagccaaacuuuguacaccgucuccguaagcgccguccaugaugagggggaguccccccccgugacagcucaagaaacgacucguccgguuccggccccaacuaacuugaagaucacugaaguaacuagcgaaggguuucgcgguacaugggaccacggagcaucugacgugucucuuuauaggaucacaugggccccauuugguucaagcgauaagauggaaaccauucuaaacggcgaugaaaauacucuuguguucgaaaaccuuaacccgaacacuauauacgaggugucuauuacugcuauuuaucccgaugaguccgaauccgacgaucugaucggcucagaaagaacauuaccgaucuugacaacccaggccccaaaauccggccccagaaaccugcaaguauacaacgccacaagcaacuccuugacagucaagugggaccccgcuucuggacggguccagaaguauagaauuacuuaucagccaagcaccggcgaaggcaacgaacagacaacuaccauuggggguagacagaacucgguagugcugcaaaaacugaagcccgauacacccuauacuauuacagucagcucacuguaccccgauggggagggagggcggaugaccggaagggggaagacaaagccacugaauaccgugcgcaaucugagaguguacgaucccuccacuaguacccuuaaugugcggugggaccaugcagaaggaaaucccaggcaguacaaacucuucuacgcucccgcagccgggggaccagaggagcugguuccuaucccagggaauaccaauuaugcaauccugcggaaccugcagccagacacuucauacacaguuaccguagugccugucuacaccgagggagacggcggacgcacgucugauacggggaggacucucaugcgaggccuggcccgaaacguucaggucuacaaccccacaccaaacucauuggaugugagaugggaucccgcccccgggccaguucuccaguaccgggugguuuacagcccuguugauggaaccaggccaagcgaauccaucgucgugccagguaacaccagaaugguucaccuggaaagguugauaccugauacccuguacucaguuaaccucgucgcacuuuauagcgacggggaaggcaacccaucuccagcccagggaagaacacugccacgaagcgggccacggaauuuacguguauuuggcgagacuacuaauucucugucagucgcuugggaucaugcagacggccccguccaacaguaccggauuauauauagcccgacugugggagauccuaucgacgaguauacaaccgugccuggucgccggaauaacgugauccugcagccccuacagcccgacacaccuuauaagaucacagucaucgccguguaugaggacggggacggcggucaccugacuggaaaugguagaaccguuggccuucugccaccucaaaacauccacauuuccgaugagugguacacaagauucagaguguccugggauccguccccuagcccagugcuggguuauaagaucguuuacaagccaguuggcuccaacgaacccauggaagccuucguuggagaaaugaccucauauacccugcauaaucucaaccccucuacuacauacgacgucaaugucuaugcacaguacgacuccggacugucuguuccucuaacugaccagggcacaacguuguaucucaauguuacugaccugaaaaccuaccagauuggaugggauacauucugcgugaagugguccccucaccgggcugcuaccagcuacagacugaagcucuccccugcagacggcacucgcggucaggagaucaccguaagaggcucggaaacaagucauugcuucacaggacugucaccagauacugacuauggagucaccgucuucguccagaccccaaacuuagagggucccggagugucugugaaagaacauaccaccgugaaaccuaccgaggccccgaccgagccccccacacccccuccaccaccaaccauuccuccugcucgcgaugugugcaagggugcaaaggcugacaucguuuucuugacagacgccuccuggagcauuggcgacgauaauuuuaacaaaguggugaaauucaucuucaacaccgugggugguuucgaugaaauuagcccagcugggauucaagugaguuuugugcaguacuccgacgaagugaaguccgaguucaaacucaacaccuacaacgacaaggcuuuggcgcugggcgcucuccagaacauaagauauagagguggcaacacaagaacuggcaaagcucugacguuuauuaaagagaaggugcugacuugggagucaggaaugcgcaagaacgugccuaagguucuugugguugucacugauggaaggucccaggaugaggugaagaaggccgcacuagucauacagcagaguggcuucucuguguuugugguagguguagcagauguugauuauaaugagcuugcgaauauugcguccaaaccuuccgaaagacacguguuuaucgucgaugauuuugaaucuuucgaaaagauugaggauaaccuuauuacauuugugugugagacagcaaccaguaguugcccacucauuuaccucgaugguuauacaaguccgggguuuaagaugcuggaagccuauaaccuaaccgagaagaacuucgccucuguucaaggcgugucucuggaauccgggagcuuccccaguuauagugcuuaccgcauccaaaagaaugcauucgugaaccagccuaccgccgaccuccauccaaacggccucccuccaagcuacacuaucauccugcuguucaggcugcugccugaaacuccuucagaucccuucgcaauuuggcagauuaccgacagagauuacaagccacagguaggugugauugccgaccccagcucaaaaacccugaguuuuuucaauaaagacacuaggggcgaagugcaaaccgucaccuucgacacagaagaaguuaaaacacuauuuuacggcucuuuccacaagguccauauugucgugaccucuaagagugucaagauuuauauugauuguuacgaaauuaucgagaaggacauuaaggaggcuggaaauaucaccaccgacggguaugagauucucgggaagcuauuaaagggcgaacguaaaucagcagccuuucagauccagagcuuugauauuguaugcagccccguguggacuagcagggaccgcugcugugauauuccaucuagacgcgacgagggaaagugcccugcuuucccuaacagcuguacuuguacgcaggauucuguugggccuccagggccuccugggccagcuggcggucccggggcuaaggggcccaggggggagcggggcaucagcggcgcuaucgguccaccuggcccacggggggacaucgggccaccggggccccagggcccaccaggcccucaaggaccaaaugggcucaguaucccaggcgagcagggcagacaggggaugaaaggggaugccggcgagccagggcucccuggucgcacugggacgcccggucucccagguccuccuggaccaaugggcccuccuggcgaccgaggauuuacaggcaaggauggcgccaugggcccucgaggcccccccgguccacccgggucacccgggucucccgguguuacgggucccucaggaaagcccgggaaaccaggcgaucacgggaggccagggccaucaggccugaaaggcgagaagggcgaccguggagauaucgccucucagaauaugaugagggccguugcccggcaggugugugagcagcuaaucucuggacagaugaauagauuuaaucagaugcucaaccagauuccuaaugacuaccagaguaguagaaaucagccaggacccccagggccaccuggccccccugggagcgcgggagcucggggugagccagguccugggggccgcccugguuucccuggcaccccaggcaugcagggaccgccuggagagcgcggucugccuggugaaaagggcgagcgcggcacaggaucuagcggaccgcggggauugcccggaccucccgggccacagggagagagucguacgggaccaccaggaagcacaggaagcagagggcccccugguccuccugggcgaccaggcaacuccgggauacgcggucccccugguccaccuggcuauugcgauucuagucaaugcgccucuauccccuauaauggucaggguuacccaggcucuggcuag

SEQ ID NO: 5286 - RNA, 5700 nt, Artificial Sequence
  Description of Artificial Sequence: Synthetic coding sequence
augaggucucgacugccucccgcccuugccgcuuugggcgccgccuuguugcugucgagcauugaggcagagggaauggagugucucacccgugccgaggcugacauugugcuccuggucgaugggucauggagcauaggucgggccaacuuccggacugugcgguccuuuaucucgcggaucgucgaaguguucgauauuggccccaagagggugcagauagcuuuggcucaguacaguggugauccuaggaccgaauggcaauugaaugcccaucgagauaaaaaaagccucuugcaggcaguugccaaccugccauacaagggugguaauacacucacuggaauggcccugaauuucauucggcagcagaacuuuagaacccaggcaggcaugcguccucgugcccggaaaauaggggugcugauuacugauggcaaaucacaggaugacguagaggcucccucuaagaaacuuaaggaugaagggguggagcuuuucgcgaucggcauaaaaaacgccgacgaggucgaguuaaagaugaucgcuacugaucccgaugacacucacgcuuauaacgucgcagacuuugagaguuuguccaggauuguggaugaucuuacaauuaaccuguguaauucaguuaaggggcccggugaccucgaggcuccauccaauuugguuaucucagaacgcacucaucgauccuucagagugucauggaccccgccgucugauucuguugacagguauaaaguugaauacuauccagucucugguggcaaacgucaggaguucuauguuucucgaauggagacuucuacgguucugaaagaccuuaaacccgaaacggaguaugucguaaacguguacaguguggucgaggacgaguacucagaacccuuaaaagggaccgaaaaaacccugcccguuccaguuguuucauuaaacauuuacgacguggggccaaccacgaugcauguucaguggcagccagucggaggcgcaacaggauauauacugagcuacaagccagucaaagacacugaaccuacccgaccaaaggaaguaagacugggacccacugugaaugauaugcaguuaacagaucuggucccuaacacagaguaugccgugacaguccaggccguccuacaugaccugacaucagagccuguaaccgugcgcgagguuacccuaccucuaccccggccccaggauuugaaacugagagacgugacccauucuacgaugaacgucuuuugggaacccguaccagggaagguuaggaaauauauaguaagguauaagacucccgaggaagaugugaaggaggucgaaguagaccgcagugagacaucaaccagcuugaaggaccuguucucucagacccucuacaccguuuccguuuccgccgugcacgaugaaggagaaagccccccugucaccgcacaagaaacaacucgccccgugcccgcucccaccaaccugaagauuacggaaguuaccagcgagggcuucaggggaaccugggaucacggcgcauccgacgugucccuguacagaaucacaugggccccuuuugggagcagcgauaaaauggagaccauucugaacggcgacgagaacacgcugguguucgagaacuugaauccaaauacaauuuacgaggugucuauuacagcuauuuaccccgacgaaagcgaaagcgaugauuugauaggcuccgaacguacccugcccauacugaccacucaggcgccuaaaagcgggccucgcaaucugcagguuuacaaugcgaccuccaauucucuuacugucaagugggaccccgcuuccggcagaguccagaaguaccguaucaccuaccagccgucuacaggcgagggcaacgagcagaccaccacuauuggaggacgucagaauaguguggugcuucagaaacugaaaccagauacucccuacaccauuacagugagcagucuguacccagacggagaaggcggcagaaugacugggcgaggcaagacaaaacccuuaaauacagugagaaaccucagaguauacgacccaagcacguccacacuaaacguucgcugggaucaugcagaagggaacccaaggcaguacaagcuguuuuaugccccagcagccgggggcccugaggaguugguccccauccccggaaauaccaauuaugcaauucuccgcaaccugcagcccgacacaucuuacacugucacugugguacccgucuauacugagggggacggaggaaggaccagugauacuggaaggacacuaaugcggggccuggcuagaaauguucagguguacaacccgacgccuaacucccuugacgugcgaugggaucccgcuccugguccggugcuacaguacagggugguguauaguccaguagacggaacacgaccuucggaaucgaucguggugccugguaacacuagaauggugcaucucgaaaggcucauuccugacacccuguacagcguuaaucugguugcccuguacuccgauggagagggaaaccccagccccgcacaaggaaggacucuuccacgaucuggcccuaggaaccuccguguguuuggggaaacuacaaacagccuaucugucgcuugggaucaugccgaugggcccguacagcaauaccggaucaucuacuccccaaccgugggugacccgaucgacgaauacacuaccgucccuggacggcgcaacaacgucauccuucagccccuucaacccgacacccccuauaagauaacagugaucgcgguauaugaggauggagauggcggccaccugaccggcaacggccggaccguaggauuacucccuccccaaaacauccacaucucggacgagugguacaccagguucagagucaguugggaucccaguccuucuccugugcucggcuauaagaucguuuacaagcccgugggcucaaaugagcccauggaggcauuugugggagaaaugaccuccuauacucuucacaaccugaauccauccacaaccuaugaugugaauguguaugcccaguacgacagcggcuugucugugccccucacagaucagggcacuacccucuaccuuaaugugaccgaucuuaagacauaucagauagguugggauacauuuugcgugaaguggaguccucaccgggccgcuacaucuuauagauugaaauuauccccugcugacggcacacguggucaagagauuacuguuaggggcucugaaaccagccauuguuuuaccggucucucuccugauacugauuauggagugacaguguuuguccagacgcccaaucuagaggggccuggcguaucugugaaggaacauacaacagugaaaccgacggaggcuccuacugaacccccaaccccacccccaccccccacaaucccuccagccagagacgucugcaaaggggcaaaagcagacaucgucuuccucacagaugccagcuggagcauuggcgacgacaacuucaacaaaguagugaaauucaucuucaauacuguugguggcuucgaugaaauuucucccgcggguauccaagucucauucguccaguauucugacgaagugaagagugaauucaagcugaacacauacaacgacaaggcuuuggcgcucggcgcacuccagaacauccgauacagggggggaaauacgagaaccgguaaggcucugacauuuaucaaagaaaaagugcuuacuugggagucaggaaugagaaagaacgugccgaagguccucguagucguuacagacgggcggagucaggacgagguuaagaaagcagcccuugugauccagcagagcggguucuccguguucgugguuggaguugccgacguagauuacaaugagcucgccaacaucgccagcaagccuucugagcgucauguuuuuaucguggacgauuuugaauccuucgaaaaaauugaggauaauuugauaaccuuuguuugugaaacugccacguccucauguccauuaauauaucuugacggcuacaccagccccggcuucaaaaugcuggaggccuauaaucuuacagaaaagaauuucgccagugugcagggcgucucauuggaaucuggaucguucccuucauacucugcuuaccguauucagaaaaacgccuucguuaaccagccuaccgccgacuugcauccuaauggccuaccuccuucuuacacuauuauccuccucuucagguugcuaccggagaccccuuccgaccccuucgccaucuggcaaaucacugaucgcgacuacaaaccgcagguaggcgucauagcagaccccagcucaaaaacucuguccuucuuuaacaaagauacucgcggggaggugcagaccguaacuuucgauacagaggaagugaaaacacuguuuuauggcagcuuucacaagguucauaucguaguaacuagcaagucuguaaagauauacaucgacuguuacgagauuaucgaaaaagauauaaaggaagcugggaacauuacaacugaugguuaugagauccuuggaaaacugcuuaaaggcgaacggaaguccgcagcuuuucagauucagucauucgacauugugugcagucccguguggaccagccgcgauagaugcugcgauaucccuagccggcgcgacgaggguaagugucccgcauucccaaacaguuguaccugcacacaggauucugucgguccaccgggcccaccugggccugccggggggccgggugcuaaggggccacguggagaaaggggaaucagcggugcuaucggccccccgggcccacggggugauaucgggccuccagggccucaggggccucccggcccacaggguccaaacggccugucuauucccggcgagcagggcaggcaggguaugaagggagaugccggggaacccggccugcccggccggaccgggacacccggucugccgggaccuccugguccaaugggaccaccaggggacagggguuucacaggcaaagacggugcuaugggaccccguggcccaccuggaccucccgggagccccggaucccccggcguuacuggcccauccggcaagccaggcaagccuggggaucacggccgccccgggccuagcgguuugaagggcgaaaagggggaccgcggggacauugcaagucaaaauaugaugcgcgcuguggcccgucaggucugcgaacagcuaaucucaggucagaugaaucgcuucaaccagaugcuuaaucaaauuccaaaugauuaccaaaguucccggaaccagccagggccaccgggaccucccgguccgcccggaagugcaggagcacgcggggagccaggaccaggcgggcguccaggauuuccgggaaccccgggcaugcagggccccccuggagagcgaggccugcccggagagaagggcgagcgcgggaccggcagcagcgggccacggggacuuccuggccccccagggccgcaaggagagagucggacagggccgccuggcagcacuggcagcagagguccccccggcccucccggcaggcccggcaacagcggcaucagggggcccccuggccccccuggguauugcgacagcucacaaugugcauccaucccuuauaacggccagggcuacccaggcagugguuag

SEQ ID NO: 5287 - RNA, 8964 nt, Artificial Sequence
  Description of Artificial Sequence: Synthetic coding sequence
augcgcucucgccuucccccugcccuggcagccuuaggagcugcccuguugcucaguaguaucgaagcagaggucgaucccccuuccgaucugaacuucaaaauaauugacgaaaacacugugcacauguccugggcaaaacccguggauccuauagugggauauagaauuacaguugauccuacaacugauggaccuaccaaggaguuuacgcucagugccucuacgaccgagacauuacugucagaauuagugccugaaacugaguacguugugaccauuacuagcuacgaugagguggaagagucugucccugugaucggucaguuaaccauccagaccggcucaagcacuaaaccuguggagaaaaaacccggaaagacagagauucagaaaugcucggugagugcuuggacugaucuggucuuccugguggacggcagcuggucugucggacggaacaacuuuaaguauauccucgauuucauagccgcacuuguuagcgcuuucgauaucggugaagaaaagacccgggugggugugguucaguauaguucagauacacgaacagaguucaaccugaaccaauauuaccagagggacgaauuacuggcagcgaucaaaaagaucccguacaaggguggcaauaccaugacaggagacgccauagauuaccuuguaaaaaauacauuuacggagucagcgggcgcccgcguuggcuucccuaagguggccaucaucauaacggacgguaaaucgcaggaugaggucgaaauacccgcacgggagcucaggaacgucgguguggagguguucucccuggggaucaaagccgcagaugccaaggagcucaagcagauugcguccacccccucccugaaucacguguuuaauguggcuaauuucgacgccauugucgauauccagaaugaaauuauaucucagguuugcucaggcguugacgaacaacugggggagcuggugaguggugaggaaguagucgaaccaccuucuaaccugauagccauggaggucucuagcaaauacgugaaguugaauuggaacccgaguccaagcccagucacagguuacaaagugauccuuaccccaaugacagcggguucacgucagcacgcucugucgguugggccgcagaccaccacuuugucaguccgcgaucugucugcugacacagaguaccagauuagcguaucagcaaugaaggguaugacuucgagugaacccauuucuaucauggaaaaaacucaacccaugaaaguacaaguugagugcucccgaggagucgauauuaaagccgacaucgucuuccucgucgacggaucguacuccaucgggauagccaauuucguaaaggugagagccuuccuggaagugcuugucaaguccuucgagaucucccccaaccggguccagauuucucugguccaauacucccgggacccacauacggaguucacacugaaaaaguucacuaagguggaagauaucaucgaggcuauaaauacuuucccuuaccggggcggcagcacuaacacaggaaaggcuaugacuuaugugcgcgaaaagauuuucguccccagcaagggaucucgcuccaaugucccuaaaguaaugauccugaucacggacgggaagucuuccgaugccuucagggauccggccaucaaauugagaaacagugauguagagaucuucgccgugggagugaaggacgcagucaggagcgagcuggaagcgaucgcauccccccccgcugagacccacguguucaccguggaagauuucgaugccuuccaaagaauuuccuuugagcuuacucaguccaucugcuuacggaucgaacaggagcucgccgccaucaaaaaaaaagcuuaugugccacccaaagaucuuuccuucuccgaagucacgucauauggguuuaagacuaacugguccccugcgggugagaauguuuuuaguuaccauaucacauauaaggaagcagccggagacgaugaagugaccgugguugagccggccucaucgacguccgucguacuguccagucugaagcccgaaacacuguaucucgugaacguuacugcggaauaugaagacggcuuuaguauuccccuugcaggcgaagaaaccacugaagaggugaaaggggcaccacgaaaucuuaagguaacagacgagacgaccgacagcuuuaagauuaccuggacccaggccccgggccgugugcucagguacaggauaauauacaggccuguggcaggaggggaaagucgugaggugacuaccccacccaaccagagacggcgaacccuagagaauuugauucccgacacaaaguacgaagucuccguuauuccugaguauuuuagcgguccuggcacuccucuuaccgguaacgccgccacagaagagguuagagggaacccgcgggaucugagagugagugauccgaccacauccacaaugaaacuuuccuggaguggagcgccggggaagguaaaacaauaccugguuaccuacaccccaguggccggaggugaaacccaggaaguuacugugcguggugacaccaccaauacugugcuacagggacugaaggaggggacacaguacgccuuguccgugacugcccuguaugcuucuggagcaggcgacgcacuguuuggcgaggggacaacccuggaggaacgcggcagcccucaagaccucgucaccaaggacaucacggacacaagcauuggcgcauacuggaccagugccccaggcauggugcgcgguuacagaguguccuggaaaucccuguaugacgacguggacaccggcgagaaaaaucuccccgaggacgccauccacacaaugaucgaaaaccuucagcccgagaccaaauauagaauauccguuuuugcuaccuauagcucuggcgagggugagccacugacaggagacgccacaacugaauugagccaggauuccaaaacgcugaaaguagaugaggagacggagaacacuaugagaguuacuuggaaaccugccccaggcaagguggucaacuauaggguggucuaccgcccccacggccgagggaagcagaugguggccaaagucccuccgacaguaacguccacaguacucaagcgacuacagccucagaccacuuaugauauaacaguccugccaauuuauaaaaugggugaaggaaagcuuaggcaaggcuccgguacuaccgccucccgguucaaaucuccuaggaaccuaaagacaucggacccaacuaugucuagcuuccgagucacgugggagccugcuccaggugaggugaaaggauacaaggugacguuccacccuacuggcgacgaucgacggcugggagagcuugugguuggaccauaugauaauaccgugguccuggaggaguuaagagccgggacuacuuacaaggugaacguuuucgggauguucgauggaggggagucaucuccucucguggggcaggaaaugaccacccugagcgacacaacagugaugccaauccuuuccagcgggauggaaugccugacuagagcugaggccgauauugucuugcuagucgauggcucguggucaauuggucgcgcuaacuuucgcaccgugcgcagcuucauuaguaggauugucgagguguucgacaucgggccaaagcgcgugcagauugcgcucgcccaguauucaggggacccucguacggaguggcagcugaaugcacaucgcgauaaaaaaucccuucugcaagccguggccaaucucccuuacaaggggggaaacacucucacaggcauggcucuaaauuucauccgacagcaaaauuuuaggacgcaggcuggcaugaggccuagggccagaaaaaucgggguucucaucacggacggaaagucacaagaugacguugaggcacccagcaagaagcuaaaagacgaggggguggagcuguucgcuauuggcaucaagaacgcugaugagguagagcugaaaaugaucgccaccgacccggaugauacucaugcauauaauguagcagacuuugaaucucuaucucgcaucguugaugaucuuacgauuaaucuuugcaauucaguaaaagggccaggcgaucuggaggcccccaguaauuuggugauaucugaacgcacgcacaggagcuuuaggguuucuuggacgccacccagugauuccgucgacagauauaagguggaguauuacccagugucuggcggaaagagacaggaguuuuacgugagccguauggagacaaguacugugcucaaggaccugaaaccagaaacagaguauguugugaacguguauagcguggucgaagaugaauacagugaaccacucaagggcaccgaaaagacacuccccgugcccgucguuagccugaacauauaugaugugggcccaaccaccaugcaugugcaauggcagccugucggcggcgcgacaggcuacauucucaguuacaagccagugaaggacacagagccuacacgccccaaggagguuaggcugggucccacugugaacgauaugcagcugacagacuuggugccgaacacugaguaugccgugacagugcaggccguccugcaugaucucaccuccgagccugugacugugcgcgaagugacacugccccuccccagaccacaggauuugaaauugcgggauguuacacauucuaccaugaauguguuuugggaaccggugccugguaaagugcguaaguacaucguccgguacaagaccccggaagaagauguaaaagaagucgaggucgaucggucugaaacuaguacuucucugaaggaccuguucucccagacccuguacacaguaagcgucagugcaguccacgaugaaggagaaucgccacccguaacggcucaggaaacaacucguccaguacccgcucccacuaacuugaaaauuacugagguaacuucugagggguuccgggggacaugggaccauggagccagugacgucuccuuauaccgcauuacaugggcgccauuuggcaguucugacaagauggaaacaaucuugaauggugaugaaaauacacugguauuugaaaaccuuaauccaaauaccauauaugaggucuccauaacggcuauuuacccugacgaauccgaaagugacgauuugaucggaagugaacgcacucugccaauccuuacaacccaggcgccuaagucagggccuagaaaccugcaagucuauaaugcaacaucaaacucccucacagucaaaugggaucccgcauccggcaggguccagaaauaccguaucacuuaucagcccaguacgggugaagggaaugagcagacaacaacgauaggcgggaggcaaaauuccgucgucuuacagaagcucaagccugauaccccguauaccauuacuguuucaagccuuuaucccgacggggaaggcggaagaaugaccggacguggaaagacgaagccgcugaacaccgugaggaauuuacgcguguacgauccgagcacaagcacuuuaaacgucagaugggaucacgcggaaggaaacccaagacaauauaaacuguuuuacgcaccggccgccgggggcccugaggaauuagugccaauuccagggaacaccaacuacgccauccuucgcaaucuacagcccgacacuucuuacacggugaccgucgugcccguguacacugaaggcgacgguggacguaccagcgacacaggccgaacacuaaugagaggccuggcucggaacguucaaguuuauaauccaaccccuaacucucucgauguuagaugggaccccgcaccuggcccuguacuccaguauagagugguguauagcccuguggauggaacaagacccucagagaguaucguggugcccggaaauacaaggaugguucaucuggaaaggcugaucccagacacacucuauucuguuaaccugguagcucuguauucggauggugaggggaacccaagccccgcucagggccgcacgcugccccgcucuggaccuagaaaucuuagaguguucggagaaaccacaaacagccuaucuguugcuugggaucaugcugauggcccaguacagcaauaucgaaucauuuauucuccuacagucggagaccccauugaugaguauaccaccgugccuggccggcggaauaacguuauccuccagccauugcagccagacacuccauauaaaaucacggugaucgcuguguacgaagauggcgauggaggucaccugacagguaaugggaggaccgucggacugcuuccuccacagaacauucacauuagugaugaaugguauaccagauuccggguguccugggauccuucuccgucccccgugcucggcuacaagaucguguacaagccuguagguagcaacgagccuauggaagcuuuugugggugagaugacuuccuauacccuccacaaccugaacccuuccacuacauaugacgugaacgucuacgcucaguaugacagcggacuuucaguaccuuugaccgaucagggaacaacccucuaccugaaugucacagaccugaaaacauaucagaucggaugggacaccuuuugcgugaaguggagcccccaucgagcggccacaucuuacagacugaagcugagcccagccgaugggacccgcggucaggagauuacugugcgcggaucagaaaccagccacuguuucaccggccuaaguccugacacagauuauggggugaccguuuucgugcagaccccaaauuuagagggaccaggcguguccgugaaggagcacacuacuguuaagccuaccgaggcccccaccgaacccccaacaccuccuccaccuccaacgaucccaccugcaagggacgugugcaagggcgccaaagcggauaucguguucuugacugacgccucuuggucgaucggggacgacaacuucaauaagguugugaaguuuaucuucaacacaguuggaggcuucgacgaaaucuccccugcugguauccaggugagcuucguccaguauucggacgagguuaaguccgaguucaaacugaacacguauaaugauaaagcacucgcacucggcgcacuccaaaauauucguuaucggggcgggaauacucgaacagggaaggcucucacguucaucaaagaaaaagugcugacaugggaguccggaaugagaaaaaauguuccuaagguauuagugguggucacugauggccgaucucaggacgaagugaagaaggcagcccuggugauacaacagagcggauuuucgguguuugucgugggcguugcagauguagacuacaacgagcuggccaacaucgccuccaaaccaucugagcgacacguguucaucguggaugacuucgaaucuuuugagaaaaucgaggacaaucugaucacguuugucugcgagacagcaacgagcaguuguccccuuaucuaucuugacggguauaccucccccggcuuuaagaugcuugaagcuuacaaccugaccgagaagaauuucgcuagcgugcagggggugagucuagaauccggauccuuuccaagcuauucugccuaccgcauucagaaaaaugccuuuguuaaccagccaacugcugaccuacaccccaauggacucccgcccagcuauaccaucauuuugcuguuucgucugcugccggaaacuccuagcgaucccuucgcaaucuggcagauuacagauagggacuacaaaccccaggugggagucauagccgacccuucuucuaagacgcucuccuucuucaacaaagacacacggggcgaaguacagacagugaccuucgacacagaggaagugaagaccuuguucuacggauccuuccacaaaagggaugaggggaaauguccagcauuuccaaauuccugcacgugcacgcaggacagcgugggcccuccagggccacccggcccagcagggggucccggggcgaagggaccucgaggcgagagggggauuaguggcgcaaucgggcccccugggcccagaggggacaucggaccuccugguccccaggguccacccgguccccaaggcccaaacggucuauccauccccggagagcaggggagacaaggcaugaaaggggacgcaggggaaccaggacugccaggaaggaccggaacacccggccuuccaggaccucccgggccaauggggcccccgggcgacagaggcuuuaccgggaaggacggagccaugggaccccggggaccuccuggcccuccagggagccccggaucuccgggggugacaggaccgagcgggaagcccggcaaacccggagaccacggccgcccagggccuuccggccugaaaggcgagaaaggcgaccguggcgauaucgcaucucaaaacaugaugcgugcaguagccagacaggugugcgagcaguugauuuccggucagaugaauagauucaaccaaaugcugaaccagaucccaaaugacuaucagucaucacgcaaucagcccggaccaccuggcccaccuggcccccccggcucggcuggggcaaggggcgagccaggaccggguggcagaccaggguucccaggaacgccugguaugcagggaccgcccggcgagcgaggccucccaggagaaaaaggggagcgugggacaggcucaagcggcccacgcggucugcccggaccccccgguccgcagggagaaucccgcacaggaccccccgguagcaccggaagccgcgguccgcccggccccccuggccgacccggcaauagcgggauuaggggcccgccaggcccaccgggcuauugcgacagcucacagugcgccucaaucccauacaaugggcagggcuacccugguucugguuag

SEQ ID NO: 5288 - RNA, 4494 nt, Artificial Sequence
  Description of Artificial Sequence: Synthetic coding sequence
auggaugucacuaagaagaauaagcgggaugguacagaagucacugaacgcauuguuacugaaacugucacgacucggcuaaccucccucccacccaagggaggaacguccaauggguaugcaaagacagcaucacuggguggggguucucgccuugagaagcaguccuugacacacggguccucaggguacauuaacuccaccggaucuacccgcggacacgcuagcacgucguccuacaggagagcgcacagccccgcaucuacguuaccaaacuccccuggcucaacauuugaacggaaaacacauguuacucggcacgcauaugagggaucgucgucaggaaacuccagcccugaguauccaagaaaggaguucgcuuccaguagcaccaggggccggagucaaacucgggaaucugaaaucagggucagguugcaauccgcgucuccaucgacucgauggacugagcuggaugauguuaaaagacuccuaaaggggagcagaucagcuucugugucccccacccgcaacaguagcaauacucugccuaucccaaagaaaggaaccguugagacuaaaaucgugacagccaguucucaaucugugucagggacauacgaugcaacuauucuagacgccaacuugcccagccauguuuggagcagcacacugccagccggcuccaguauggggaccuaccacaauaacaugacgacccaguccucuucccugcucaauacuaaugcuuauucugcuggaagcguuuucggcgugccuaacaauauggcuaguugcaguccgacccuccacccaggucucuccaccaguucaagcgucuuugggaugcagaacaaccuggccccgucccugacuacucugucccauggcacaaccacgacuucuacagccuauggcguaaagaaaaacaugccccagucucccgcggcagugaauacaggcguguccacgucagccgcuugcacuacaagcguucaauccgaugauuuguuacacaaggauuguaaguuccugauucuugagaaggauaauacuccugccaaaaaggagauggagcugcuuaucaugacaaaggauagcggaaagguguuuaccgcaagccccgcguccaucgccgcaaccuccuuuucagaagauacacuuaagaaggagaagcaagccgccuacaaugcugauucagggcuuaaggccgaggcaaauggggaucuaaaaacgguuuccacuaaaggaaaaacuacgacagcagacauccauucuuacgguucaucaggcgggggagguucagguggcggagguggugugggcggugcgggcggggguccauggggacccgccccagcaugguguccgugcgggagcuguugcuccugguggaaaugguuacugggucuacuccuaacauggcugcugcugcugggccugcuguucggccugauugcucuugcugaggagguaagaaaacuaaaggcgcggguggacgagcucgagagaauucgaagaucgauccuacccuacggagacucuauggaccguauugagaaggacagacugcagggcauggccccagcugccggagcagaucuggauaaaauuggacuccauagugacucacaggaagaguuauggauguuuguccgcaagaagcugaugauggagcaagagaauggaaaucugagaggcaguccaggcccaaaaggcgauaugggcucuccuggaccuaaaggugaucggggcuuucccggcacuccaggaauuccagguccucuuggccacccgggcccucaggggccgaaggggcaaaagggaagcguuggcgacccuggcauggaaggcccuaugggucagagaggcagggaggggccaaugggcccacgaggagaggcaggcccuccaggaagcggugagaaaggcgaacgaggagccgcaggggagccugguccccacggaccacccggagugcccggcagcguggggcccaaaggaucuuccggauccccaggaccacaggguccaccugggcccguaggucuccagggacugcgcggagaagugggauuaccuggagugaaaggggauaaaggaccuauggguccaccgggaccaaagggagaccaaggagagaaggggccuagaggacucaccggcgagccagggaugagggggcuuccaggcgccgugggagagcccggggccaagggcgccauggggccugccgguccagauggccaccaagggccacggggcgaacagggccugaccggaaugccuggaauucguggccccccaggcccuucgggggauccgggcaagccaggucucaccggaccucagggcccccagggccucccgggaacacccggacgcccaggcauaaaaggugagccgggagccccuggcaaaaucgugaccucugagggaaguucgauguugaccgugccaggaccccccgguccucccggcgcuaugggcccuccagggccccccggugcacccgggccugccggaccagccggguugccggggcaucaggaagugcugaauuuacaaggcccgccagguccucccggcccuagggggcccccaggcccgagcaucccgggaccuccuggcccacggggcccaccgggugaggggcugccugggccgccgggcccacccggaucguuccuuuccaacucugagaccuuccucucuggcccaccaggaccaccaggcccgcccggaccuaagggggaccagggaccccccggaccacgcggucaccaaggagaacagggccugccaggauucagcaccuccggaagcaguagcuuugggcuaaaccugcaggguccuccaggccccccugguccacagggccccaagggcgauaagggagaccccgggguuccaggagcgcuuggaaucccguccggucccucagagggagggucaucaaguacgauguaugucaguggaccaccagggcccccuggcccucccggaccaccugguaguaucagcuccagcggccaggaaauccagcaguacauuagugaauauaugcagucugacucgaucaggucauacuugucuggagugcagggcccacccggcccuccagggccaccaggaccagugaccaccaucaccggggagaccuucgauuacagugaguuagccagucauguuguuuccuauuugagaaccucuggauauggcguuucccuuuucagcagcaguauuaguuccgaggacauucucgcgguccugcagagggacgacguucgccaguaucugagacaauauuugaugggacccagagguccacccgguccaccuggcgccucaggcgacggcagucugcuaucccuggauuaugcugagcuuucgagccgaauccuaucuuauaugucaucguccgguauuucuaucgggcugcccggccccccaggacccccuggccuaccaggaaccagcuacgaagaacuccugagccugcuucgaggcuccgaguuucgaggcaucguuggccccccuggcccucccggccccccaggcauacccggaaauguuuggaguuccaucuccguggaggaucucucguccuauuuacauacagcuggguugucauucauaccaggcccaccgggcccuccagggccacccggaccuagaggaccccccggggucuccggugcccuggcaaccuacgcugcggagaauuccgacucauuccgcuccgaauuaauuuccuauuuaacaucgccugacguccgcucuuucaucguaggcccacccggcccucccggcccacaggggccgccaggcgacuccaggcugcugucuaccgacgcgagccauucccgaggcaguagcaguucaucucauaguucgagcgucaggagaggcucuucuuauagcuccucaauguccacaggagggggcggugcagguucacuuggagccggaggggcauucggugaagccgcuggagacaggggucccuacgggacugauauugggcccggcggaggguacggcgccgcugccgaagggggaauguacgcuggcaacgguggccuacugggcgcggacuucgccggggacuuggauuauaacgagcuugcaguucgggucuccgagucgaugcagagacaaggguugcuccaaggcauggcauauaccguucaagguccuccgggccagccuggaccccagggcccacccggaaucaguaagguguuuuccgcauauuccaacgucacggcagaucugauggacuuuuuucaaaccuauggcgcgauacaggggccaccuggacagaaaggcgaaauggggacucccgggccaaagggcgacagaggcccggcaggaccgcccggacacccugguccucccggaccucgcggccauaaaggugagaagggggacaagggcgaucaagucuaugcugggcgaaggagacguagaagcauagcggugaaaccauag

SEQ ID NO: 5289 - RNA, 1254 nt, Artificial Sequence
  Description of Artificial Sequence: Synthetic coding sequence
auggaugugacuaaaaagaauaagcgagacgggaccgagguaacugagagaaucguaaccgagaccgugacaacuagguuaacuucgcucccuccaaagggaggaacuucuaauggauacgcaaaaaccgcuagccugggggguggcucccgguuagagaaacagucccugacgcacgguucuaguggcuacaucaauagcaccgguuccacccggggacaugccucaacauccuccuaccgccgugcucacagcccugcuaguacccugccuaacuccccuggaucuaccuucgaaaggaaaacucaugugacucggcaugcuuaugaaggauccucaucugggaacucuagcccagaguacccgcgcaaagaauuugcaucaaguaguacgcgagguaggagccagacccgggaguccgaaauucgcgugaggcuccaaagcgccaguccuuccacccgguggacugaacuggaugaugugaaacgcuuacuuaaagguucccgaagcgccucuguguccccaacaagaaacagcucaaacacacuaccuaucccaaagaaggguaccguggagacgaagauugucacggcuucuucucaaucuguuagcggcaccuacgacgcgaccauauuagacgccaaccugccaagccacgugugguccucaacucuccccgcuggcucuucaauggguaccuaucauaauaauaugacgacccaguccuccagccuuuuaaacacaaacgcauacucugccggcagcguuuucggagucccgaauaauauggcuucauguuccccaacacuccacccaggccuaagcacuagcagcucugucuucggcaugcagaauaaccuggcgcccagccucaccacucucagccacgggacuaccacuacaucuacugccuacggagucaagaaaaauaugccccagagcccugcugcuguuaacacuggcgugucaaccuccgcugcaugcacaacuagcguucaguccgaugaucugcugcacaaagauuguaaauuccucauccuggagaaagauaacacacccgccaagaaagagauggagcuucugaucaugacaaaggacagcgggaaagucuucaccgccuccccagcuagcauugcagccacgucuuucuccgaggauacauuaaagaaggaaaagcaggcagccuacaaugcagauucagggcuuaaagccgaagcaaacggcaagaacaaguaugauugcugccccccuuag

SEQ ID NO: 5290 - RNA, 201 nt, Artificial Sequence
  Description of Artificial Sequence: Synthetic coding sequence
uaauacggugcuauucaaggcccgcccggccaaaaaggggagaugggaacuccaggacccaagggggauaggggcccggccgguccuccagggcacccugggccccccggcccacgaggacauaaaggagagaagggagauaaaggagaucagguguaugccgguagaagacgcagacgaucuaucgcagugaaaccuuag

SEQ ID NO: 5291 - RNA, 1815 nt, Artificial Sequence
  Description of Artificial Sequence: Synthetic coding sequence
auggacgugacaaagaaaaacaaaagggacggcacagagguuacugagcgcaucgucaccgagaccgugacaacuagacuuacuagucugccucccaaggguggcacgagcaacggguacgcuaaaacggcgucguuaggaggaggcucccgccucgagaaacagucccuuacccacgggagcagcggcuauauaaacagcacaggcaguacucgcgggcacgccaguacuuccaguuaccgacgcgcacacagcccagccagcaccuuaccaaacucaccuggcuccacguucgaacgcaaaacacacgucacccggcacgcauaugaggcuagcucaucuacccgagggagaucacaaacuagggaaucugagauuagagugaggcuucagucagccucaccaucuacgcgguggacugaauuagaugauguuaaaagacugcugaagggaucuagaagcgccucagugucucccaccaggaacucuaguaauacccuuccaauucccaaaaaggggaccguugagacaaaaauagugacugcuuccagccagucugucucaggcacuuacgaugcuacuauuuuagaugccaauuuaccgucucacgugugguccagcacguugccugccggcuccuccauggguaccuaccacaacaauaugacaacucaaucuuccagucuauuaaauacgaacgcuuacucugcgggcaguguguuuggagucccaaauaauauggcgagcuguucaccuacccugcauccgggucuaaguacaucuucgucugucuucgguaugcagaacaaccuugcucccagucugacuacucuuagccacggaaccacaaccacgucgacugcuuauggcgucaaaaagaacaugccccagagcccugcugcagugaauacagggguguccacauccgcugcguguaccacauccgugcagagcgacgaccuucugcacaaagauugcaaauuccugaucuuagaaaaggauaauacacccgcaaagaaagaaauggagcuccucauuaugaccaaggauucuggaaagguguucaccgccagcccagccuccaucgccgcuacgagcuuuuccgaagauacacugaaaaaggagaagcaggcagcauacaaugcagauucuggauuaaaagcugaggcuaauggagauuuaaagacgguaagcacaaagggcaagacaacaaccgcugauauucauuccuacggcucgucaggagggggcggaucaggaggggggggcggaguugguggagcuggcgguggccccuggggccccgccccagcuugguguccuuguggaagcugcugcuccugguggaaaugguuacugggucuauuacuuacauggcuguuauuacugggacuucuuuucgggcucauugcccuggcugaggaaguaaggaaauuaaaggcacgcguggacgagcuggagcguauaaggcggucuauacucccauacggggacucaauggauaggaucgaaaaggaucggcuacaggggauggccccggcugcuggugccgaucucgauaagaucgggcugcacagugauucacaagaggaauuguggauguucgugaggaaaaaauuaaugauggagcaggagaacggcaauuugcggggaucacccggaccgaagggagacauggggagcccuggccccaagggagaucgcggcuuccccggcacacccggaauuccuggcccccucgggcacccugggccccaaggacccaaagggcagaaggggucagucggcgacccuggcauggaggggccaauguag

SEQ ID NO: 5292 - RNA, 3951 nt, Artificial Sequence
  Description of Artificial Sequence: Synthetic coding sequence
augucuaguggugauccagcccaucuuggucuuugccucuggcuauggcugggggcuacacugggucgggagcaggugcaggcgagcggucuccugcgcuuagccgucuuacccgaggacaggcuccagaugaaauggcgcgagucugaaggaagcggacucggcuaucuugugcaggucaagccuauggccggcgacagcgaacaagaagugauucucacgacaaagaccccuaaggcaacaguuggaggccucaguccaucuaagggcuacacccugcagauuuuugagcucaccgggucgggacgguuucuuuuagcccggagagaguucguuauugaagauuugaaguccaguucacuugaccgcaguucucagagacccuugggaaguggugcgcccgaaccgacaccuagccauaccggcagcccagacccugagcaagccagcgaaccacaaguggcauucacaccaucucaggauccaagaaccccugccggcccucaguuucguugccugccuccagucccagccgauauggucuuucugguggauggcuccugguccauugggcacucucacuuccaacaggugaaagauuuucuagccucagugauugcaccuuucgaaaucggcccggacaagguccaaguaggcuugacucaguacucuggagaugcacaaacugagugggaccucaacucucucuccaccaaggagcaggugcuggccgcuguccgcaggcuuagauacaagggaggcaacacuuuuacaggcuuggccuugacacaugugcugggacagaacuugcagcccgccgcgggauugcggccugaagccgcgaagguuguaauuuuaguuacagauggaaaaagucaggaugauguacacacagcagcgcggguucugaaggaccugggagucaauguguuugcuguuggcgugaagaaugcugacgaagcugagcuacggcugcucgcgucaccuccccgcgauauuaccgugcauagcgucuuagacuuccuucagcucggagcccuggccggucuccuguccagacugaucugccagagguugcaggguggcucucccagacagggaccagcagccgcccccgcacuggacacacuuccugcucccacuucccugguucuaucucaagugacaaguuccagcauuaggcucaguuggacacccgcuccacgucacccauugaaguaccugauuguguggagggccagcagaggagggacuccccgggaagucgugguggaaggcccagcggcaucuacugagcuccacaaccucgcuuccagaacugaguaucuggugucaguguucccaaucuacgaaggcggggugggcgaaggacuucgcggacuggucacaaccgccccccugccuccaccuagagcccuuacgcuugcggccgugacaccacggacuguucaccucacuuggcagcccagugcuggcgccacucacuaccuugugagguguuccccugcauccccgaaaggugaggaagaagagagggagguccaagucgggcggcccgaggugcugcuugauggucucgagccaggcagagacuacgaagucagcguacagagccugaggggcccagaaggcucggaggcccgcgguauaagggcacggacacccacucuggcaccuccccgccacuugggauucucugaugucagucacgacgccgcaagagucuuuugggaaggagcacccagaccagucagauuaguucgggugacauaugucucuucugagggcggccacagcgggcaaacugaagccccuggcaacgcaacuagcgcaacccucggcccgcuuuccaguucuacaacuuacaccguuagaguaaccugcuuauacccaggaggaggaucgucaacacucacuggucgggucacgacgaaaaaagcuccaagcccaagccagcugucaaugacagagcucccuggagaugccgugcagcuagcauggguagccgccgcccccucagguguucucguuuaccagauaaccuggaccccgcuaggagagggcaaggcgcaugaaauuucugucccaggaaaccugggaacugcuguucuaccuggccugggcaggcacaccgaauaugacgucacgauccucgcuuauuaccgcgacggggccagauccgacccugucucccuccgguacacaccuucuacugugaguagaucaccaccuuccaacuuggcccucgccagugagacaccagacucuuugcaggucucauggacccccccacugggaaggguacugcauuauugguugacguaugcaccggccucaggguuagggcccgagaaauccgucaguguuccuggcgcucgcagccacguuacccugcccgaccugcaagccgcuacaaaauaccgugucuuggucucagcgaucuacgcugccggacgguccgaagccgugucggcuacagggcaaacugccugccccgcacucaggcccgacgguucccugcccggauuugaccuuaugguggcuuuuagccuagucgagaaggccuacgcauccauccgcggaguggcaauggaacccuccgccuuuggaggcaccccaacauuuacauuguuuaaagacgcucaacucacuaggagggucucagacgucuauccagcuccccugccaccugagcauacgauaguguuucugguucgcuugcucccagagacuccgcgagaggccuucgcccuguggcagaugaccgccgaggauuuccagccguugcucggggugcugcuggacgcaggcaaaaagucacugacauacuuccaccgagauccccgggcggcccugcaagaagccaccuucgauccccaggaaguccguaaaauuuuuuuuggcucguuucauaaggugcauguggcgguagggaggaguaaggugagacuuuacguggauugucggaagguugccgagcggccucugggggagaugggcucaccuccagccgccggauucgucacucucggccggcuggcaaaggccaggggaccgcgcuccuccucugcggcuuuucagcuucaaaugcuccagaucguguguucugauacaugggcugacgaggauagauguugugagcuccccgccagccgugauggcgagacaugcccggcuuucgucucagcuugcaguuguagcagugagacaccuggcccucccggcccccaggguccacccggacucccuggcaggaauggcacaccuggagaacagggcuuucccggaccuagaggagagccugggccuccgggccagauggggccagaaggaccugguggccagcaggggucacccggcacacagggccgcgccguccagggcccuguggguccacccggcgucaaaggugagaagggcgaucauggcuuaccaggacugcagggucauccaggccaucagggaaucccaggacgcgugggacuccaggguccuaaggggaugcgggggcuggaaggcacugcagggcugccaggaccuccagggcccaggggauuccaaggcauggccggagccaggggcacgucuggcgagcguggcccccccgggacagugggccccacaggacugcccggaccgaagggcgagcguggggaaaaaggcgaaccucagagccucgccacacuguaucagcuugugucucaagcgagucacguuaguaaguucgacuccuuucaugaaaacacuagaccaccuaugccuauucuggagcagaagcucgaaccugguaccgaaccacuuggaucgcccggcacaagaagcaaagcuuuggucccuggcgaaugggggcgaggcggucgccaucuggagggacggggagagccaggagccguuggccagaugggcuccccgggacagcagggugccucaacccagggauugugggaauag

SEQ ID NO: 5293 - RNA, 3855 nt, Artificial Sequence
  Description of Artificial Sequence: Synthetic coding sequence
augucgagcggugauccagcucaccuuggucuuugccuguggcuguggcucggcgccacucuugggagagagcagguccaggcuagcggguuacuccggcuggcagugcugcccgaggauagacugcagaugaaguggagagaauccgaggggagcgggcucggcuacuuaguucaggugaaaccgauggcuggagauagugagcaggaaguaauuuuaacgacgaaaacacccaaggcgacuguaggaggacucucuccgucuaaaggguauacccugcaaaucuuugagcugaccgggagcggacgguuucuguuggccaggcgcgaguuugugauugaagauuugaagagcuccucccuugaccgcuccagccagcgcccacuuggaucaggggcacccgagcccaccccaucgcauacaggaucgccugacccagaacaggccagcgaaccccagguugcguuuacuccaucacaggacccacggacgccagcaggaccacaauuucguugccugcccccugucccagcggacaugguguuucucguugauggcagcuggucaauuggccauucucauuuucagcaggucaaagauuuccuugcaucaguaauagcaccguucgagauuggucccgauaaaguucaagugggccuuacccaauacuccggcgacgcgcaaacggaaugggaucugaacucacuaucuacaaaagagcagguacuggccgccgugcggaggcuucgcuacaaagguggcaacaccuucacgggucuugcacugacgcauguccucggacagaaccugcagccugccgccgggcugcgccccgaggccgccaaaguggugauccugguuaccgacgggaagucacaggaugacgugcacacagccgcacggguguugaaggauuuaggagucaacguauucgcaguaggggucaagaacgcggaugaggccgaguuaaggcuucuggccucacccccucgugauauaacgguucacucuguguuggauuucuugcagcucggugcacuggccggacugcugucgagacuuauuugucagcggcuccagggaggcuccccuagacaggguccagcugcggcaccugcucuggauacacugccagcacccacuucucucguccuuagccagguuaccucuucuuccaucagacugagcuggacccccgcaccccgucauccacucaaguaccugaucguuuggagagccagccgugguggcacuccgcgcgagguggugguggaaggaccugccgcuucaaccgaacugcauaaucucgccucacggacugaguaccuugucucgguguuuccuauauaugaaggugguguaggggaagggcugaggggacuagugaccacggccccccuuccacccccccgggccuugacgcuagcagccgucacaccccgaaccguccaccugaccuggcagcccucugcuggcgccacgcauuacuuggugagauguagcccagccagucccaagggggaggaagaggaacgcgagguccaggucgggagaccugaagugcugcuggacggcuuagaaccugggagggacuaugaagugagcguccaaagccugcgcggccccgaaggcucugaggcucgaggcaucagagcaaggacacccacguuggcacccccacgacaccugggauuuuccgacgugagucaugaugcagccaggguguuuugggaaggcgcaccucgccccguacgacuagugcgagucacguacgucaguucugaaggcggccacucuggucagaccgaggccccuggaaacgccaccucagccacccugggaccucuaucuuccucaacgacuuacacaguaagggugacgugccucuaucccggaggggguagcagcacccucacaggucggguaaccaccaaaaaggcaccuagcccaagccagcucuccaugacagaacuuccuggcgacgcaguccagcuagcuuggguagcggcagcuccaaguggcguccucgucuaucagaucacguggacgccccucggagaagggaaagcucacgagauaagcgucccugggaaccuggguaccgcagugcugccuggacucggacgccauacugaauacgacgugaccauucuugccuacuacagagauggcgcuagaagcgaucccgucucccugcgauauacucccagcaccgugucaaggucuccccccagcaaucuggcgcucgcuucugaaaccccggacucccugcagguuuccuggacaccuccauuaggaagaguucugcauuacuggcugacauaugcuccagcaagcggacuuggccccgaaaagagcguauccgugccuggagcccgcagucaugugacauugcccgaccuccaggccgcaacgaaauaccgagugcugguuucagcaaucuacgcugccggacggagcgaagccguuagcgcgacuggacagacagccugccccgcccuaagacccgaugggagucuuccuggcuuugaucuaaugguggcuuuuucauuaguggagaaagcuuaugcgucuauuaggggaguggccauggagccguccgccuucgggggaacacccacguuuacucucuuuaaagacgcccagcugacgcgucgggugagcgacguguauccagccccgcuuccuccagagcacacuauagucuuccucguccgccuguuaccugaaacucccagggaggcauuugcacuguggcagaugacugcugaggacuuccagccauuauuggguguccuccucgaugcaggcaaaaaaagucugaccuauuuccaccgcgauccaagggcagcccuucaagaagcaaccuucgacccccaggaagugcggaaaauauuuuucggguccuuucacaaggugcacguagcagucggcaggucuaaagugagauuauacguggauugcagaaagguagcagagagaccgcugggcgaaauggguuccccgcccgccgccggguucguuacgcuggggcgccuugccaaagcuaggggaccccggagcucuagugcagcauuccaguugcagaugcugcaaaucguauguuccgacacuugggccgacgaagacagauguugcgagcuacccgcuucccgagacggcgagacaugccccgccuucgugucggcuugcucuugcuccagugaaacuccggguccgcccgggccucaggggccaccugguuugccgggacggaauggcacacccggggagcagggcuuucccgggccaagagggccccccgggguuaaaggggaaaagggagaucauggacugccaggccuccaaggucaccccggacaccaaggcauccccggccgugugggucugcaagggccuaaaggcaugagaggucucgagggcaccgccggccuucccgguccuccuggccccaggggauuccaagggauggcuggcgcuagggguaccucuggagagagaggucccccaggaacugucggcccuacuggccuacccgggcccaaaggggaacgcggagagaagggcgagccgcaaucacuugccacacuauaucagcucgugagccaagcuagccacgugagcaaguuugauuccuuucacgagaacacuagaccacccaugccaauauuggagcagaaacuugaaccgggcacagaaccuuuagguagcccagguacccgcagcaaagcccuggugccgggagaauggggaaggggaggcaggcaucuggagggucgcggggaaccuggcgcugucggucagauggguaguccuggucagcagggggcaucaacacagggacucugggaguag

SEQ ID NO: 5294 - RNA, 3894 nt, Artificial Sequence
  Description of Artificial Sequence: Synthetic coding sequence
augucgagcggggauccagcccaccugggcuugugucuuugguuguggcucggagccacauuggggcgggagcaagugcaggcauccgggcuguugcggcuggcgguguuaccugaggauagacugcaaaugaaguggcgcgaaucagagggaaguggacuuggcuaucuagugcaggugaaaccuauggccggcgauagcgagcaggagguuauccuuaccacaaagacccccaaagcuacagugggcgggcugucucccaguaaagguuauacgcuacagaucuuugagcuuacaggcuccgguagguuccugcuugcacggcgcgaauucgugauugaggaccugaaaucuucaucccuggaucggucaagucagcgaccucuugggaguggggcacccgagcccacaccaagucauacuggcagccccgacccagagcaagcauccgaaccccagguggccuuuacuccaucacaagaccccagaacccccggugggucagaguggcgcgagaccggaccacaauuucgcugccuuccucccgugcccgcagacaugguguuucucgucgacgguagcuggucaaucggccauagccacuuccagcaaguaaaggacuuccucgcgucagugauugcgcccuucgagauuggcccggauaagguccaggugggccucacacaauacagcggggaugcacagacugaaugggaucugaauagcuuaucuacgaaagagcagguccucgcugcagugcgcagacugcgguauaaaggaggcaauaccuuuaccggauuggcauuaacccacguucuuggacaaaacuuacagcccgcugccggacucaggccagaagccgcgaaaguuguuauccucguaacugauggcaagagucaggacgauguccacacugccgccaggguguugaaagauuugggcguuaauguuuuugcaguggguguuaaaaacgcugacgaggcugaacugcggcuguuagcuucgccgccccgggauaucacaguucacuccgugcuggauuuccuacagcugggggcccucgcaggccugcugagccgccugaucugccagcggcuccaggguggaagcccacgucagggcccggcagcagcucccgcucuggauaccuuaccagccccuaccagccuuguucugucgcagguaaccucuucuucgauccgguugagcuggacccccgccccaagacauccccuuaaguaucuuaucgucuggcgggccuccagggguggaaccccaagagaggucguugucgaaggucccgcagcauccacagaacugcauaaccuugcuuccaggacagaauaccugguaaguguguuucccaucuaugaaggcggagugggggagggucuccgagguuugguaaccacggccccgcucccuccuccacgagcauugacccucgccgccguaacaccaaggaccguacauuugacauggcagccuuccgcuggggcuacucacuaucucgugcgauguagcccggcaagucccaaaggagaagaggaggagagggaggugcagguuggucgaccagaggugcuccuggauggacuugaaccgggccgcgauuacgaggugucgguccagucucuaaggggaccggagggcagcgaggcgcggggcauucgagcccggaccccaacacucgcuccgccacgccaccucggguuuucugauguuagccaugacgcugcgcguguuuucugggaaggcgccccacgucccgugcgacuagucagagugaccuacgugucauccgagggaggacacagcggacagaccgaagcuccaggaaacgccacuagcgccacguugggcccgcuaucuuccaguacgacuuacacaguuagggugacaugucuuuauccaggaggcggcagcucgacucugacaggaagagucaccacaaagaaagccccuucccccagccaacugucuaugacugagcugccuggagacgcaguccagcucgcuugggucgcagcugcacccucuggcguauugguauaucagaucacuuggaccccucuuggagaggguaaggcucaugagaucagcguccccggcaaccucggcacagcagugcugccagggcugggcagacauacagaauaugacgugacaauccuagcauacuacagggacggggcccgaagcgauccuguaagucucagauauacccccagcacuguguccaggaguccacccucuaaccuugcucuggcaucagaaacgccugacucacuccagguuucuuggaccccaccccugggacgaguucuccacuacuggcugacguacgcucccgcaucaggguuagggcccgagaagucugugucagucccgggagccaggucccacguuacacuaccugaccuccaggcugcgaccaaguaucgcguccuggugucggcaauuuaugccgccggccgcagcgaggccguuagcgccacaggccagacugccuguccugccuuaaggccagacgggucuuugcccggcuuugaucuuaugguggcauuuucccugguggagaaagcauacgcuaguauucgcgggguugcuauggagcccucugccuucgguggaacacccacuuuuacccuguuuaaagaugcacaacugacucggcgcgucucugaugucuacccggcucccuugcccccagagcauacaauuguguuccugguuaggcugcugccugagacaccacgugaagcauuugcccuguggcaaaugaccgccgaagacuuccagccauuacugggcguucugcucgaugcaggcaaaaaaagccucaccuacuuccaucgggacccgagggcagcccugcaagaggccacauuugacccacaggagguuagaaaaaucuucuucgggagcuuccacaaggugcauguggcugucgguagaagcaagguucggcuguauguugacugccggaagguggccgaaagaccauugggcgaaaugggcaguccccccgccgcgggauucgugacccugggaagacucgccaaggcucgaggcccucgaagcucgagcgcagcuuuccagcuucagauguuacagaucguaugcagugacacaugggccgacgaggauagauguugcgagcugcccgcaucuagagauggggagacaugucccgcauucgugagcgcuugcucguguaguucagagacaccagguccacccggcccucagggaccuccuggcuugccuggacguaacgggacuccuggcgaacaaggguucccaggcccccgaggaccgcccggaguuaaaggagaaaaaggggaccacggucucccagggcuccaggggcaucccgggcaucaagguaucccuggucggguugggcuucagggcccuaagggaaugagaggccuggaagggaccgcaggccugccgggaccgcccgguccgcgggguuuucaggguauggccggagcucgcggcacaucgggagagcgcgguccaccugguacuguuggacccacggggcugccagggcccaaaggagagcggggggagaagggagaaccucagucacucgcaacuuuguaccagcucguuagccaggcuugcgagucggcgauucaaacgcacgugucaaaauucgauagcuuccacgagaacacgaggccaccgaugccaauacucgaacagaaguuggaaccaggcaccgaaccacuaggaucaccaggaacacgcagcaaagcacucgugccuggugaaugggggcgcgggggucgccaucuggagggccggggagaaccaggggccguugggcagaugggcagcccaggccagcagggugccucuacacaaggauugugggaguag

SEQ ID NO: 5295 - RNA, 3894 nt, Artificial Sequence
  Description of Artificial Sequence: Synthetic coding sequence
augucuucuggcgacccagcucaucuuggccugugcuuauggcuguggcucggagccaccuuggggcgcgagcaaguucaagccuccggccuuuuacgcuuggccguccuccccgaagacagacugcagaugaaguggcgcgaauccgaagggaguggcuugggcuaccuggugcaagugaaaccuauggccggcgauagcgagcaggaaguaauucugacuacuaagacaccgaaagcaacaguugguggacucucuccuaguaaaggauauacucuucagauauuugaguugaccggaucaggaagguuuuugcucgcuagaagagaguuugugaucgaggaccuuaaaucuuccaguuuggauaggagcagccagcguccucugggcaguggugcucccgagccaacacccucacauacaggcucucccgacccugaacaggccuccgaaccgcagguugccuucacuccaucccaggacccacggaccccaggcggcagcgaguggcgggagacaggcccacaguucagguguuuacccccagugccugccgauauggucuuccugguggauggcucauggucaauuggucauucccauuuccaacagguaaaggacuuccuggccagcgucauagcaccguuugagauuggacccgacaaaguccaggucggacucacccaguauucaggcgaugcacagaccgaaugggacuuaaauucacugagcacuaaagaacagguccucgcagcagugaggaggcuucgcuauaaggguggcaauacuuucacagggcucgccuuaacucaugugcucggacagaaccugcagccugccgcugggcugaggccggaagcugccaaaguugugauacucgucacagacgggaagucucaagacgaugugcacacugcagccagaguacugaaagaucucggagugaaugucuucgcugucggcgucaaaaacgcugacgaggcggaacugagguuguuagccaguccaccuagagacaucaccgugcacucuguacuugauuuucuucagcuuggcgcucuugccggccuguugagccgucuaauuugccagcgguuacaggggggauccccucgacagggacccgcugcugcaccggccuuagauacccuucccgccccgacgaguuugguccucucacaaguuacgucaagcucuauacgccuaaguuggacuccugcuccucgacacccucuuaaguaccucauuguguggcgugccucucgcggugggacacccagggaagucguuguggagggaccugcagcaucgacugagcugcacaaucuggccagcagaacugaauauuugguuuccguguucccaaucuacgagggcggcguuggagagggcuugagaggacuugucacuaccgccccccugccccccccccgcgcccuuacucuggcugcugugacuccaaggacugugcacuuaacguggcagcccucugcaggugccacacacuaucucguucguugcucaccggccagcccgaagggugaggaggaggagagggaaguccagguggggcgaccggagguguugcucgauggccucgagccagggagagacuaugaggugucaguacaauccuugagaggacccgaaggcuccgaagcccgcgggauuagggcacgcacuccgacacuugccccacccagacaucuaggcuucucagaugugagucacgacgccgcacgcguguuuugggaaggugcuccuagaccugugcggcugguaagggucacauaugucucuucugaaggcggacauagcgggcaaaccgaggcacccggcaaugcuaccagcgccacacugggcccuuugagcuccuccacaacauauacuguacgcguuacaugucucuaucccgggggagguaguuccacgcugacggggcgcgucacuacuaaaaaggcuccuucccccucucagcucucaaugacagagcuaccaggggaugccguccaauuggcuugggucgccgcagcccccucuggugugcuugucuaccagauuacauggacaccacugggagaggggaaagcucacgagaucagcgugccagggaauuugggaacggccguucuaccugggcuggggcgccacaccgaauaugauguaacaaucuuggccuacuaucgggacggagcucguucagauccuguaaguuuacgcuacacacccuccaccguuagccggaguccaccgagcaauuuggcacuggcaucagagaccccagauucccugcaggucaguuggacucccccucucggccgcgugcuccacuacugguugacuuacgcuccugccucagggcugggacccgaaaaaagcgucucagugccaggagcacgaucucacgugacuuuaccggaccuccaagccgcuacgaaauaucgcguccucgugucugcuaucuaugcugccggaagguccgaggccguguccgccaccggccagaccgccugcccugcuuugcgccccgacgggagccugccuggguuugaccugauggucgcuuucucccugguggagaaggcguacgcuucgaucagaggaguugcaauggagccguccgcauuugguggcacaccgacuuucacccuuuuuaaggacgcccagcucacuaggcgggucucugacgucuacccagcuccacugccuccggagcauaccauuguuuuccugguccggcuucuacccgagaccccucgcgaagcuuucgcccuguggcagaugaccgcugaggacuuucaaccacuguugggagugcuucucgaugcaggaaagaagagccugacauauuuccauagagacccacgggcugcucugcaggaagccaccuuugacccucaggaaguccguaaaauauuuuucgguucuuuccauaaggugcacguugccgugggccggagcaagguccgccuauacguggacuguagaaaaguggcagagagaccgcuuggagagaugggcaguccgccugccgcuggcuuuguuacacuuggacgcuuagcaaaggcucggggcccccguucaaguucagccgcguuccaguuacagaugcuccaaauugugugcagugauaccugggcugaugaagaucggugcugcgagcuccccgcgucucgggauggcgaaaccuguccugccuuuguuagcgcuuguaguugcaguagcgagacgcccggaccccccgggccgcaggguccuccaggccugcccggaaggaacggcacgccaggagagcaggguuuucccggaccucgcggcccucccggagucaaaggcgaaaaaggagaccacggacuccccgggcugcagggccacccuggccaccagggaauuccuggcagaguuggcuugcagggaccaaaaggcaugagggguuuggaggggaccgccggcuugcccggaccuccggguccacgcggauuucaagguauggcuggagcucgcggaaccagcggcgagcggggaccgccuggcacagugggcccuacagguuuacccggucccaagggggagcgaggcgaaaagggcgaaccucagucacuggcgacacuuuaccaauuagucucucaggcgugcgaaagcgcgauccaaacccaugugucuaaauucgauaguuuucacgagaauacuaggccaccaaugccaauucuugagcagaaacuggagccagggacugagccgcucggcagcccuggcaccaggagcaaagcacucgugccgggagaauggggacgcggcggccgccaccucgaggguagaggggaaccaggugccgucggccaaauggggucgccaggucagcagggcgccaguacucaaggcuugugggaguag

SEQ ID NO: 5296 - RNA, 2175 nt, Artificial Sequence
  Description of Artificial Sequence: Synthetic coding sequence
auggccgggcuaacugcugcagccccaaggccagggguccuguugcuguuauugaguauccugcacccuaguagacccgguggaguaccuggggcgauucccggagggguccccgguggcguuuuuuaccccggugcggggcugggcgcccugggggggggugcucuugggccaggugggaagccauugaagcccgugccagguggccucgccggcgccgguuugggcgcaggauuaggggccuucccagcagucacauuccccggggcucuugugccuggcgguguugcagacgcugccgccgcuuauaaggccgcuaaggcgggcgccgggcuagggggagucccuggagucggaggucuuggaguguccgcuggugcaguaguuccgcagcccggugccgguguaaaaccugggaaggugcccggugugggccugcccgggguauaccccgggggaguguugcccggagcgcgguucccugguguaggaguguugccuggcguuccaacuggggcuggcguuaaacccaaggcccccggcgugggaggggccuuugccggcauuccuggggucggcccauucggaggaccgcagcccggcgugccucuaggcuaccccauuaaggccccuaaacugccuggaggguacggccugccuuauacuacgggaaaacuccccuauggcuacgguccaggugguguagcaggcgccgccgggaaggcuggcuauccgaccggcacuggcguuggcccgcaggccgccgccgccgcagcagccaaggcagcugcgaaguucggcgccggggcagcugggguguugccuggggugggcggagccggcguaccgggcgucccuggcgccauuccugggauagggggaaucgcugggguaggcacucccgcggcugccgccgccgcagccgcugccgcuaaagccgcuaaauauggagccgcugcuggacuugugccaggcggucccgguuuugggccagggguggucggagugccaggagcggggguaccuggaguugggguccccggagcaggaaucccuguugugccaggagccgggauuccaggagcagcugugccuggggucguuagucccgaggcagccgcgaaggccgccgccaaagccgccaaguauggcgcucggcccggggucggaguuggcggcauuccuacuuacgggguaggcgcaggcgguuucccuggauuuggcguaggaguuggagguauuccgggcguagccggcgucccgggggugggcggcgucccuggagucgggggagucccuggaguagguaucucgccggaggcgcaggcagcggccgccgccaaagccgcuaaguacggaguaggaaccccugccgcagcugccgcaaaggcagcggcaaaggcagcacaguucggauuaguuccuggggucgggguggcgccaggcgucgggguugccccaggggugggagucgcuccuggaguuggacuggccccaggagucggaguggcaccaggaguaggagucgccccuggggucggaguggccccaggaauagguccugggggcguggcagcugcugcuaaaagcgcagcuaaaguagccgcgaaagcucaacucagggcagcagccgggcugggugcuggaauaccggggcucggcguugggguuggcgugcccgggcugggagucggagccggggugccuggauuaggagugggagcaggggugcccggcuuuggcgcugugccgggagcguuggccgcugccaaggcggcaaaguauggagccgcggugccaggcguguugggaggguugggagcacugggcggagugggcaucccugggggggucguuggcgccgggccagccgcugcagcugcggccgcuaaagccgccgccaaagcagcccaguuuggguuaguuggggccgcuggacucgguggauuaggagucggaggacuaggagugccuggaguagguggucucggcggaaucccaccugccgcggcggccaaggcugccaaauacggagccgccggccucggcggcgugcucgggggggcgggccaguucccgcugggcggcguggccgcgcgccccggguuuggacugagcccuauuuuuccagggggagccugccuggguaaggcauguggacggaaacgcaaauag

SEQ ID NO: 5297 - RNA, 2274 nt, Artificial Sequence
  Description of Artificial Sequence: Synthetic coding sequence
auggcaggacuaaccgccgccgcucccaggccaggaguccugcugcucuuacugucgauuuugcacccaucacgacccggugggguuccaggcgccauccccggugggguuccugggggcgucuucuacccaggcgccgggcuuggagcccuugggggaggagcacugggucccggcgggaagccgcuaaaaccugucccagguggccuggcaggugcgggccugggcgccggauugggagcuuuucccgcgguuacguucccuggagcucucgucccgggcgguguugcagacgcagccgcggcguacaaagcugcuaaagcgggcgccgggcucggagguguuccaggcguggguggccugggugucagugccggggcaguugugccacagccaggggccgggguuaagcccggaaagguacccggggucgggcugccuggagucuauccaggaggaguucuucccggcgcucgcuuccccggagugggaguacugccuggggugccgacuggagcaggcgucaaaccgaaagcuccuggcguugggggagcauucgcuggcauuccuggcgugggacccuuugggggaccacaaccaggugugccccugggguaccccaucaaggccccaaagcugcccggcggcuacggacucccauacaccacagggaagcuuccauauggguacggcccugggggcguggccggcgcugccgggaaagcggguuauccgacagggacuggugugggcccucaggcugccgccgccgccgcagcuaaggcagcugcuaaauuuggugcuggggcggcaggagugcugccagggguggggggcgcuggcgucccaggggugccuggggccaucccuggaaucggggguauugccggaguggguacuccggccgccgccgccgccgccgccgcugcagcaaaggcggccaaauacggcgccgcagcaggucuagugccgggcgggcccggcuucggcccaggaguggugggagugccgggagcuggggugcccggugucggagucccuggagccggaauucccguggugcccggggccggcaucccuggggcagcuguaccaggcgucguaucaccggaggccgcagcuaaagccgcagccaaagcugcuaaauauggagcaaggcccggggugggaguuggagguauaccgaccuauggagugggggcgggcgguuucccaggguucggcgugggcguaggcgguauuccuggcguggccggcguaccaggagucggcggagucccgggcgugggaggcguuccgggcgugggcaucucaccagaagcgcaggccgccgcugcagcuaaagccgcuaaguacggggucggaacuccagcggccgccgccgcuaaggccgccgcaaaagccgcucaguucggacugguuccuggcguuggaguggcaccaggaguaggcguugcaccaggagugggcguugcaccuggggugggccuggcccccggcguuggaguggcaccgggagugggaguugccccggggguggguguagcacccgggauagggcccggggggguggcagccgccgccaagucagcagccaagguugcggccaaggcacagcugagggcagcagcuggcuuaggagccggcauucccggccugggcguuggagucggcgugccggguuugggagugggcgcuggcguucccgggcugggaguuggugccggugugccaggguuuggugccggagcagacgagggagucagaagaucccucuccccggagcugagagagggcgaucccagcagcucucagcacuuacccuccacgccuagcaguccacgagugcccggagcucuggcagccgcaaaggcggcaaaguacggcgcugcugugccugggguccuuggaggccugggugcucugggcggugugggaauaccagguggagugguuggggcuggucccgccgcagccgcugcugcugcuaaggccgcagcaaaagcagcccaguuuggguugguuggugccgcaggguuggggggacugggagugggaggccugggcguacccgguguggguggucucggcgggauaccuccagccgccgcggcuaaggcggcuaaguacggugccgcaggacuugguggcguucuggguggagccggucaguucccacucgguggcguggcugcacgaccaggguuuggccugucccccauuuuuccuggcggugccugcuuggguaaagcguguggacgaaagcgcaaguag

SEQ ID NO: 5298 - RNA, 2136 nt, Artificial Sequence
  Description of Artificial Sequence: Synthetic coding sequence
auggccggacugaccgcugcagcuccacgaccuggcgugcugcuccugcugcucagcauacugcauccuagccguccugggggggugccuggagccauuccagggggggugcccggaggugucuucuacccaggcgccggccugggagcgcucgggggcggggcauuaggccccggaggcaagccuuugaaaccagucccaggcgggcuggccggcgcuggacugggugcagggcugggagcuuucccagccgugacuuucccuggcgcgcuugugcccggcggcguggcggaugcggcugcagcuuacaaggccgcuaaagcuggagccggucuggguggagucccugggguggguggauuaggagugucagcugcgccaagcguccccggggcgguggugccccagcccggcgcuggcguuaagccgggaaagguacccggcguuggacugccuggcguuuaccccggcggaguucugccuggugcacgguuuccaggggugggagugcuuccuggcguacccaccggagcuggggugaagcccaaagcacccgggguggggggcgcauucgcggggauucccgguguggguccauuuggagggccucagccaggcguuccacucggguacccgauaaaagcuccuaagcucccuggaggauacggguugcccuacaccaccggcaagcugccauacggauauggcccaggugguguggcaggagccgccggcaaggcuggauaucccaccggaacugggguagguccacaggcugccgcugcugcagcugcuaaggccgcugcaaaguucggggccggggccgcuggcgugcucccgggcgucggcggcgcugggguaccgggcguuccuggggcgauaccaggcauugguggaaucgcgggaguggggaccccagccgccgcugccgcagcagcugcugcugcaaaagcugccaaauauggcgcagccgcugguuugguuccaggcgggccugguuucgggccuggaguggugggcguaccaggcgccggugugcccggcgugggagugccaggagccgggauucccguagugccaggggccgggauaccuggggcugcuguaccggggguggugaguccugaagccgcugcaaaggccgcagcuaaagccgcaaaguacggugccagacccggcguaggcguuggggggauuccaacauacggcguuggggcagggggcuucccuggguucgggguuggggugggggguauucccggaguugccggcgugccuggaguggguggcgucccaggcgucgggggagugccagggguuggcauaaguccugaggcacaggcugcugcugcagcuaaagcugcaaaguaugggguuggaacgccugcggcugcugccgcuaaggccgccgcaaaagcugcucaauucggucugguuccaggcgucggcgucgccccaggaguggguguggccccagggguaggaguggcaccuggcguaggauuagcuccuggagucggcguggcgcccggagugggaguugcccccggugugggcguggcaccagggauuggcccaggagggguugccgcugccgccaaauccgccgccaaagucgcugccaaagcucagcucagggccgccgcuggccugggcgcugggauucccggucugggaguuggagucggggugccagggcucggaguuggugccggaguuccaggacugggcgugggagcaggcguccccggauucggugcagugccaggcgcuuuagccgcagcuaaggcagcaaaguauggcgcagccguccccggggugcuuggggggcucggcgcgcuggggggcguggggaucccuggaggaguggucggggccggcccugccgccgcugccgcugccgcuaaggcagccgcaaaggcggcucaguuuggucucguaggggcagcgggcuugggaggccucggugugggaggccuuggagucccuggcgugggugggcuuggugggauacccccagcggcugccgcaaaagcagcuaaauacggcguggccgcgcgacccggguucgggcugucaccaauauuucccggcggugcaugucugggcaaggcaugugguaggaagagaaaauag

SEQ ID NO: 5299 - RNA, 2379 nt, Artificial Sequence
  Description of Artificial Sequence: Synthetic coding sequence
auggccgggcuuaccgcugcugcuccucggccuggagugcuuuugcuuuugcugagcauucugcauccuucgcgacccggaggugucccaggagcuauaccaggcggggugccgggaggcguauucuaccccggagccggccuaggagcguuaggcggcggugcucucggccccgguggcaagccucucaagccaguacccgggggacucgcuggugccggguugggagccggacucggcgcguucccagccguaaccuuuccaggcgcucuagugccgggaggcguggccgaugccgccgcugcauauaaagcagcuaaggccggugcaggacuuggaggaguaccgggcgugggaggucugggcgugucagccggagcuguagugccccaaccaggcgccggggucaagccaggcaaggugccaggagugggccugccagggguguauccggguggcguacucccaggagcccgcuuuccaggcgugggagugcugccgggggugccuacuggagcuggaguuaagcccaaagcccccgggguggguggugcauucgcagggauaccaggcgugggucccuucggggggccucaaccaggggugccucucggguacccaauuaaggccccaaaauugccuggaggcuacggucucccauacacaacuggaaaacugccauacggguacggcccaggaggaguggcaggugcugccgggaaggcaggguaucccaccgguacugguguuggaccgcaagcugcugcagcugccgcagccaaagcugcagccaaguucggcgccggcgcugcaggggugcugcccggaguugguggugcuggaguaccgggggucccgggggcaauccccgguauaggugggaucgccggcguuggcacgcccgccgccgccgccgccgccgccgccgcugcaaaagcagcuaaauauggcgccgcugccggacuggucccuggggguccaggcuucggcccuggggugguuggcguccccggcgccggcgucccaggagugggcgugccuggagcaggcauuccuguugucccaggcgccgguauucccggggccgcugugccuggaguuguuucccccgaggccgcggcuaaagccgcagcuaaagcagcgaaguacggugccaggccaggagucggagucggaggaauuccaaccuauggaguaggggcagggggauuuccaggauucggggugggcgucggaggaaucccagggguugccggagugccuggggugggcggcguuccuggcgucggaggagugccuggagucgguaucagcccagaggcccaggccgccgcugcugccaaagcagccaaauacggcgcagcuggcgccgguguacuuggcggccuagugccaggagccccgggagccguccccggugugccggggacuggaggaguucccggagugggaaccccugcagccgcugccgccaaagcagccgcaaaagcagcucaauuugcccugcuaaaucuggcggggcucgugccaggugugggaguugcccccggagugggcguggcaccuggagugggaguggccccaggagugggccuggcgccuggcgucggaguagccccuggcguuggcgucgcaccaggaguuggcgucgcacccggaauaggcccuggcggaguagccgccgcggccaaaagcgcugccaaagucgccgcaaaagcccaauuacgcgcagccgcagggcuuggggcuggcauucccggucugggaguggggguugggguuccagggcuaggugugggcgcugggguuccaggccuuggugugggugcugguguucccggguuuggagcaggagcugacgagggugugagaaggagucucucaccugaacuuagagagggcgauccaagcuccucccaacauuugccaucuaccccuucuucgccccgcgucccaggcgcuuuagcugccgcaaaagcagcgaaguauggcgcugccguccccggcguccuugguggccuaggggcgcucgggggcguagggaucccgggggggguggucggugcuggccccgcggcggcugccgcggccgcuaaagccgccgcaaaggcugcgcaauucggacuaguuggagcagcagggcugggcgggcucggugugggagggcugggcguacccggugucggggguuuggguggcauuccuccugcugcugcggcgaaggccgcaaaguauggggcagccggccuuggcggcgugcucggcggagcaggacaguucccccuuggcggaguggccgccagacccggauucgggcuuagccccaucuuucccggcggugcuugucuugggaaagccugcggucggaaaaggaaguag

SEQ ID NO: 5300 - RNA, 2034 nt, Artificial Sequence
  Description of Artificial Sequence: Synthetic coding sequence
auggcaggguuaacagccgccgcaccucggccugggguucuucuucucuugcugagcauccugcaucccagucggcccggugggguccccggggccauuccugguggggucccaggggggguauucuacccggcuuugggcccaggugguaagccccugaaacccguaccgggcggccuggcgggcgcgggccugggagccgggcugggagccuuuccagccgugacuuuuccaggagcccucguccccggaggcguagcugacgcagcagcagcuuacaaagccgcaaaagccggcgcggggcugggcggcguaccuggugugggcggauuaggcguauccgcaggcgccguggucccgcagccaggugccggcguaaagcccggaaaaguucccggcguuggguuaccuggcgucuauccagggggcguacuucccggcgcucgguucccuggggugggagugcuaccaggcgugccaacuggagcaggcgucaaaccuaaagccccaggaguugggggcgccuuugccggcauucccggugugggccccuuugggggcccccagccaggcguaccccugggauauccaauuaaagcgccuaaguugcccggcgguuacggucugccuuauacuacagggaaacuacccuacggguaugggcccgggggaguggcaggagcagccggcaaagccggauauccuaccgggaccgggguaggaccgcaagccgcagcugcugccgcagcaaaggcugcagccaaguuuggcgcuggcgccgcuggcguucuaccgggaguggggggugccggagugccgggcguuccgggggcaauuccaggcauaggcgguauugcugggguaggcacaccugcggcagccgcagcugcugcagcagcagccaaagccgcaaaguauggagcagcugcuggacuggugccugggggacccggcuucgguccaggugucgugggcgugcccggagcgggcguuccagguguugguguaccaggugcaggaauucccgugguuccuggggccgggauucccggugcagcugucccgggugucguuucaccugaagcugcagcaaaggcugccgccaaagcugccaaauacggagcaaggccaggcgugggcguaggcgguaucccuacuuacggcguuggugcagggggguucccagguuuuggcguuggagugggugggauacccggaguggcaggggugccaggcgucggcggggugcccggcguggguggugugccuggcgucgguaucucaccagaagcucaagcagccgcugccgccaaagcugccaaauaugggcuggugccuggaguuggaguagcccccgguguuggcguagccccuggagucggaguggcaccaggcgugggccuagcuccaggugugggcguggcccccggcgugggcguggcacccgggguggguguagccccugguauaggccccggcgguguggcugccgcagccaaaucugcagcaaaggucgccgcuaaagcccaguugcgcgccgccgccggacucggggccggaauucccggcuugggugucggcguuggagugccaggucugggugucggcgcuggugucccggggcuuggggucggcgccggcgucccgggcuucggcgccgugccuggugcacuggcagccgcaaaggcggcuaaauacggugcugccgucccgggggugcucgguggucucggugcgcucgggggaguagguauccccgggggaguaguuggcgcaggucccgcagcggccgcagcugccgcuaaggcugcugcuaaggcggcccaguuuggauuagugggggcagcaggucuuggagguuugggugucggaggucuaggaguccccggugugggcggauuaggggggauaccacccgccgccgcagccaaagcggccaaguacgguguugcagcucguccgggauucgguuuguccccgauuuucccuggaggagcuugccuggguaaagcuugcgguagaaagcgcaaguag

SEQ ID NO: 5301 - RNA, 2118 nt, Artificial Sequence
  Description of Artificial Sequence: Synthetic coding sequence
auggccggacuuacagccgccgccccacggccugggguucuuuuguugcugcucagcauucuucacccuucacgcccuggcgggguuccaggcgcgauaccagguggagugccugggggagucuuuuacccaggagcgggacugggggcccuggguggaggggcguuggggccuggaggcaaaccacuaaagccagugccuggagggcuugcuggggcaggacugggggcuggucuuggggcuuuuccugcugugacauucccaggagcacuugugcccgguggcguagcugaugcagccgccgccuacaaggcugcgaaagccggagcaggccucggagggguucccggaguggggggucugggagugucugcuggugcugugguaccccagccgggagcaggcguuaagcccggcaaggugccaggcgugggcuugccagguguuuauccugggggugugcugcccggagcucgcuucccaggagucggcguucucccagggguccccaccggggcuggcgugaagccuaaagccccagggguagguggagcauuugcagguauaccuggcgucggucccuuuggcggcccacagccuggggucccgcucggcuaucccauaaaggcacccaaacuaccaggcggauacggacuccccuauaccacagggaaacuuccuuacggauacgggccaggaggagucgccggcgcugcggguaaagcugguuaccccacagggacuggggucggaccgcaggcagccgcggcagcagcugcuaaggcagcggcgaaguuuggcgcuggcgccgccggaguccuccccgggguaggcggcgccggugugccuggagucccgggggcaauccccggaauugguggaaucgcaggaguggggacacccgcugccgccgcggccgccgcagcagccgcgaaggccgcuaaauauggagcugccgccggucuagugccgggaggaccugguuuuggcccuggagucgugggcguccccggcgccggggugccaggcgugggcguccccggcgcaggcauccccgucguaccaggggccggcauuccaggagcggcugugccuggcguggucucccccgaggccgccgcaaaggcugcagccaaggccgcgaaguauggagcaagacccgggguuggcgugggcgguauuccgacauacgggguaggcgcaggcggcuuuccagguuucggugucggcgugggcggcauuccaggggucgcagggguaccuggcgugggcggcguucccggggucgggggcgugcccggagugggaauuagcccugaagcacaagccgcagcagcagcgaaagccgcaaaguacgggcugguucccggagucggaguggcccccgggguggggguugcccccggcguuggcguggcuccuggggugggacucgcccccggaguagggguugccccugggguugggguggcacccgguguggguguugcgccuggcaucggcccaggaggcguagccgccgccgcaaagucugcagccaaaguugcugcaaaagcccaacugcgggcugcugccggacugggagcuggcaucccuggacuuggcgucggugucggggucccuggccuggguguaggagcuggcgugcccggacucggagucggagccggcgucccgggcuucggggcugugccuggggcacucgccgccgccaaagcagcaaaauacggggcagcuguucccggggugcuggguggccucggcgcuuuggggggcgucgggauuccuggcgggguuguaggggcaggcccggcugcugccgcugccgccgcuaaggccgcggccaaggccgcucaguucggguuggugggggccgccggacugggcgggcugggcgucgggggcuugggcgugccuggggugggagguuuaggaggaaucccucccgcugccgcagccaaggccgccaaauauggggccgcgggauugggugguguauuagguggggccggacaguuuccccucgguggggucgcagcaagaccaggauuuggccucucgccuauuuuccccggaggcgccugucucggaaaagcuugcggaagaaaaagaaaguag

SEQ ID NO: 5302 - RNA, 645 nt, Artificial Sequence
  Description of Artificial Sequence: Synthetic coding sequence
auggccgggcugacagcagcagcuccgcgccccggcguauugcuauuguuacugucaauucuccacccuagccggccuggcggcgugccuggcgccauuccuggaggagugccugguggcguauucuacccgggggcuggacucggcgcucuaggugggggggccuuaggaccaggcggaaaaccucucaaaccagugccaggaggcuuggcaggagccggacugggggccggucucggcgcuuuuccagcugucacauuccccggagcccucguacccggcggcguggccgacgcugcagccgcuuacaaagcugcgaaagcuggcgcaggacucgggggugugccaggcguuggcggacuuggcgucagcgccggugccguggugccccagccgggugcuggugugaaacccggaaaggugcccgggguaggacugcccggaguuuacccaggcgggguacugccuggaguggggccuuuuggcgguccucagccuggcgugccgcugggauacccaauuaaagcucccaagcucccuggcgguuacggccugccuuauacaacuggaaaacugccuuacggauacggaccugguggggucgcaggcgccgcgggcaaagcaggcuauccgacaggcaccuag

SEQ ID NO: 5303 - RNA, 504 nt, Artificial Sequence
  Description of Artificial Sequence: Synthetic coding sequence
auggccgggcuaacugccgcggcgcccagaccaggugugcuguuacuccuccuuucgauccuacacccuagcagaccuggcggagucccaggagcuauucccgguggcgugccgggcgguguuuuuuauccuggugcaggucugggcgcccugggggggggugcucugggcccugggggcaagccgcucaaaccugugccugggggguuggcgggugcaggacugggugccggacuaggagccuuuccggccgugaccuuccccggagcacugguuccuggaggcguggccgaugcugcugccgccuacaaagcagccaaggcaggcgucggcccuuucggggggccccagccuggcgucccucucgguuacccgauuaaagcaccaaaguugcccggaggauauggacuaccuuauacuacaggaaagcuuccauauggguacggcccuggcggcguugcaggagcugccgggaaggcgggauaccccacuggcacagguuag

SEQ ID NO: 5304 - RNA, 2079 nt, Artificial Sequence
  Description of Artificial Sequence: Synthetic coding sequence
auggcaggccuuacugccgcagcgccaaggccggggguuuuauuguugcuccuuuccauucuccauccuagccguccuggcggggugcccggcgcuauaccaggcggcguacccggagguguuuuuuauccuggagcgggauuaggggcucugggagggggcgcuuuggggccagguggaaagccucugaaaccugugccuggugguuuggccggagccggccugggggcgggguugggcgccuucccggcugucaccuucccuggugcccugguucccggaggagucgcagacgcugccgccgccuauaaggcugcgaaagcuggagcuggccucgguggggucccagguguagggggucucggggugagugccgcuccauccguucccggcgccgucguaccccagccuggagccggagucaagccuggcaaggugccugguguuggcuugccaggcgucuacccuggugggguacugccaggcgcucgcuuccccggugugggagugcugccuggugugcccacuggggcaggagucaagcccaaggcaccaggaguaggcggggcuuuugcuggaauucccggcgugggccccuucggcgguccccagcccggcgucccacuuggguauccaauuaaggcuccaaaauugccgggcggcuacgggcucccauacacaacgggaaaguugcccuacggauauggcccuggcggcgucgcaggggccgcaggcaaggcuggcuaucccacaggcacaggaguugggccucaagcugcagcggccgcugccgccaaagccgcagcuaaguuuggagcuggagcagcuggcguguugccaggagugggcggcgccggagugcccggaguaccuggagccauccccgggauuggugggauugccggcguggggacaccagcugccgcugcagcggccgcugcugccgcuaaagcagcuaaguacggcgcugcggcuggacucguuccgggaggcccuggguuugggccuggcgucgugggagugcccggagccggcgugcccggagugggagucccgggcgccggcaucccuguugugcccggugcaggaauccccggggccgccgucccagggguggucagcccugaggccgccgcaaaagcugccgcgaaggccgcaaaguacggggcucggccgggaguagguguagggggcauuccaacuuauggcguuggugccgggggauucccuggguuuggcgucgggguagggggaauacccggcguggcgggcgugcccggagugggugggguaccggguguuggcggaguacccggcguaggaaucaguccagaagcccaagcugcggccgccgccaaggccgcuaaguacggccugguuccuggcgugggcguggcaccaggcgucggaguggcuccagguguaggugucgcuccgggagugggucuggcaccgggcgugggaguggccccagguguggggguugccccaggaguaggagucgcaccagguauaggcccuggcggcguggccgccgcugccaagagugcugcuaaaguggcugccaaggcccagcugagggccgccgcuggguugggggcagggauuccaggguugggugucggggugggugucccuggacuaggagugggggcaggcgugccuggccugggagugggcgccggggucccaggauucggugccgugccaggggcucucgccgcugccaaagcugccaaguauggcgccgcugugccuggaguccuuggaggacugggagcccugggcggggucgggauucccggaggcgucgugggcgccgggcccgccgcagcggcggcugccgcaaaagcagcugcaaaggccgcgcaguucggucuggucggugcugcagguuuaggcggccugggagucggcggucuggggguaccagggguugggggucucggaggcaucccacccgcugcugcugccaaggccgccaaauacggugucgcggcccgcccaggcuucggacugucuccgauuuucccagguggcgcuugccuugggaaggcgugcggaagaaagagaaaauag

SEQ ID NO: 5305 - RNA, 507 nt, Artificial Sequence
  Description of Artificial Sequence: Synthetic coding sequence
auggcuggccugacggccgccgccccuaggccuggcguacugcucuuacuucuguccauucuccacccuucacgcccaggagguguccccggggcuaucccuggcgguguacccggaggagucuucuauccuggagccgguuugggagcacugggaggcggagcccucggaccugguggaaaaccgcuaaagcccgggguggggccauucggcggcccucagccaggagugccucugggauaucccauaaaggcaccaaagcuuccuggguacggcccugggggcguggccggagccgcuggaaaagcaggcuacccaaccggaacugggguugggccucaggcagccgcagccgcagcugcaaaggccgccgcaaaauucggggcuggggcugccgggguuuuacccggugugggaggagccggagucccuggcgucccaggagcuauuccuggaauuggcggaaucgccggaguaggcacccccgcugccgcugcugccgcauag

SEQ ID NO: 5306 - RNA, 885 nt, Artificial Sequence
  Description of Artificial Sequence: Synthetic coding sequence
auggcuggacucacagcagccgcgccaagacccgguguucuucuccugcucuugagcauacuccacccuagucggccugggggcgugccuggcgccauaccaggggggguuccgggaggaguauucuacccgggggcgggccuaggugcauuggguggaggagcccucgguccuggagggaaaccgcucaaaccuggauugggggccuucccagccguaaccuuccccggcgcacucguucccggaggagucgcugaugcugcugccgcauauaaagcugcuaaggccggcgccgguuuaggaggcgugccugggguuggcggccuuggagugagugccggggccguggucccacagccaggagccggcgugaagccuggaaagguuccgggggucggacuccccgguguuuauccuggcgggguacucccaggcgcuagauucccuggcgucggcguucugccuggcguccccaccggcgcaggcguaaagccuaaagccccagguguaggcccauuuggaggaccucagcccggugucccccugggcuauccaauaaaggcucccaaacugcccgguggguauggacugccauacacaaccggaaagcugccauaugguuacggaccugggggugucgccggcgcagcaggaaaggccggguacccgaccgguaccggcguggggccucaggccgcagcggcugccgccgccaaagcugccgccaaguuuggcgcgggggcagcugggguguuacccggcguggguggcgcugggguccccggcgugcccggagcaauucccggaaucggaggcauugcagggguugggacccccgccgccgcggccgccgcagcagcagcugccaaagcggcuaaauacuag

SEQ ID NO: 5307 - RNA, 531 nt, Artificial Sequence
  Description of Artificial Sequence: Synthetic coding sequence
auggccggacugacagcagcugccccuagacccggaguacuccuccucuuacugucaaucuugcacccauccagaccgggugggguuccaggggcgaucccuggcgguguccccggcggugucuucuacccaggagcaggacugggcgcauuagggggaggugcacugggcccugguggaaaaccacucaagccaguucccggugggcuggcaggggccggccucggggccggccuaggagccuucccagccguuaccuucccuggcgcuuuagugcccggaggagucgcagacgcugcugcagcauauaaagcagccaaggccggcgccggacuggguggcgugccuggcguggggggccugggaguuucagcgggagcagugguuccccagcccggagcgggggugaaaccugggaagguaccggggguuggcggagcauucgcaggaauuccuggcguuggccccuucggagguccgcagccaggcguaccuuugggcuauccaauuaaagcucccaagcuaccguag

SEQ ID NO: 5308 - RNA, 1992 nt, Artificial Sequence
  Description of Artificial Sequence: Synthetic coding sequence
auggccgggcugacagccgcagccccccguccuggcgugcugcuguuacugcuuagcauucugcacccgucucggccaggcgggguuccgggugccauccccggcggggugccagggggcguuuucuacccaggagcaggcuugggcgcccucggaggcggggcucuuggucccggaggcaagccacucaaaccugugccggguggacuggcaggcgccggacucggcgcaggcgccggccuugggggcgugccuggcgugggugggcucggcgucucugcaggagcugucgugccgcagcccggagccgguguaaagccuggaaaagugcccggaguaggcuuacccggcguguaucccggaggcguacugccuggagcuagauucccuggugugggcguacuacccggaguuccuaccggcgcgggcgugaagccuaaagcaccgggaguggggggagcguucgcaggcaucccuggaguuggaccuuucggugguccccagccaggcgugccccuuggguauccaauaaaggccccuaaguugccuggaggguacggacucccguacacaacggguaaauugccuuacggguacggacccgggggggucgccggagccgcgggcaaagcagguuaccccacgggcacuggaguugggccacaggcugccgcggcugcugccgcuaaggcagccgccaaguucggggcaggcgccgcuggugugcugccuggggucggcggugccgggguaccaggugucccaggggccauuccagggauuggugguaucgccggggugggaacaccagccgcagcagccgcugccgccgcagccgccaaagccgcuaaauacggagccgcagcuggccucgugcccggggguccugguuuugguccaggcgugguggggguucccggggccggcgugccagguguaggggugccaggagccgggauuccugucgugccuggggcaggcauuccuggugccgcugugcccggcguggugucccccgaggcagcugcuaaggcagcugcgaaagccgccaaauacggugcacggcccggggugggcgucggugggauuccuacauacggaguaggcgccggggguuuucccggcuuuggaguggguguggguggcaucccaggcguugccggugucccaggagugggaggcguucccggagugggaggaguaccagguguugguauuuccccugaagcccaggcagccgcagccgcuaaagccgcaaaauauggugucgggacacccgcugcagccgccgccaaggccgcugcuaaggccgcccaguucggacuuguuccuggcguggguguugcuccaggggugggaguugccccaggcauugggcccgguggugucgccgccgcugccaaaagugcagccaagguggcagcuaaagcgcagcuucgggcugcugcuggacucggggcggguauuccuggucuggguguaggggugggaguaccgggauuggggguuggcgcuggugugccuggacugggggugggugccgggguccccggauuuggggccguucccggggcuuuggcagcugccaaagcugcuaaauauggggcugcagugccgggaguucucggaggguuaggcgcuuuaggcggcgugggcauucccggaggaguugugggagcgggaccugcagccgcugccgcugcggcuaaggccgcagcaaaggccgcccaguuugggcugguuggcgcugccgggcuuggcggguugggggugggcgggcugggagugccagggguuggcggacucggaggcaucccuccggcagcagcagcgaaagccgccaaguauggugccgccggacuagggggggucuuaggcggugcgggucaguuuccccugggagggguggcugcaagacccggauuuggccucucaccgauuuuccccggaggugcuugucugggcaaggcaugcgggcgcaagaggaaauag

SEQ ID NO: 5309 - RNA, 2121 nt, Artificial Sequence
  Description of Artificial Sequence: Synthetic coding sequence
auggcaggguugacagccgccgcaccccggccagguguguuguugcugcugcugagcauucugcacccuuccaggccaggaggagugccuggagcaauucccggagguguccccggcggcguguuuuacccuggagccgggcugggggcccuuggaggaggggccuuagguccggguggaaagccccugaaaccuguuccugguggccuugccggggccgggcugggugcugguuuaggcgcuuuccccgcggucaccuuuccaggcgcacucgucccagggggagucgcagaugccgcagccgcuuacaaggcugcuaaagccggagcaggacugggaggugucccaggaguuggaggcuuggggguuuccgccggcgccgucgugccccagccaggcgcaggagucaagcccggcaaagugccgggcgugggucugccuggcgucuaccccggcgguguucuaccaggugcgagguucccaggagugggaguauugccgggggucccuaccggggcagggguuaaaccgaaagcuccagggguggguggagcuuucgccgguaucccugggguggggcccuucggcggcccacagccuggagucccauugggcuauccaauuaaggccccgaagcugccuggcgguuacggauugccauacacuacagguaagcugccauacggcuacgguccagggggcguggcuggcgccgcaggaaaggcagguuaccccacagggacuggaguagguccacaggccgcggcugcugcagccgccaaagcggcugccaaguucggcgcaggcgccgccgguguacugccuggagugggaggggcuggcgugcccggcgugccaggagcaauuccuggcaucgguggcauugccggagugggaacaccggcugcagccgccgcagccgcagccgcagccaaggcagcuaaauauggcgcggccgccgguuugguacccggugggcccggcuuugggccaggaguuguaggcgugcccggugcugggguaccuggugucggcgugccuggggccggaauuccuguggugccgggggccggcauucccggagcagcaguacccgguguggucaguccugaagccgcggccaaggccgcugccaaagccgccaaguacggcgcgaggcccggggugggagucggagggauucccacauacggcguuggggccggaggguuccccggauuuggugugggcgucggcgguauaccugguguugcgggcguccccggcguagggggcgugccagggguggggggggucccuggaguaggaauaagcccagaagcucaagccgcagccgcugcuaaagcugccaaauauggaguaggcacaccagccgccgcagcugccaaggcagcggccaaagccgcccaauucggacugguaccuggcguuggcgucgccccuggggugggagucgcaccugggguuggaguggcuccaggugucggccucgccccugggguggggguggccccaggcguggggguggcucccggcgugggcguugcuccaggaauaggaccuggagggguggcagcugcagcuaagucggccgcaaagguagcagcaaaagcccaguuacgggcugccgccgggcugggugccggaauuccggggcugggagugggugugggagucccgggacucggcguuggagcaggcgugccugggcuuggagucggugcuggaguuccuggcuucggagccgugccuggagcacucgccgccgcuaaagcggcaaaguauggugcagccgugccuggggugcugggcggucuaggcgcccuagguggagugggcauuccaggcggcguggucggggcaggcccugcagcagcugccgcugccgcaaaagccgcugccaaagcugcacaguuuggucucgugggagcagccggguugggaggcuugggagucggaggacucggggugccuggcguggguggccuuggcggcauccccccagccgcagccgccaaggcagccaaauauggaguugcugcccggccaggcuuuggcuuaucaccuauauucccuggcggagcuugucuggggaaagccugcggaagaaagaggaaauag

SEQ ID NO: 5310 - RNA, 2145 nt, Artificial Sequence
  Description of Artificial Sequence: Synthetic coding sequence
auggccgggcugacugcugccgcaccccgccccgggguacuauugcuuuuauuaaguaucuuacacccuucacgccccgggggcguaccuggugccauuccaggcggaguuccaggugguguguucuauccagcccuugguccuggaggcaaaccccugaagccugugcccggcggauuagcaggcgcuggccugggcgcagggcugggagcuuuuccagcuguaacuuucccgggagcgcuuguccccggggguguugccgaugcugcagcagcuuacaaggccgcaaaagcaggggcaggccuaggcggagugccgggcguggggggacucggcguuucagcuggggcagugguuccucagcccggcgcugguguuaaacccgguaagguccccggcgugggccugccaggugucuacccugggggcgugcugccgggugcacgguuccccggaguuggagugcugcccggcguccccacaggggcaggggugaagccuaaagcuccuggugucggaggcgccuucgccggcaucccaggagucggcccauuuggggguccucagcccggaguaccucugggguauccuauuaaagccccaaagcuaccagggggauauggauuaccauacacaacaggcaaguugccauacggcuacggcccgggcggaguggccggagccgcuggcaaagcgggauaccccacugggacggggguuggaccccaagccgcagccgcugccgccgccaaggccgcagcaaaauucggggccggugcagccgggguguuaccuggcguuggaggggccggcguacccggcguaccuggggcuauccccggcauaggcggaauagccggcguaggcacgccugcggccgccgcugcagcugccgcugcagccaaagcagcaaaguacggugccgccgcuggauuggugcccggcggaccaggguucggaccgggagucgugggcguuccuggagcuggaguccccggaguuggggugccaggagccggcaucccagucgucccuggagccgguaucccaggggcagcaguccccggggugguaagcccugaggccgcugccaaggccgccgccaaggcggcaaaauauggagcaagacccggggucggcguagguggaauaccaacauauggugugggcgcuggggguuuccccggcuuuggcgucggcgucggaggaauccccggaguagccggugucccaggugugggcggugucccgggaguggggggcgugccaggcgucggcaucucccccgaggcucaggccgcugccgcugccaaggccgcuaaauacggugugggcacaccagccgcagccgccgcuaaggccgcugccaaggccgcucaauuugggcuggugccaggaguuggcguugcgcccgguguaggcguugcccccggcguuggagucgcaccuggcgugggauuggcucccgggguugguguugcccccggagugggcguugcaccaggagugggagucgccccggggaucggcccugggggcguggcagccgcagcaaagucagccgccaaagucgccgccaaggcacagcucagggccgcugccgguuugggagcaggaaucccaggauuagggguuggcgucggggucccgggccugggcguaggcgcaggaguacccggucuagggguuggcgcuggugugccagguuuuggagcugugccuggagcgcuugccgcugccaaagccgcuaaguacggggccgcaguuccuggugugcucggaggacuaggagcuuuaggaggaguggguauacccggcggaguggugggggcaggucccgccgcugcugcggcugcugcuaaagcugcagcaaaagccgcccaguuuggccucgugggcgcugcggguuugggcgggcugggugucggaggccuaggggucccaggagucgguggccuuggcggcaucccccccgcggccgccgcaaaggcugccaaauauggagcagcugggcucggcggcguucuggguggagccggacaauucccacuugggggcguagcagcccgccccggauucgggcuuagcccaaucuucccagggggagccugccuuggcaaggcaugcgggcguaagcggaaauag

SEQ ID NO: 5311 - RNA, 651 nt, Artificial Sequence
  Description of Artificial Sequence: Synthetic coding sequence
augggcgcugcgcgucuccucccaaaucugacacucugucuucaauuacucauccucugcugccaaacacagggcgaaaaccacccuucucccaacuucaaccaguaugucagagaccaaggugcaaugacugaucaacugucucgccggcagauucgcgaguaccaacucuauagccggacauccgggaagcauguccaggucaccggacgacggauuucugccaccgcagaggacggaaacaaguuugccaaacucauaguggaaaccgauaccuuugggucucgugugcgaaucaagggggccgagucugaaaaauauauuugcaugaauaaacgcgggaaacucauagguaaaccauccggaaagagcaaagacuguguguuuacggaaauugugcucgagaacaauuauacagcauuccagaaugcucgacaugaagggugguuuauggcuuuuacacgacagggccggccucgacaggccagucgcagucggcaaaaucaaagagaagcacacuucauaaagaggcuguaccagggacagcugccauuuccaaaccacgcugagaagcagaagcaauucgaauucgugggaucugccccuacgcgccgcacgaagagaacgaggaggccucaaccacugaccuag

SEQ ID NO: 5312 - RNA, 618 nt, Artificial Sequence
  Description of Artificial Sequence: Synthetic coding sequence
augggugcggcacggcucuuaccuaauuuaaccuuaugucugcagcuccugaucuuauguugccagacucaguacguuagggaccaaggggcuaugacagaucagcucucuaggcgucaaaucagagaguaccagcucuacagucgcacaucaggaaaacacguucaagugacaggccgaaggaucagcgcuacagcggaagaugggaacaaauucgcuaaacucaucguugagacagacacuuucggcucacgugucagaaucaaaggggccgagagcgagaaauacaucuguaugaauaagagagggaaacugaucgguaaaccaucagguaagaguaaagacugcguuuucacagaaaucguauuggaaaauaacuauacugcuuuccagaaugcucgccaugaggggugguucauggccuucacccggcaagggcgacccaggcaggcgucuagaagcaggcagaaccagcgugaagcccauuuuaucaaaagacuguaccagggccaacuuccauuccccaaucaugccgaaaagcagaaacaguucgaauucgucgguucagcccccacccgucggacuaagcgcaccagacguccacagccacuuacauag

SEQ ID NO: 5313 - RNA, 390 nt, Artificial Sequence
  Description of Artificial Sequence: Synthetic coding sequence
augggggauccgguggucacagaaacccccacucugcugggcuuaccagaacagagacgugcugccguuagacaugugaauaagggcgcugggauccuggagauccgguccguccauguuggugugguagugauuaaggcuguaucuaguggcuuuuacguggcaaugaauagaaggggucgguuauauggaucuagacuuuacacuguggacugccgguuucgugaaaggauugaagaaaacggccacaauacuuacgcaagccagagauggcguaggcgaggacagccuauguuuuuggcccuggacagaagagguggcccuagaccaggggggagaacccgcagauaucaccucagcgcacauuuccuuccaguccuugugucguag

SEQ ID NO: 5314 - RNA, 621 nt, Artificial Sequence
  Description of Artificial Sequence: Synthetic coding sequence
augucagggcccggaacggccgccgucgcucugcugcccgcaguacuccucgcgcucuuagccccuugggcugggagaggcggggccgcagcaccaaccgcaccgaauggaacgcuggaggccgagcuagaacgccguugggagucacuuguggccuugucccuugcaagauuaccagucgcagcucagccuaaagaagcagcgguucaguccggcgccggagacuaccugcuuggaauuaaaagacugcgaagacuguacuguaauguagggaucggauuucaccugcaggcucugccugacgggcgaaucggaggggcccaugcugacacaagggauagucuccuggaacugucuccugucgaaaggggcgugguuuccauuuucgguguagcuuccagauucuuuguggcaauguccucgaaaggaaagcucuacggcagccccuuuuuuacagaugaguguacauuuaaagaaauauugcugccaaacaauuauaaugcuuacgaaucauacaaguacccagguauguuuaucgcuuuauccaagaauggcaagacaaagaaaggaaaccgugucucccccacuaugaagguaacccacuuccugcccagauuauag

SEQ ID NO: 5315 - RNA, 723 nt, Artificial Sequence
  Description of Artificial Sequence: Synthetic coding sequence
augacgccccaccgcuuacugccccccuuacuguuguuacuugcguuacuacuugccgccucaccuggcggcgcucuagcuaggugucccggaugcggccagggcgugcaggcuggcugccccggcggcuguguagaggaagaggauggaggauccccagcagaaggcugcgccgaagccgagggcugucugcggagagaaggccaagaguguggggucuauacccccaacugcgccccaggacugcaaugucacccccccaaagacgaugaagccccacucagagcacuacugcucggaagaggcagaugucugccagcccgggcuccugccgucgcagaagaaaacccuaaggagaguaagccacaggccgguacugcccgcccccaggacgugaauagaagggaccagcagaggaacccaggaaccaguacaacgcccagucagccuaauucugccggcguccaggauaccgagauggggccuugucggcgacauuuagacaguguccuccagcagcugcagacagaaguguaucgcggcgcacagacacuguauguuccaaauugugaccauagagguuucuaccggaagcgccagugccgaucaagccaggggcagcgacgaggccccugcugguguguggacaggaugggcaaauccuuacccgggucgcccgaugggaacgggucaagcucaugcccgacugggucaucgggauag

SEQ ID NO: 5316 - RNA, 411 nt, Artificial Sequence
  Description of Artificial Sequence: Synthetic coding sequence
augaccccucacaggcuacuccccccacuguugcugcugcuggccuugcuucuggccgccucucccggcggggcccuggcgagauguccaggaugcggccagggaguacaggccgggugucccgggggauguguugaagaagaagacggagguaguccagcagagggcugugcagaggcugagggcuguuuacgacgcgagggucaggagugcggcguuuacacucccaacugugcuccuggguugcaaugccaccccccaaaagaugaugaagcuccccuccgggcgcugcugcuaggcagaggccgcugucuacccgccagggcaccagcaguccugucaagccccaggacccucagaaaacugagcccagaaccaggagcaaccuguuccugucgcggagaauccuag

SEQ ID NO: 5317 - RNA, 717 nt, Artificial Sequence
  Description of Artificial Sequence: Synthetic coding sequence
augacaccacaccggcugcuccccccucuguugcugcuacuugcccuccuguuggccgcaagccccggaggagcccucgcccgcugcccaggcuguggacagggagugcaggccggaugucccggagggugcguggaagaagaggacggaggcucgccagccgaaggaugugcagaagcugaggggugucugcgcagagagggccaggagugcggcguauacacuccaaauugugcuccagggcugcagugccaccccccaaaagaugacgaggcgccccuccgggcacuucuguuaggaagaggccgaugccucccugcaagagcgccagcagaagagaacccaaaggaauccaagccccaggccggaacagcucguccccaggauguuaaucggagagaucagcagagaaacccagguaccucuacuacgcccucccagcccaacagcgcagggguccaagauaccgaaaugggaccuugucguagacaccuggauagcguucugcaacaguugcagacagagguuuaucgcggugcccagacccuuuacguccccaauugugaucaucggggauucuaccgcaaaaggcaguguagaucuucacagggacagcgcagagggccauguugguguguagaucggauggggaaaucacuacccgggucaccugacggaaacggcucuagcucuugcccuacugggucaucuggcuag

SEQ ID NO: 5318 - RNA, 837 nt, Artificial Sequence
  Description of Artificial Sequence: Synthetic coding sequence
augccccgucucucccuucuacuuccucuguuacugcuccuguugcucccccuguugccgccuuuaagucccagccucgguaucagggaugugggugggcgccgaccaaaaugcgggccaugucgcccugaaggcuguccugcccccgcgcccugcccugcucccggcauuagcgcacuugacgaaugugguuguugcgcccgcuguuugggcgcagaaggagcuuccuguggaggaagagcuggcgguaggugcggcccaggccuggugugcgcgagccaagcugcaggugcggccccugagggaacuggucugugcgugugugcacaaaggggcacagucuguggcucagacggccgcucuuauccuagugugugcgcauugcgguugagggcccggcacacaccacgcgcucacccuggccaccugcacaaagcucgggauggaccuugugaguucgcuccagucgugguugugccaccuagaucuguccacaaugucaccggggcucaagucggccuaucuugcgaagugcgagccgugcccacacccgucaucacauggcggaaagugaccaaguccccagaggguacacaagcccuggaagaguugccgggagaccacgucaauauugcugugcagguacguggcgguccuucagaccacgaagcuacagcauggauucucaucaacccccugcguaaagaggacgaaggcguuuaucagugucacgccgccaauauggucggagaggccgaaagccacucaaccgugacagugcuggaucuaucgaaguacagaucuuuccauuucccugcgccagacgaucguauguag

SEQ ID NO: 5319 - RNA, 459 nt, Artificial Sequence
  Description of Artificial Sequence: Synthetic coding sequence
augugcucacugccaauggccagauacuacaucucuuuccucccagaaccucugcccgccaaaucuuugcagcacggcgugccacugucgcuagacuccucccugucaucacugcuagaaaagaucuguauccuucccaaucgaggcuuggcacguacaaaggucccuauuuuccugggaauccaaggcggcucccguugucuggcuugcguggagacggaggaggguccuucuuuacaauuagaagaugucaauauugaggaacuguacaaagguggagaggaggcgacaagguuuaccuucuuucagucuucaucggggucggcguuucgccuugaagccgccgccuggccuggcugguuucugugugguccagcggaaccacagcagcccguccaacugaccaaagagucugagccgagcgcgaggacuaaauuuuauuuugaacagucaugguag

SEQ ID NO: 5320 - RNA, 459 nt, Artificial Sequence
  Description of Artificial Sequence: Synthetic coding sequence
augugcagcuuaccaauggcuagauacuacauuauuaaguacgcagaucaaaaagcccuguauacacgagauggacaacugcuugucggugaucccguagcugacaauuguugugcagaaaagauuuguauuuugccaaaucggggacucgcuaggaccaaaguacccauuuuucuuggcauacaaggggguucaaggugcuuggcauguguggaaaccgaggaagguccgaguuugcaacuggaagauguuaacauagaggaacuguauaaaggcggcgaagaggccacgcgauuuaccuucuuucaaagcagcaguggaucagccuucagacuggaggccgcugcuuggccuggcugguucuugugcgggcccgcugagccccaacagccaguucaacuaacuaaggagagcgagccuagugcccguaccaaguuuuauuuugagcagucgugguag

SEQ ID NO: 5321 - RNA, 459 nt, Artificial Sequence
  Description of Artificial Sequence: Synthetic coding sequence
auguguucguuacccauggccagauacuauaucauuaaauacgccgaucagaaagcuuuauacacucgagacggacaacugcucgugggcgaucccguggcugauaacugcugugcagaaaagauaugcauucuuccaaaucgcggcuuggcuaggacgaagguaccaaucuuucuagggauccaaggggguucgaggugucucgcuuguguggaaacagaagagggccccagccuucagcuugaagaugugaacauugaagagcucuauaaaggaggagaggaggccacgcgguuuacauuuuuucaguccuccucaggcuccgcuuucagacucgaagccgcugcguggccaggaugguuucucuguggucccgcugaaccacagcagccugugcaacugacaaaagaaucugaaccaagcgcaaggacaaaguuuuacuuugagcagucgugguag

SEQ ID NO: 5322 - RNA, 600 nt, Artificial Sequence
  Description of Artificial Sequence: Synthetic coding sequence
augaacugcguaugucgcuuggugcuagugguccucucccuauggccagacacagccguugcuccaggacccccaccagggccuccaagaguuucucccgaccccagggcugagcucgacagcacuguccuccucacaagaucacuuuuagccgacacccggcagcucgcugcucagcugcgcgacaaguuuccugccgauggcgaccacaaccuggauucacugccaaccuuggcuaugagcgcgggggccuugggcgcucugcagcugcccgguguguugaccagacugagagcagacuuacuguccuaccucagacacguucaauggcuccgacgcgcaggcggaucuagccucaagacccuggaacccgagcucggaacacuucaagcucgcuuggacaggcugcugcguagacugcaauugcucaugucgcgccucgcucucccccagccaccaccggaucccccagcaccaccgcuggcccccccaucgucagccuggggagguaucagggccgcgcaugcaauccucggaggccugcacuuaacacucgauugggcuguuagagggcuccugcugcuuaagacccgccuauag

SEQ ID NO: 5323 - RNA, 621 nt, Artificial Sequence
  Description of Artificial Sequence: Synthetic coding sequence
augaauuuccaacagaggcugcagucguuauggacacuggcaagaccuuuuugcccuccccuccuugcuaccgcgucccagaugcagauggucguacugccgugucugggcuuuacucuacuccucuggagccaagugaguggcgcucagggccaggaguuccauuuuggacccugccaggugaagggagucgugccccaaaagcugugggaagcauucugggcugucaaagacacaaugcaggcucaggacaacauuacgagugcacgccugcuucaacaggaaguacuccagaacguuucagaugccgaaucuuguuaucucguacauacauuacuggaauuuuaucuuaagacgguauuuaagaacuaucacaauagaacugucgaggugagaacuuuaaagucuuucucuacguuagcuaacaacuucgugcucauaguaucgcagcugcagccuucucaagagaaugagauguuuaguaucagagauagugcccaccgcagguuccuguuauuucgcagagccuucaaacaacucgaugucgaggcugcccugaccaaagcccugggcgagguggauauccuguuaacuuggaugcagaaauucuauaagcuauag

SEQ ID NO: 5324 - RNA, 465 nt, Artificial Sequence
  Description of Artificial Sequence: Synthetic coding sequence
augaacuuccagcaacgguugcaaagccuguggacccuugcuucccgacccuuuugucccccucuacuggcaacagcaucacagaugcagaugguagugcugccaugccugggauuuacgcugcuacucuggucacaagucucuggggcgcaaggacaagaauuccauuucgggccaugccagguuaagggggucgugccgcaaaagcugugggaagcuuucugggcagucaaggauacuaugcaggcccaggacaacauaacaagcgcccgauugcugcaacaggaagugcugcagaacgugagucaggaaaacgaaauguucaguaucagagauucugcccaccgucgcuuccuacuuuuuaggagagcuuucaaacaguuggacguggaggcugcguugacaaaagcacuaggcgagguugacaucuuacuaacuuggaugcagaaauucuacaaacuguag

SEQ ID NO: 5325 - RNA, 624 nt, Artificial Sequence
  Description of Artificial Sequence: Synthetic coding sequence
augaacuuccagcaacgccugcaaucccuuuggacauuagcuucucgccccuucugcccuccucuguuagcaaccgcaucccagaugcaaaugguggugcugcccugucuaggcuucacauugcugcuguggucacaggugagcggcgcgcagggccaagaauuccacuucggccccugucaaguuaaaggagucgugccacagaaacugugggaggccuuuugggcugucaaggacaccaugcaggcacaggauaauauuacguccgcucgauuauugcagcaagaaguacuacagaauguuagugacgcugagucgugcuaccucguucacacccuucuggaauuuuaucuuaaaacugucuuuaaaaauuaucacaaccgaacgguagagguuaggacgcucaagagcuuuaguacgcuggccaacaacuuuguccuaaucguaucacagcugcagccaucgcaggagaaugagauguucucuaucagggauucagcacaccguagguuucuccuuuuccgacgcgccuuuaagcagcuggacguggaagccgcacugaccaaggcucuaggcgagguggauauccugcugacauggaugcagaaauucuauaaacuguag

SEQ ID NO: 5326 - RNA, 495 nt, Artificial Sequence
  Description of Artificial Sequence: Synthetic coding sequence
auggccucccacagcggccccucuacuucaguccuguuucuuuuuuguugccucgggggguggcuagccucccauacacugccgguacggcuucuaagacccagugaugauguacaaaaaauaguugaggaguuacagagccuuagcaagaugcugcucaaggacguugaagaggaaaagggagugcuugugucccagaacuauacucugccgugccugagcccugacgcccaaccgccuaacaauauccacucucccgcaauucgugcuuaccugaaaacuauacggcaauuagacaauaaaucugugauagacgaaauuaucgaacaucuugauaaacucauauuccaagacgcuccagagaccaauauuucaguccccacagacacccacgaaugcaagcgcuuuauucuaaccauuagucaacaguucucggaaugcauggacuuagcacucaaaucgcugacuuccggcgcccaacaggcaacaacuuag

SEQ ID NO: 5327 - RNA, 507 nt, Artificial Sequence
  Description of Artificial Sequence: Synthetic coding sequence
auguguuuccccaaggugcugagcgacgauaugaagaaacuaaaagcucggauggugaugucaagccuggccgagcuggaagacgacuuuaaagaaggguauuuagagacuguggcugccuauuaugaggaacaacacccagagcugaccccacugcuugaaaaagaaagggauggccuccggugccgcggcaaucguuccccggugcccgauguugaggaccccgcaacagaggagcccggagagagcuucugugacaaggucaugcgaugguuucaggcgaugcugcagagguugcagacuugguggcauggcguucuggcaugggucaaagaaaaagugguugcacucguacacgcuguccaggcauuauggaaacaguuucagucuuuuuguuguagucuguccgaauuauuuauguccucuuuccagaguuacggggcucccagaggcgacaaagaggagcugaccccacaaaaguguucagaaccccaaucaucaaaguag

SEQ ID NO: 5328 - RNA, 2070 nt, Artificial Sequence
  Description of Artificial Sequence: Synthetic coding sequence
auggcacccgccccagucacucucuuagccccuggagcagcuucaucaaugucuugcucccaaccuggccagcggucacccucuaaugauuuucaggugcuccguggcacugagcugcagcaccuguugcaugcuguggugcccgguccauggcaagaagauguggcagacgccgaggagugugcugggagaugcggcccacugauggacugcugggcuuuucacuacaaugugucuucccauggcugucagcugcugccuuggacgcaacacuccccccauucccggcuguggcacuccggccguugcgacuuguuccaggaaaagggcgaaugggguuauaugcccacacuccggaaugggcuggaagaaaacuuuugcaggaacccugacggugaccccggagggccuuggugccauacuacagacccggcuguccgcuuucaaucauguucuauuaaaucuugcaggguggcagcauguguuuggugcaacggggaggaguaucggggagccguagacagaacagaguccggcagagaaugccagcggugggaucuucagcauccccaccagcaccccuucgaaccgggcaaauuccuagaucaagggcuggacgacaauuacugucgcaauccugacggcagugagcgcccuuggugcuacacaacggauccacagauugaaagagaguuuugcgaucucccaagaugcggcucagaagcacaaccacgacaggaagcaaccagcgucucuuguuuucgggguaaaggcgaaggauaccgggggaccgccaauacuaccaccgccgccuaccuggcuucugucgguacacgaaagucucauauuagcaccgaucuccgccagaagaauacaagagccagcgaaguaggcggcggagccgggguugggaccuguuguugcggcgacuugagagagaacuucugcuggaaccucgauggaagugaagcuccuuggugcuuuacccuucggccugggacaagagucggguucuguuaccagauacggcgguguacugaugaugugaggccucaagacugcuaucacggcgcaggagagcaguacagggguacagugagcaagacuagaaagggcguacaaugucagcgaugguccgccgaaacuccccacaagcugcaggcucugacucucgggaggcacgcuuugaugucgggcacacgugcuuggaaguggcugagguugccuugccaugauuucgcacccgcaccagccagcguacauaucuacuugcgaaccgccuguaccaccggaggugagcugcugccugaucccgacggggacucacauggccccuggugcuacacaauggacccuaggacaccuuucgauuauugugcccugcgccguugcgaucagguucaguucgaaaaauguggaaagagaguugaucgcuuggaucagagaagaaguaagcugcgugucgccggcgggcauccagguaacagucccuggacagucucucuuaggaacagacauaugccccugacuggguacgaagucugguugggcacuuuauuccaaaacccacaacacggcgagcccggauugcaaagggucccgguggcaaaaaugcuuugcgggccaucaggcucacagcuagugcugcugaaacuagagcgcagcguuacgcugaaucaaagaguugccuugaucugccucccacccgaaugguauguggucccucccggaacaaagugcgaaaucgcaggguggggggagacgaaggggacagggaaugauacuguucugaauguugcccugcucaacgucaucucuaaucaggaauguaacauaaaacaucgagggcacguucgagaguccgaaaugugcacugaaggucuguuggcuccaguuggcgccugcgagggagauuaugguggcccguuagccuguuuuacacacaacugcugggugcuuaaaggcauucgcauccccaaccgaguuugcaccaggucuagauggccagcuguguuuaccagggucuccgucuuuguugauuggauucacaaagucaugcgucuggguuag

SEQ ID NO: 5329 - RNA, 2148 nt, Artificial Sequence
  Description of Artificial Sequence: Synthetic coding sequence
auggcccccgcuccagugacguuguuagcaccuggagcggcaaguagcaugucuugcucccaaccagggcaaagaucccccuccaacgacuuccaaguucugagagguacagagcuccagcaccugcuacaugcaguggugcccgggcccuggcaagaagacguggcugacgcggaggaaugugccgggcggugcgguccucugauggacuguugggcuuuccacuacaacgugucaagccaugguugccaacugcuuccauggacucagcacucuccccacucuaggcuguggcacucaggccggugcgauuuauuucaggaaaaaggcgaauggggcuacaugccuacguuacggaacggccucgaggagaauuucuguagaaacccugacggcgacccuggagggcccuggugccauaccaccgaccccgccgugagauuccagucaugcagcaucaagucuuguagaguggccgcuugugugugguguaauggugaagaguacaggggcgcaguggacaggacagaaucuggucgggagugucaacguugggauuugcagcauccucaucaacacccuuuugaaccggguaaauuuuuagaucagggccuggacgauaauuacuguaggaaccccgaugggagugaaagacccugguguuacaccacagauccacagauugagcgggaguucugcgacuuaccccguuguggaagugaagcccagcccagacaggaggccacuucugucucuuguuuuagagggaaaggggaaggguacagaggaacugccaacacaaccaccgccgcauaccuggcuucuguggggacgcggaagagucauaucagcacagaucuccggcagaagaacacacgugcuucugaggucggcggaggggcuggaguagguacuugcugcugcggcgaccugagagagaacuuuuguuggaaccucgacggaucggaggccccuugguguuuuaccuugaggccuggcacccgggugggcuucugcuaucagauacgccggugcaccgacgacgugagaccacaggauugcuaucacggugcaggggaacaguaucguggaaccgugucgaagacaaggaaaggcgugcaaugccaaagaugguccgccgagacuccccauaaauuacaggcauugacccugggaagacacgcccucaugucuggaacccgugcuuggaaauggcugcgucuaccgugucacgauuuugcuccggcccccgccaguguccauauuuaucugcguaccgcuugcacaacuggcggugaacuccugccagauccagauggcgacucacacggaccuugguguuauacuauggacccacguacuccauuugacuauugcgcuuugaggagaugugaccaaguucaguuugaaaagugcggaaagagaguagaucggcuggaccagaggcgcucaaaacuccgggucgccgguggccauccuggcaauucucccuggacuguuucacugcggaaccgacagggccagcacuuuugcgccgggucgcuggugaaagaacaguggauccucaccgcccggcagugcuuuaguaguugccacaugccucugacuggcuacgaggugugguuaggcacucuuuuucagaauccucagcauggcgaaccgggccugcaaaggguuccaguugcaaagaugcugugcgggcccuccggaagucaacuggugcugcugaagcuggagcggagcgucacucugaaccagagagucgcauugauaugccugccuccagagugguauguugugcccccuggaacuaaaugcgagauugcaggcuggggcgaaacuaaagggacaggaaacgauacaguccuuaaugucgcucuccugaacgugauaaguaaucaggaguguaauauuaaacaucgcgggcacgugcgggaguccgaaauguguacugaagggcuccuggcccccgugggggcgugugaaggagauuauggcgggccacucgcaugcuucacacacaacugcugggugcuuaaaggaauaaggauucccaaccgugugugcacuaggucaagguggccagcuguauucacuagaguuucuguuuucguugauuggauacauaaagugaugagacuagguuag

SEQ ID NO: 5330 - RNA, 1527 nt, Artificial Sequence
  Description of Artificial Sequence: Synthetic coding sequence
augaauugccagcaauuguggcuaggcuuuuugcuucccaugacaguaucaggaagaguccugggcuuggccgaggucgccccuguggacuaucugucacaauacggauauuugcagaaaccacuagagggcagcaauaauuucaagccagaggauauuacagaggcccugagggccuuccaggaagcuucagaacugccggugucuggccagcuggacgacgccacacgggccaggaugaggcagcccagaugcggguuagaggaucccuucaaucagaaaacuuuaaaguaccuuuugcuuggccgguggcggaaaaaacaucuuacauucagaauucugaaccugcccucgacacugccaccucauacugcucgggccgcccuccgucaagccuuucaggauuggaguaauguggcuccacucacauuccaggagguucaggcuggugcggccgacauacgauuaaguuuucauggccgccaguccuccuauuguucuaacaccuuugauggaccaggccgagugcuugcucacgccgacauaccagaauuagggucugugcauuuugaugaggacgaauucuggacagagggaaccuaucgcggaguuaaccuuaggaucaucgcugcacacgaagucggacacgcucuggggcuagggcauagucgcuacucucaggccuugauggcuccggucuaugagggcuaccguccccauuucaagcugcauccagaugacguggcagggauucaagcuuuguacgggaaaaaguccccuguaauuagggaugaggaggaagaagaaacugagcugccaacaguacccccugugccuacggaaccuucuccaaugccugauccuugcuccuccgaacuugacgcuaugaugcucggaccaagagggaaaacauaugcuuucaaaggggauuauguguggacagugagugacucagggccaggaccucuguuucgcgugucagcucugugggagggacugcccgguaaccucgacgcagcuguuuacaguccaaggacucaguggauccacuucuucaagggagacaagguuuggcgcuacaucaacuuuaaaaugagccccggauucccuaagaaacucaaccguguagagccuaacuuggacgccgcucucuacuggccauugaaccaaaaggucuuccuuuucaaggggaguggguacuggcagugggaugagcuggcccgaacugacuucucaucuuauccgaaaccaaucaaaggucuguuuaccggcgugcccaaccagccauccgcugccauguccuggcaggauggcagagucuauuuuuuuaagggcaagguuuauuggaggcugaaucagcaauugcgaguugaaaagggauauccuagaaacaucucacacaauuggaugcacuguagaccccgaaccauugauacaacgcccagcggcggcaacacaacuccuagcggaaccggcauaacacucgacacaaccuugagcgccaccgaaacgaccuucgaguauuag

SEQ ID NO: 5331 - RNA, 669 nt, Artificial Sequence
  Description of Artificial Sequence: Synthetic coding sequence
augggagugacaugggauuucuccauguccaauggcggucccagaggaaagaccuaugcuuuuaagggcgacuauguguggaccguuuccgauagcggccccggcccauuguucagaguuucagcccuaugggagggccugcccgggaaucuggaugccgcuguauacuccccccguacccaguggauccacuuuuuuaaaggugacaaaguguggcgauauauaaauuucaagaugagcccuggauuucccaaaaaauugaaccguguggagccaaauuuagacgccgcccucuacuggccacugaaccagaaagucuuccuauucaaggggaguggauauuggcagugggacgaguuagccagaacggauuucuccagcuacccgaaaccaaucaaagggcuauuuacgggcguccccaaucagcccagcgccgcuaugucuuggcaggacgguaggguguauuuuuuuaaaggaaaaguuuacuggagauuaaaccaacagcuccgagucgaaaagggauacccacgcaacaucagccauaauuggaugcacugcaggccaagaacuauugacacuaccccuucugggggaaacacuacacccucgggcaccgguauuacuuuggauacaacacuauccgcuacugagacuaccuuugaguauuag

SEQ ID NO: 5332 - RNA, 918 nt, Artificial Sequence
  Description of Artificial Sequence: Synthetic coding sequence
augaacugucaacagcuuugguuaggcuucuuauugcccaugaccguaaguggucgcgugcugggauuagcggagguugcuccaguggacuaccuuucacaguacggauaccugcaaaaaccccucgaagggucuaacaacuuuaagcccgaagauauuacagaggcgcugcgcgccuuccaggaggccucagagcugccggugagcggucaguuggacgaugccaccagagcacgcaugcgucaaccccgcugcggacuugaggauccuuucaaucagaaaaccuuaaaguaccuccucuuaggacgguggagaaaaaaacaucucacauuccgcauucucaaccucccuaguacacuaccgccucauacagcaagagccgcccucagacaggcuuuccaagauuggagcaaugucgccccuuugaccuuucaggaggugcaggccggugcagcggacauccgccugucauuucacggaaggcagagcaguuacuguuccaacacauuugaugguccaggaaagaagagcccaguaauaagagacgaagaagaagaagagaccgaacugccaaccgugccucccgucccgacagaacccucucccaugcccgaucccugcucguccgagcuagacgcuaugaugcugggcgaagcacccccucuacaggcagucgggcggagaugggggcagccagcugauccagaggcauggacaaauggcagcgacaugggguugcagcaugaacaguggagagcuccaugggaggaucuaugcuuucagggcggcuuauguguggacugcauccgauuucgaacuggcccguuggugcccucugucugcccucucggcggcgcuccacgcaaacccggguguugcugucugcuggcaucaaauacuauggacucauuacuauag

SEQ ID NO: 5333 - RNA, 1173 nt, Artificial Sequence
  Description of Artificial Sequence: Synthetic coding sequence
auggggcgcggagcccgaguucccuccgaggccccuggcgcuggcgucgagcggagauggcugggagccgcacuuguugcacugugucugcuuccugcccuuguucuccuggcaagacuaggagcacccgccgugcccgccuggucagcugcacagggggauguagcggcgcugggacucuccgccgugccucccaccagggucccuggcccucuugcuccacggaggagaagauauacucucacucccgccagacugcgaugggaccacuuuaaucucaccuauaggauucuauccuuccccaggaaucuccucuccccgcgagagaccaggagggcauuagccgccgcauuuagaauguggucagauguuucccccuuuucuuuucgagaaguugcuccugagcagccuuccgaucuaagaaucggguuuuauccuauuaaccauaccgacugucucguuagugcacuucaccacuguuucgacgggcccacaggcgagcuggcccaugcauuuuuuccuccccacggcggcauccauuuugaugacuccgaguacugggugcuggggccuaccagauacucauggaagaaggguguuuggcuuacugacuugguccauguagccgcacaugaaaucggacacgcacugggacugaugcacucccagcacggcagggcccucaugcauuugaacgcgacucugaggggauggaaggcacugagccaagaugaacuauggggacuacacagacuguacgggugccuugaucggcuguucgugugugcaaguugggcacggagggguuuuugcgaugcacggcgaagacucaugaagcgacuuugucccaguuccugugacuucugcuacgaauuccccuuucccacgguggccaccacuccaccccccccuaggaccaagacgagacuugucccugaaggccgcaaugugaccuuccguuguggacagaagauucuccauaaaaaagguaaaguguacugguauaaagaccaggaaccacuggaauuuucauauccaggcuaccuagcccugggggaggcacacuugucuaucauugccaacgccguuaaugaggggacauacaccuguguggugcgaagacaacagagaguguugacuacauauuccuggagagucagagugcgcggcuag

SEQ ID NO: 5334 - RNA, 1161 nt, Artificial Sequence
  Description of Artificial Sequence: Synthetic coding sequence
augggccgcggcgcccguguuccuagcgaagcccccggggccggggucgagagacguuggcuaggggcagcacugguggccuuaugucugcuccccgcccuggugcuucuugcgagacugggggcaccugccguacccgccuggagcgcggcccagggggaugucgcugcccugggccuuucugccguaccacccacacgagucccaggccccuuggcaccccgacgccggagauacacucucaccccugcucggcugaggugggaccauuuuaauuuaaccuauaggauccuuucauuuccaagaaaccugcugaguccucgggaaacucgccgugcuuuggcggcugcauuccgaauguggagcgacgugaguccuuucaguuucagggaaguggcuccagagcagccauccgaccugcgcaucggagggagaccacccccaccccggcccgguccugcacgaccggcuagucagccucgagcgccuccucgauugcugccugaucagccccacggcuugccgggccugcgggccgccccacuguugaggaggccccauggaggggcugggccccgucugcuccccccagcucggagacauccacugagaagacagagagugcucggucccgggccacacgcacuucagcucgaagagaggagagucgcacauggacccggcgccagaggcgggccccgggauaggccaagggcagguccugacgcacuaaccacaagaccaggggcccacgcucccgagagacacgccgcacgguuggagggcgucgugccaggccgugccgugggagccgcacccgcgcuucgaaugccuagacaggcugugagaguccgcguccugggggccgaagguuuauugcgcagaucaccugcagcccacgaagaagcucucccccagcaguuacgacuuuuacucagaauacccuugccacauggcggccaucacccaacugcuccgcaggaccagaaccaggcgggugcucgaggccaggaacgagauuuaccccuucgcccagaggacccuccacaggaacgugaaucuguacuggugcagggaccaggagcuccaggcgucuuguugccccgacucccuggucccggacgcggagcacccgaacaccaucgacaaagaagacaguag

SEQ ID NO: 5335 - RNA, 1293 nt, Artificial Sequence
  Description of Artificial Sequence: Synthetic coding sequence
auggggcggggcgcacgcgugccaucggaagcgccgggcgcaggggucgagagaagauggcugggagccgcauugguggcccucugucugcuuccggcacugguacuccuugcacgccugggcgccccugcagugccugccuggucugcugcucagggggacguagccgcccucggacuaagugccgugccacccacccgaguaccuggaccccuagccccacgacggcgacgcuauacccugaccccugcccgccugcgcugggaucacuucaaccugacguauaggauuuuguccuuuccccguaaccuccugucgccgagagaaacaaggagagcacuggcugccgccuucaggauguggagugaugugagccccuuuucuuuucgugaagucgcuccagagcagccaagugacuuacggauaggcuucuacccaauuaaccacacagacuguuuagucuccgcucuccaucauugcuuugaugggccaaccggagaacuagcacacgcuuucuuucccccccaugggggaauccauuucgaugauuccgaguauugggucuuaggacccacucgcuacucuuggaagaaaggggaucguccugguaguuggcgcccauuacuguguaguacaguaggcugcagggggcgugcacucggacagacagccggcggaacuuuucgugggggggggugccauuggucauuggccgguguuuggcuaaccgacuugguccaugucgcagcacacgagaucggacaugcccuaggacucaugcacucccagcacggccgagcccuuaugcaccugaaugcaacauuacguggguggaaagcacucucacaggacgaguuauggggacugcaccguuuguacggaugccucgaccgucuuuuuguaugugccuccugggccaggaggggcuucugcgaugcccgacggcgacugaugaaaagauugugccccucuagcugcgauuuuuguuaugaauuucccuucccuaccgucgcaacaacccccccaccaccccggacaaaaacccgccucgugccagaagggcgaaaugugacguuucggugcggccagaagaucuuacacaaaaaaggcaaaguuuauugguauaaggaccaggagccccucgaauuuaguuaucccggauaccuggcucugggugaagcgcaccuaucaauuaucgccaacgcuguuaaugaaggaaccuacaccugcgugguuagaaggcagcagcgcgugcuuaccaccuacaguuggaggguuagaguacgcggcuag

SEQ ID NO: 5336 - RNA, 717 nt, Artificial Sequence
  Description of Artificial Sequence: Synthetic coding sequence
augggccgcggcgcucggguuccgagcgaagcucccggagcagguguugagcggagaugguugggcgcagcacuuguggccuugugcuuacucccugccuuggucuuauuggcccgccuuggugcgcccgcagucccugcaugguccgcggcacaaggagacguggccgcucugggauuaagugcaguaccgccaacucgggugccaggcccucuggccccucggaggagaagauacacauugacgccugccaggcuccgcugggaccauuucaacuugacuuacagaauuuugaguuuuccacgcaaccuguugucaccgcgagagacccguagagcucuggccgccgccuuuaggauguggagugacgucucaccguucuccuuuagagaaguggcucccgaacaaccuagcgaucucagaauaggcuuuuaccccaucaaucacacagacugccugguuucggccuugcaccauugcuuugauggcccgacaggggaauuggcacacgccuucuucccaccacacggagggauucacuuugacgacagcgaauauuggguccugggucccacucgguauagcuggaagaaaggugacaggccuggauggccaccugguggucugucauccgcugcucagugggcagccgcagucggacucuggggaaggagacaggaaggacccucuggcguuguagcugcaacaggcguguag

SEQ ID NO: 5337 - RNA, 1938 nt, Artificial Sequence
  Description of Artificial Sequence: Synthetic coding sequence
augccacgaaguagggguggacgagcggcuccagggccacccccgccuccgccuccucccgggcaggcaccucgguggagccgcuggcgcgugccgggacgccuccuacuguugcugcugcccgcucugugcugucuacccggcgccgcgagagcagcggccgccgcugcaggggcugguaaccgugccgccguugcaguggccgucgccagagccgacgaagccgaggcucccuuugccggccagaacuggcugaagaguuacggguaccucuugcccuacgauucacgcgcuucugcgcuucacagcgccaaggcucuccagucagcugugaguaccaugcagcaauucuauggcaucccuguuacaggaguuuuggaucagaccaccauugaguggaugaagaaaccucgguguggggucccugaccacccucaccugucacggcgaaggaggaacaaacguuacgcacuuaccggccagaaguggcggcaaaagcacaucaccuauuccauacacaauuacacaccgaaggugggcgagcucgacacgcgcaaggcgauccgacaggcguucgaugucuggcaaaagguaaccccacucacguuugaagaagucccauaccaugagauuaaaagcgauaggaaagaggcugacauuaugaucuuuuucgccuccggauuccacggggauaguuccccauucgauggcgaaggcggauucuuagcacacgccuauuuuccugguccuggaauuggcggagauacccacuuugauucggaugagcccuggacacuuggcaacgcaaaccaugaugguaaugaucuguucuugguugcuguacacgaguuagggcacgcccuuggccucgaacauucaucagauccauccgcuauuauggcccccuuuuaccaauacauggaaacccauaacuuuaaacugccacaggaugaccuccagggaauucaaaaaauuuaugggccuccggccgaaccccuugagccgacacgaccacugcccacgcuccccgucaggcggauucacucuccuucagaacguaagcaugagcgccagccccgcccaccacgccccccccugggcgaccgacccaguacacccgggacuaaaccaaacaucugugacgguaacuuuaauaccguugcccuuuucaggggcgaaauguuugucuucaaggauagaugguucuggagacuacggaacaacagagugcaagagggauauccaaugcagaucgagcaguuuuggaagggauuacccgcucgaauugacgcggcguaugagcgagcugacggacguuucguguuuuuuaagggagauaaauacugggucuucaaggaaguuacaguagagccuggcuacccacacagcuugggagagcuuggguccugucuuccgagggagggcaucgauacagcccuaagaugggagccaguuggaaaaaccuacuucuucaaaggcgagcgguacuggcgguacagcgaggagcgaagggcuacagaccccgguuaccccaaaccuauuacagucuggaagggcauuccucaagcaccucagggggcguuuauuagcaaagagggcuacuauaccuacuucuauaaagggcgcgacuauuggaaauucgacaaucagaaacucuccguggagccggguuacccuagaaauauccugagggacuggaugggcugcaaucagaaggaaguggaaaggcgaaaggagcgaagauuaccacaggaugacguggauauuaugguaaccaucaacgauguccccggaucugucaaugcugucgccguugucauacccugcauccuuagccugugcauucuaguuuugguuuacaccauauuucaguuuaaaaacaagaccgguccacagccugugaccuauuauaaaagaccaguccaggaauggguguag

SEQ ID NO: 5338 - RNA, 1542 nt, Artificial Sequence
  Description of Artificial Sequence: Synthetic coding sequence
augaaacgucuccuacuccucuuuuuguucuuuauuacuuuuaguucugcguuuccacuuguuagaaugaccgaaaacgaggagaauaugcagcucgcacaagccuaucuaaaccaguucuacucccuggagauagaagggaaucacuugguucagucaaaaaauagaucacuaaucgacgauaaaauucgcgaaaugcaggcuuuuuucggauugacggucacuggcaaacuugauucaaacacgcuagagaucaugaagaccccucggugcggagugccagauguggggcaauacggcuauacacugccaggauggcgaaaauauaauuugacauacagaauuauuaacuauacucccgauauggcucgagccgccguggacgaagcaauccaagaaggcuuggaggucuggagcaaggugacgccacucaaguuuaccaagaucucaaagggcaucgcagacauuaugaucgccuucagaacacgggugcauggaagaugcccuagauauuucgacggcccccuugguguucucggacaugcauucccaccaggucccggacuuggcggagacacacauuucgacgaggaugaaaauuggacgaaggauggggccgguuucaaccuguuucugguggccgcccacgaguuugggcaugccuugggccucagccauucaaacgaccagacggccuuaauguucccaaauuacgugucacuugaucccagaaaguacccucugucucaggacgacaucaacggcauucagagcaucuauggaggccugccaaaggagccugcaaagccuaaggaaccaacgaucccccaugccugcgauccagaccugaccuucgacgcaauuacuacguuccgccgcgaggugauguuuuucaaggguaggcaccuuuggagaauuuacuacgacaucacagauguggaauucgaacugaucgccucauuuuggcccucccucccugcagaucugcaggcagcuuaugagaaccccagggauaaaaucuugguuuuuaaggaugagaacuucuggaugauacgcggauaugcaguccuucccgauuaucccaaauccauccacacacuuggguuuccaggacgcgugaaaaagauugaugccgcugugugcgauaagaccaccagaaaaacauacuuuuuugugggcauuuggugcuggcguuucgacgagaugacucaaacuauggacaaaggguucccacagagagugguaaagcauuucccuggaauuagcauccgcguugaugcagcuuuccaguacaaaggcuuuuuuuuuuuuucccgcggcagcaaacaguuugaauacgacauuaaaacaaaaaauaucaccagaauuaugcgcacaaauacgugguuucagugcaaagaaccgaagaacucaaguuucggauuugauauaaauaaagagaaggcccacagcgggggaaucaagaucuuauaucacaagucuuuaucccuguuuauauuuggaaucguacaccuccugaaaaauacaucaauauaccaguag

SEQ ID NO: 5339 - RNA, 393 nt, Artificial Sequence
  Description of Artificial Sequence: Synthetic coding sequence
augguggccagggugggacuauugcugagagcccugcagcuccuacuguggggacaucucgaugcccagccugcagagcgaggggggcaggaguuacggaaggaagccgaggccuuucucgagaaguacggauaucugaaugagcaaguuccuaaagcaccaacuuccacacgguucucagacgcuauucgggccuuccagugggugucacagcuuccggugagcggcguucuggaccgagccacccugagacaaaugacacgacccagauguggggugaccgacacuaacaguuaugccgccugggccgaaagaauauccgacuuguuugcgagacacagaacgaagaugagacguaagaaaagguucgcaaagcagggcgaacacuguuag

SEQ ID NO: 5340 - RNA, 1560 nt, Artificial Sequence
  Description of Artificial Sequence: Synthetic coding sequence
auggucgcacgcguugggcugcugcugcgggcucuccaguuacugcuuuggggacaucuugacgcacagccagcggaaagggggggacaggagcugcgcaaagaagcagaagcauuccucgaaaaauacggauaccuuaacgaacaagucccuaaggcacccacuagcacucgcuuuucagacgcgauacgagcuuuccaaugggucagccagcuuccagucucugggguucuggacagggccacauuacgacagaugaccaggcccaggugcggggugaccgauacaaauagcuaugccgccugggcugagaggauauccgacuuguucgcaagacaucggacuaaaaugaggcguaagaagcguuuugccaaacaaggaaauaaaugguauaaacagcaucuguccuaccgucuggugaauuggccugagcauccagaacccgcugugaggggagcuguccgcgcggccuuccagcuguggucuaacgucucugcucuggaauuuugggaggcgccugcgacugggccugccgauauuagguugaccuuuuuucagggagaccacaacgacggccuggggaacgcuuucgacggcccggguggagcccucgcccaugcuuuucuuccccguagaggagaagcucacuucgaucaggaugagcguuggucacucucacgucguagagggcggaaucucuucguugucuuggcucaugagauaggacacacucuggggcugacccauucacccgccccuagagcacuuauggcacccuacuauaaacgguugggcagagaugccuugcugaguugggacgaugugcuggccgugcagagccuuuaugggaagccccugggggggucuguggcggugcaacugcccggcaagcuuuucaccgacuucgaaaccugggacucuuacucuccacaaggacgccgcccagagacucaaggccccaaguauugucauuccaguuucgaugcuauuaccguugaccggcaacaacaacucuauaucuuuaaggguucccacuuuugggaaguggccgccgacgggaacgugagcgaaccaagaccgcugcaggaacgauggguaggccucccuccuaacaucgaggcagcagccgugagucugaacgauggagauuuuuacuucuucaagggcggcagaugcuggcgguuccgaggaccgaaaccgguguggggccuaccccagcuguguagagccgguggccucccacgacacccugacgcagcacuguuuuuucccccacugaggcgucugauucuguuuaaaggggcucgcuacuauguuuuggcgcggggcgggcuacagguugaaccuuacuacccaagguccuuacaagacuggggcgguaucccagaagaagugagcggcgcccuccccagaccggacggaaguaucauuuuuuuucgcgacgaccgguacuggcgcuuagaccaggccaagcuucaggcuacuaccagcggcaggugggcaacggaguugccguggaugggcugcuggcaugccaacuccggcagugcgcuguucuag

SEQ ID NO: 5341 - RNA, 1179 nt, Artificial Sequence
  Description of Artificial Sequence: Synthetic coding sequence
auggucgcaagaguaggcuugcuucuacgugcacugcaguuguugcucugggggcaccucgaugcucaaccugcagaacguggcggacaggagcugagaaaagaggcugaagccuuccucgagaaguacgguuacuuaaaugagcaggugcccaaagccccaaccucaacacgcuuuucggaugcaaucagagccuuccagugggugucccaauuaccagucucuggagugcuugauagggcaacucugagacagaugacuagaccuaggugcggcguaacagacacuaacucuuaugcagcaugggcagaacguauuucugaucuuuuugccagacacagaaccaaaaugcgacgcaagaagagguucgccaagcagggaaauaagugguacaaacagcaucugucauacagguuagucaauuggccggagcauccggagccugcugugaggggcgcggucagagcagccuuccaacuguggucaaacgugucggcauuagaauucugggaagccccagcaaccgguccagccgauauccgauugacguucuuucaaggggaccauaacgauggacuaggaaaugccuucgaugggccugguggcgcgcuggcccaugcguuccugccgagaagaggagaagcucacuucgaccaggaugagagauggucccuguccagacggcggggccgcaacuuauucguagugcuggcacacgaaauuggucauacccuggggcucacucauagcccagcgccgagagcucuuauggcaccauacuacaaaagacugggcagggaugccuugcugagcugggaugaugugcuggccgugcagucccuuuauggcaagccucuaggaggauccguugccgugcaguugccugguaaacucuucacagacuucgaaacuugggacucauauuccccucagggcagaaggcccgagacccaagggccuaaguauugucauaguucuuuugacgccaucaccguggaucgacagcaacagcuguauaucuucaagggaagucauuuuugggaagucgccgccgaugggaauguaagcgaaccaagaccauuacaggagaggugggucggccugccgccaaacauugaggccgccgccgucagccuaaacgauggggauuucuauuuuuuuaagguccaguccgucuag

SEQ ID NO: 5342 - RNA, 678 nt, Artificial Sequence
  Description of Artificial Sequence: Synthetic coding sequence
auggucgccagggucggccuccucuuaagagcacugcaacuuuuacucuggggccacuuggaugcucagccagcugagcgaggaggccaggagcuccgcaaggaagccgaggccuuucuugagaaguauggauacuugaacgaacagguuccuaaggcucccacaagcacuagauucucagaugcaauacgcgccuuucaaugggucucacaacuccccgugagcggaguucuggauagagccacccugcggcagaugacacggccgcgauguggaguuacugacaccaauagcuaugccgcuugggcugagcgcaucuccgaucuguuugcucgucacaggacuaaaaugcgacguaagaaaagauuugccaagcaaggcaauaaaugguacaagcagcacuuauccuauaggcuugucaacuggcccgaacaucuaaggucccgccaguucggcgcgcccugugcaccuccuagcucauguggcgcaaccucccagcgcuggucauccggacgcccacagccacaagccccccugacuuccggcucccccucuucuaaagguacuacaaccaugggcugggcuaugccuuugauggcucagggagcucccuggcggacuccaagcugcccagcugcagcaaagaggacaaguaccaagaugucugcuggcccguag

SEQ ID NO: 5343 - RNA, 1095 nt, Artificial Sequence
  Description of Artificial Sequence: Synthetic coding sequence
augcacagauugaucuucgucuauacacugaucugugccaauuuuugcucaugccgggauacaucugcgaccccccagucagcgucaaucaaggcguugcggaacgcuaaccuccgaagggaugaucuguaccgccgagaugaaacaauccaggucaaggggaaugguuauguucaguccccccguuuuccgaacucuuauccuagaaaccuguugcugacauggcgccuccauucucaagagaacacccggauucagcuagucuuugauaaccaauucggacuagaggaggcugagaacgauaucugccguuaugauuuugucgaagucgaggacaucucagagacuaguacuaucaucagaggcagguggugcggucacaaggaagugccgccacggauaaaaucccgcacaaaucagauuaagaucacuuuuaaauccgacgauuauuucguugccaagcccgguuucaagauuuacuacucacugcuagaagacuuccagcccgccgcugccuccgaaacuaacugggagagcguuacauccucuaucuccggagucaguuacaauucgccgagugugaccgaccccacacugaucgccgacgcacucgacaaaaagaucgcggaauucgacacugucgaggacuuacugaaguacuucaacccugagucuuggcaggaagaucuagaaaacauguaccuugacacaccacgauauagaggaagauccuaccacgaucgaaaaucaaaaguugacuuggacaggcugaaugacgacgcuaagcguuacagcugcaccccccggaacuacucagucaacauacgagaggaacucaaacucgccaauguggucuuuuuuccccggugucuccucguccagcgaugcggcggcaacuguggaugcggcaccguuaauuggagaagcugcaccugcaauuccggcaagacugucaaaaaauaccaugaagugcuccaauucgagccuggccauauuaagaggcgugggagagcuaagaccauggcuuuagucgacauccaguuggaccaucacgagagaugcgacugcaucugcucuaguaggccaccucgcuag

SEQ ID NO: 5344 - RNA, 1113 nt, Artificial Sequence
  Description of Artificial Sequence: Synthetic coding sequence
augcaccggcugauuuuuguguauacacugaucugcgccaauuuuuguucuugucgagauacaucagccaccccucaauccgcaucgauuaaagcucuuagaaacgcgaaucugcgaagggacgaguccaaucaucucacagaccuauauaggcgggacgaaacaauccagguuaagggcaacgguuacguucaaucccccagauuccccaacaguuaucccagaaaucuguuacucacauggagacuccacagccaggaaaacacacggauucagcuuguauuugacaaccaguucgggcucgaggaagcggagaacgacauuugccgcuaugacuuugucgaaguagaggacauuagcgagacaucaaccaucauccgcggccgauggugcggccacaaagaagugccuccacggauaaagagcagaacaaaucagauuaagaucaccuuuaagucggacgacuauuuugucgcaaagccaggcuucaaaaucuacuauagucuucucgaagauuuccagccagccgccgccagcgagacaaacugggagagcguuacaagcuccauaaguggcgucuccuacaauaguccuucugugacagauccaacccugaucgccgacgcccuggacaaaaagauugccgaguucgauacaguugaagauuugcugaaguauuuuaacccagagagcuggcaggaggauuuggagaacauguacuuggauaccccccgauauagagggagauccuaccacgauaggaaauccaaggucgaccuggaccguuugaaugacgacgccaagcgguacagcugcacaccaagaaauuauuccguuaacauucgcgaagaacugaaguuggccaaugucguguuuuucccaaggugccugcucguucaaagauguggaggaaauuguggauguggcacugugaacuggaggucguguaccugcaacagcggcaaaacagugaaaaaguaccacgagguucuccaguucgagccaggacauaucaagaggagaggacgcgccaaaaccauggccuuaguugacauccaacuggaccaccaugagcggugcgacuguauuugcaguucacggccaccacgauag

SEQ ID NO: 5345 - RNA, 726 nt, Artificial Sequence
  Description of Artificial Sequence: Synthetic coding sequence
augaaccgcugcugggcccuguuccuaucccucugcugcuaucuccggcucguuucugcggagggggaccccauuccugaggaacuguacgaaaugcuuagcgaucacuccauucgaucuuucgacgaucuacaaagguugcugcacggcgacccuggggaggaagauggugccgagcuggacuugaacaugacucgaucucacagcggcggugagcucgaaucccuugcucguggccgccggagccuggguucucugacaauugccgagcccgccaugauagccgaaugcaagacccgaacagagguuuuugagaucucuaggcgacugauugaucguacaaacgccaacuuccucguuuggccccccugcguugaagugcaacgcugcuccgguuguuguaauaauagaaaugugcaaugucgcccuacccaaguacaauuacgcccaguucagguucggaagauugaaauaguucgaaaaaaaccaaucuuuaagaaagcgacaguuacccuagaggaucaccuggcgugcaagugcgaaacaguagcugcagcuagaccagugacacguucucccggagggucucaagaacagcgcgcaaaaacaccucagaccagagugacaauccgaacugugcgaguucgcaggccuccaaaggggaagcaucguaaguucaagcauacgcacgauaaaacggcucucaaagaaacccugggagcauag

SEQ ID NO: 5346 - RNA, 681 nt, Artificial Sequence
  Description of Artificial Sequence: Synthetic coding sequence
auguuuauuaugggauuaggugaccccauaccugaagaguuguacgagaugcugagcgaucauagcauuagaaguuuugacgaccuccagcgacugcuucauggggauccaggugaggaggauggggcagaauuggauuuaaauaugacucgaucacacucuggaggagagcuggagucccuggcccggggacgccggucccuuggcucacucacuauugccgagccagcaaugaucgcugagugcaaaaccaggacugagguuuucgagaucucccggcgacugauagacagaacuaacgcaaacuuucucguguggccgccaugcguggagguccaacgauguuccggaugcugcaauaauaggaacgugcagugucguccaacucagguucagcuucgaccgguacagguucgcaagauugagauuguccgcaaaaagccuaucuucaagaaagcaacagugacucuagaggaucacuuagccuguaaaugcgaaacagucgccgcugcuaggcccguuacucgaucuccaggggguucccaggagcaacgggcgaagacaccacagacccgcgugacuauuaggacuguuagaguaaggcgcccaccuaaaggcaaacauaggaaguucaaacacacacacgauaagacugcacuaaaggagacacuuggagccuag

SEQ ID NO: 5347 - RNA, 411 nt, Artificial Sequence
  Description of Artificial Sequence: Synthetic coding sequence
augcuuucagaucacucuauuagaucuuuugacgaucuccagagacucuugcauggcgauccaggggaagaggauggugccgagcucgaucugaauaugacaaggagucacagcggaggagaacuggagagucuggcuagaggcagacggucauuaggcagccucacuauugcugagccggccaugauugcugaguguaaaacccggacugaagucuucgagaucucaaggcgcuuaauugaccgcacaaaugccaauuuccuuguguggcccccuugcgucgaggugcagagguguucaggaugcuguaacaaucgaaacgugcaguguaggcccacccaaguccaauuacgcccaguccaggugcgcaaaaucgaaauagugcgaaagaagcccaucuuuaagaaguag

SEQ ID NO: 5348 - RNA, 435 nt, Artificial Sequence
  Description of Artificial Sequence: Synthetic coding sequence
augcuuucagaucauucuaucaggaguuucgaugacuuacaaagauugcuucauggagaucccggagaagaagauggggcagaacuggaucugaauaugacccguucacauucagguggggagcuggaaucgcucgcucgcggaagaagaaguuuggguucacucacuaucgccgagccagccaugaucgccgaaugcaagacucgaacggaaguauuugaaauuucacggagacuuauugaccgcacuaacgccaauuuucugguguggccgccgugcguggagguccagagauguucuggauguuguaauaauagaaaugugcaaugcaggccgacccagguccaauugagaccgguacagguacggaaaauagagauaguuaggaagaaaccuauauuuaaaaaggccaccgucacgcucgaagaccacuag

SEQ ID NO: 5349 - RNA, 411 nt, Artificial Sequence
  Description of Artificial Sequence: Synthetic coding sequence
augauacucaauuggaaacuccuaggcauuuuggugcugugucuucacaccagagggauuucuggaucugaaggacaccccagucaccccccagcggaagauagagaggaagcgggaucuccgacuuugccucaaggcccaccgguuccaggagaccccuggccuggcgccccucccuuauuugaagacccuccucccacucgccccaguagaccuuggagagaccuuccugagaccggcguguggcugccugaaccuccacgaacugauccaccacaaccuccccgaccagaugaccccuggcccgccgggccucagcccccagagaauccauggccaccugcaccagaaguggauaauaggccccaggaggagccggauuuggaccccccuagagaggaguacagauag

SEQ ID NO: 5350 - RNA, 417 nt, Artificial Sequence
  Description of Artificial Sequence: Synthetic coding sequence
augacggcucuguuccuuaugagcaugcuauucggacugacuugcggacaggccaugaguuuuugcauuccuacagaguacacuaugcacauagaacgaagagaaugcgcauauugccuaaccaucaauacgacuauuugcgccggauacuguaugacccgcgauaucaacgguaagcuuuuucucccaaaguaugcacuuucacaggaugucugcaccuaccgcgacuucauuuaucgcacagucgaaaucccuggaugcccucuucauguugcgccauauuuuagcuauccuguagcgcucagcugcaaaugcggaaaguguaacacugauuauucugacugcauacacgaagcaaucaaaacgaacuacugcaccaaaccacagaaaucuuaccucguuggauucuccgucuag

SEQ ID NO: 5351 - RNA, 417 nt, Artificial Sequence
  Description of Artificial Sequence: Synthetic coding sequence
augaccgcccuguucuugaugucuauguuauuuggucuaacaugcggccaagcaaugucguuuugcaucccuacugaguauacuaugcauauugagcgccgcgaaugugcguauugucugacuauaaauaccaccaucugcgcuggauacuguaugacuagagauaucaacggaaaacucuuccugccgaaguacgcccugucucaagacgugugcacuuacagagauuuuauuuaccgcacagucgagaucccaggauguccacuucauguugcccccuauuucucuuauccaguugcccuguccuguaaaugcgguaaauguaacaccgauuacuccgauugcauucacgaagccauuaagacgaauuauugcacuaaaccccaaaaaucauaucuggugggcuucuccguguag

SEQ ID NO: 5352 - RNA, 1281 nt, Artificial Sequence
  Description of Artificial Sequence: Synthetic coding sequence
augaguggcggaguguaugggggggaugaagucggagcucucguguuugauauuggcucuuucuccguaagggcaggcuaugcaggcgaggauugucccaaggccgauuuuccaacuacaguaggguuacuggcugcagaggaggggggaggucuugaacuggagggugauaaagaaaagaaagguaaaauuuuucacauugauacgaaugcacuccacgucccacgcgauggugcugaggugauguccccgcugaagaacgggaugauugaagacugggaaugcuuccgugcgauccuugaccauacauauaguaaacauguaaaaucagagcccaaccuucaccccguccugaugucagaggcuccuuggaacacccgcgcaaagagagaaaagcucaccgaacuaauguuugaacaauauaauauuccugcauucuuccuauguaagacagccgucuuaacagccuucgcaaacggccgcuccaccggccuuguguuagauuccggcgccacacauacuaccgcgauuccaguccacgacggauauguucuacagcagggaauugucaaaaguccuuuggccggcgauuuuaucaguaugcagugcagagaacucuuucaagagauggccauugauaucaucccaccauacaugaucgcugccaaggagccagugagagagggggcacccccuaauuggaagaaaaaggaaaaacuaccgcaaguaagcaagagcuggcacaauuacauguguaaugaaguuauccaggacuuucaggcaagcguguugcaagucucagacagcccuuaugaugagcaaguagcggcucaaaugccaaccguucacuaugaaaugcccaacggauacaacaccgacuauggggcagaacgccucaggauuccugaaggucucuuugacccaucaaauguuaaaggauugagugggaauacaauguugggagugggucacgucgucacuacuucaaucggcaugugugauaucgacauuagacccggacuguaugggucagugaucguaaccgggggcaauacacuucuccaaggguuuacugaccguuuaaauagggaacuaucucagaagacuccgccaucaaugagguuaaagcucaucgccucuaauucuacaauggaaagaaaguucagccccuggaucggcggcaguauauuggccucucugggaaccuuucaacaaauguggauuaguaaacaggaguacgaagaaggaggaaagcaguguguugagcguaagugcccauag

SEQ ID NO: 5353 - RNA, 3939 nt, Artificial Sequence
  Description of Artificial Sequence: Synthetic coding sequence
auggggccucguuugucugugugguugcuguuacugccugcugcccugcugcuacaugaagaacauucuagagccgcugccaagggcgguugcgccggaucaggcuguggcaaaugugacugucauggagucaagggacagaagggugagagaggacugccaggccuccaaggcguaaucggauucccagggaugcaaggacccgagggcccccaagguccucccgggcagaagggagauaccggcgaacccggacuuccuggaaccaagggcacacgcggucccccaggcgccuccgguuaucccggcaacccuggacugccgggcaucccugggcaagacggcccaccggguccuccuggaauucccggcuguaacggcacuaagggagaacggggacccuuaggcccaccaggacugccuggguuugcugguaauccuggagauccaggagaaauucugggccacguaccuggaaugcuguuaaaaggggagagaggcuuucccggaaucccuggaacaccaggaccgcccggcuugccaggucuccaaggccccguggguccacccggcuucaccggaccccccguuagcuucggcggauguuugagugaguuugggcauggcgggaucucauuuccacugacgaaaaggcggcagggcgaucagggcguuagcgggccaccuggagugcccggccaggcucaggugcaagagaagggagauuuugcaacaaaaggggagaaagggcagaaaggugagccaggguuucaaggaaugcccggggugggcgaaaaaggagagccaggcaaaccaggaccacgcgguaaacccggcaaagacggugacaagggcgagaagggaucccccggguuuccaggcgagccgggcuacccagggcuuaucggcaggcaaggaccccaagugaaugcaggcacuauugcauauccauuaccaccaugcccaguuaucgggacaggucccuuaggcgagaaaggugagcggggauauccuggaaccccuggcccuagaggugagcccggaccaaaggguaguuuccuggcuuucuuuccaccaccucccacaccaccaccuuucgcuggucuuccagugccuggacaggcuggagcaccuggauuuccuggcgagagaggggaaaaaggugaucgcggcuucccuggaacgagccuuccggggccuucagggcgggacggcuuaccaggaccucccgguucuccgggccccccaggacaaccaggguacaccaauggaauuguggaaugucagccgggcccacccggagaucaaggccccccaggaauucccggccagccaggauucauuggggaaauuggggagaaaggacagaaaggagagagcugccugauuugugacauugauggcuauagggguccaccuggaccucaggggcccccaggcgagaucggauucccuggucagcccggagcaaagggguuaccggguauaacggggcagagugguuugccuggguuacccggacagcagggcgccccaggaaucccuggcuuucccgggaguaagggcgagaugggcgucaugggcacgccaggccaaccuggaucaccaggcccuguaggagcgccggggcuucccggugaaaaaggagaucaugguuuuccaggaucaucgggaccucgaggagauccuggacugaaaggcgacaagggagacgugggacuccccgguaaaccagggucuauggacaaggucgacaugggcaguaugaaaggccagaagggcgaucaaggagagaagggccaaaucggccccauuggcgaaaagggaucacguggagauccuggaacgcccggagugccaggaaaggauggacaggcuggccaaccgggucaaccuggacccaaaggagauccggguauuucagguacaccaggcgcgccaggccuuccagguccaaaaggcuccgucggaggcaugggucugcccggcaccccaggcgagaaaggggugcccgguaucccagguccccagggcagcccaggauugccaggugauaagggagcgaagggggaaaagggccaggcgggaccaccaggaaucggcauuccaggauugcgaggagagaagggggaucaaggcauagcuggguuuccaggcucaccuggugagaaaggcgagaaaggaucaauugguauuccagggaugccaggaaguccaggucugaaggguucuccuggcagcguggguuacccaggaucgccgggacugcccggggagaaaggcgacaaaggacuuccaggauuggacgguaucccaggagucaagggugaggccggccuuccgggcacuccugggccgacagggccugcuggccaaaagggcgaaccaggaagcgacggcaucccgggauccgcaggagaaaagggagagcccggccucccugggcggggauuuccaggcuucccgggugcgaaaggagacaagggcagcaaaggcgaaguggguuuuccgggauuggcagggucucccgguauccccggcucuaaaggcgaacagggcuucaugggccccccagguccccagggccagccaggccugccaggguccccaggacaugcgacagaggggccaaagggugaucgcggaccccagggucagccaggucugccaggucugccuggaccgauggguccaccuggccugcccggcauagacggcgugaagggagacaaaggaaauccggguuggccgggcgcaccaggcgugccagguccuaagggagaccccggauuucagggcaugccagggaucggcggaagcccgggcauuacaggcucgaaaggagacaugggacccccaggcguuccuggauuucagggcccgaaaggucuaccuggccugcagggcauuaagggcgaucagggagaucagggcgugccuggggcuaaagggcuaccuggccccccaggacccccgggaccauacgauauuauaaaaggggaacccggacuuccugggccugaagggccacccggguugaaaggguugcaaggguuacccgguccuaaaggccaacagggcgugacaggccuagugggaauccccgguccacccggcauuccaggguuugauggggcccccggccaaaagggagagaugggaccugccggcccaaccggaccccguggcuuuccggggccucccggcccagacggucugccuggaucuauggggccucccggcacccccagcgucgaucaugguuuucucguaacccggcacucucagacgauagacgauccucagugcccuucugggacaaagauauuguaccauggcuauagccugcuguacguccaagggaaugaacgcgcccacggccaggaucucggcaccgccggcucaugucuccgaaaguuuucgacgaugcccuuucuauuuugcaauauaaacaauguguguaacuucgcuucacgcaaugauuacuccuauuggcugucaacuccugaacccaugccuaugucgauggccccaauuacuggcgaaaacauuagaccuuuuauuucucggugugccguuugugaggccccagcaauggugauggccguucacucacagaccauccagaucccuccaugccccucuggcugguccagccuuuggaucggauacucguucgucaugcauaccagcgcuggagccgaaggaagcgggcaggcccuggcuuccccuggauccugccucgaggaguucagaagcgccccuuucauugaaugccacggccggggaaccugcaauuacuacgcgaacgcauacaguuuuuggcuggcuacaaucgaaagauccgaaauguuuaaaaaaccuacgccaucaaccuuaaaggccggagaauugcguacccauguaucucgcugucaagucuguaugcgccgcacuuag

SEQ ID NO: 5354 - RNA, 5010 nt, Artificial Sequence
  Description of Artificial Sequence: Synthetic coding sequence
augggaccccggcugaguguguggcuucugcuguugccugccgccuuacucuugcaugaagagcacucacgagcagcagcaaagggcgggugcgcugguagcgggugcgguaagugugauugucacggugugaaggggcagaaaggcgagcgaggccugcccggacugcagggcgugaucggauucccugggaugcaaggaccagaaggcccacaaggaccuccugggcaaaaaggugacacaggcgaacccggccuccccggaacuaagggaacaagagguccccccggcgcgucaggguacccuggaaacccaggccugccuggcaucccaggacaagacggaccuccuggaccaccaggaaucccaggauguaaugguaccaagggagagcgaggcccacuuggaccaccuggacuucccggcuucgcuggaaacccuggucccccagggcugccaggaaugaagggcgacccgggcgagauucuagggcaugugccugggaugcuccugaaaggugagagagguuuccccggaauuccaggaacacccgguccgcccggccugccaggacugcaggggcccgugggaccuccuggguuuacuggcccccccggcccacccgggccgccugggccuccaggagagaaaggccagaugggucuuagcuuccagggcccgaaaggugacaagggagaucaggguguuagcggaccaccagggguacccggccaggcgcagguacaggagaagggggauuuugccacaaaaggggaaaagggucaaaagggggaacccggauuucaggggaugccaggaguuggggagaaaggugagccggguaaaccgggaccccgcgggaagcccggaaaggacggugacaagggcgagaaggguuccccuggcuucccuggugaacccggauauccuggccuaaucggaagacagggcccacaaggugagaagggcgaggccggcccacccggcccucccgggauagucauugguaccggcccucugggggagaaaggagagcgagguuacccaggcaccccaggcccccguggcgaaccugggcccaaaggauucccuggcuuaccuggccagccaggcccuccaggacugcccgugcccggccaagccggcgcucccggguucccaggcgaacgaggugagaaaggcgacagaggguuucccgguaccucacucccuggaccuagcgggcgggacggcuugccuggaccccccgggagccccggaccuccugggcaaccuggcuauaccaauggcaucgucgagugccaaccagguccacccggggaccaaggcccaccagggauuccagggcaaccaggcuuuauuggugaaaucggcgaaaaaggucagaagggugaguccugucugauuugcgacauugauggcuauagaggaccacccgggccccagggcccacccggcgagauuggauucccagggcagccaggagcuaaaggagaccguggguuacccggacgcgacggugucgccggcguaccagggccacaaggaacccccgggcuuauaggccagccgggagccaagggcgaaccuggcgaauuuuacuucgaccuucgacucaagggcgauaaaggagaucccggauuucccggucagccaggaaugacugggagagcaggaaguccaggccgcgauggacauccuggucugccaggaccgaaaggaagcccuggaucagugggcuugaaaggagagagaggacccccaggaggagugggcuuccccggaucaagaggggauacaggaccaccggguccacccggcuaugguccagcaggaccgauuggagacaaggggcaagcgggauuucccggagguccuggauccccaggccugcccggaccaaagggcgagccuggaaaaauagugccacucccugggcccccaggugcagagggccuccccgguucaccaggcuuccccggaccccagggcgauaggggcuuuccuggcacaccaggaagaccgggucuccccggagaaaaaggagccgugggccagccaggcaucgguuuccccggcccucccggcccaaagggcguggauggcuugcccggcgacaugggcccacccggcacaccggguaggccgggcuuuaaugguuuacccggcaacccaggcgugcaaggucagaaaggagagcccgggguaggccugcccggauugaaaggccuuccaggccucccgggcauuccagguaccccaggagagaaagguagcauuggaguuccaggcguucccggagagcauggugcaauagguccacccggauugcagggaauucgcggugagccagggccuccuggccuuccagguucagugggcucgccaggaguuccggggauugggccacccggagcacgcgguccaccaggagggcagggccccccuggacuuagcgguccuccugggauuaaaggggagaagggguucccaggcuuuccuggacuugacaugcccgggcccaagggcgacaaaggcgcucagggacuccccggcauuacaggccaguccgggcuucccggcuuacccggccagcagggggcccccgggauaccaggcuucccagguucuaaaggagaaauggggguaaugggaacucccggccaaccuggcucuccaggucccguaggagccccaggcuugccaggagagaaaggggaccacggcuuuccuggcagcagcggcccccgcggugacccuggauuaaagggcgacaaaggagacgucggacugcccggcaaaccuggauccauggauaaagucgauaugggaucaaugaagggacagaaaggcgaccaaggagagaaaggucagaucgggcccauaggugaaaaggguucgcguggggaucccggcacaccugguguucccgggaaggacggucaagcgggacagccaggccaacccgggcccaaaggcgauccuggcaucucaggcacccccggagcaccugggcuacccggaccuaagggcuccguggguggaaugggccugccuggcacaccaggcgaaaagggggugccugggauccccggcccucagggaagccccggccucccgggugauaaaggagcaaaaggagaaaaagggcaggcaggcccccccggcaucggcauucccggacuacgcggugagaaaggagaucaggggauugccggauucccgggcagucccggcgaaaaaggcgagaaggguucaauuggcauuccagggaugccagggucgccagguuuaaaaggcucccccggcucaguaggcuauccuggcagccccggccucccuggagaaaagggugacaagggccucccgggacuggaugguauacccggcguuaagggcgaagcaggcuuaccaggcacccccgguccuaccgggcccgcuggacaaaaaggcgaaccuggcagugacggaaucccuggauccgcaggagaaaagggagagccaggacuaccugguagaggauuuccuggauucccgggcgcuaagggugacaagggcagcaagggagaaguaggcuuccccggccuagccgggucccccgggauuccaggcucuaagggcgagcagggcuuuaugggcccaccagguccucagggucagccgggccucccgggcaguccaggacaugcaaccgagggaccuaagggggauaggggaccacagggacagccgggauugccaggacugccuggcccuaugggacccccaggguuacccgguaucgauggcguuaagggcgacaaaggaaacccagguuggccaggagccccgggagugccaggcccuaagggagacccaggcuuccaaggaaugccuggaaucggaggauccccaggcaucacugguuccaagggagacaugggcccacccggcguuccgggcuuucagggaccaaagggccucccgggacuacaggguauuaaaggcgaccagggcgaucagggagugccaggagcuaaaggacucccaggcccaccgggcccgccgggaccuuacgauauaauuaaaggugagccugguuugccuggaccagaagggccucccggucugaaggggcugcaaggacugccagguccaaagggccagcagggggugacuggacuaguugguaucccuggaccaccaggaauuccuggguuugacggcgcuccaggccagaagggagagaugggaccagccggcccaacuggaccuagaggauuuccugguccacccgguccugauggacucccuggaaguaugggccccccuggcacgccuuccgucgaccacgguuuucuggugacacgucauucccaaaccauugaugacccgcaaugcccuucagggaccaagauacucuaccacggcuacagucugcuuuaugugcaagggaacgaaagggcucacggacaggaucucggcaccgccggcagcugucuacgcaaguucucuaccaugccuuuucuauuuuguaacaucaacaauguuuguaacuucgccagccgcaacgauuauagcuacugguugucgaccccugagccuaugccaaugucuauggccccuauuacaggcgaaaauaucagacccuuuaucuccagaugcgccgucugcgaagcuccagcaaugguaauggcagugcauucucagacuauucagauacccccuuguccaucugguuggaguagucucuggaucggauacucuuuuguuaugcauaccagugcaggcgcagaaggcucgggacaagcccuggcuucaccaggauccugucuagaagaguuccguuccgcgcccuucaucgagugucaugguagagguacauguaacuauuaugcuaacgccuacaguuucuggcuggcgacuauugaacgcucugaaauguuuaaaaaacccacaccuagcacacugaaggcaggugaauugcgaacucacguuucucgcugucagguaugcaugagacgaacauag

SEQ ID NO: 5355 - RNA, 3957 nt, Artificial Sequence
  Description of Artificial Sequence: Synthetic coding sequence
augggaccacgguuaucuguauggcuccuuuugcugccagccgcucuauuacugcacgaagagcauucuagagcagccgcaaaaggcgguugugccgguucaggaugcggaaaaugcgauugucacggagucaagggccagaaaggagaaagagggcucccaggccuucaaggaguaauugguuuccccgggaugcagggcccugaggggccccagggucccccagggcagaaaggagauaccggcgagcccgggcuaccugggaccaaagggacacgcggaccucccggagcaagcggcuacccaggaaaccccggccucccuggcauacccggccaggacggaccuccuggccccccuggcauuccaggaugcaauggcacaaaaggggagcgagggccucucggaccaccaggacuaccgggguucgcgggcaacccaggcccuccugggcugccaggaaugaaaggcgaucccggugagauuuugggccacgucccaggcaugcugcugaaaggugaacgggguuuuccuggaaucccagguacucccggccccccaggacugccaggacuccagggcccugugggccccccaggcuuuaccgguccccccggaccuccagggccaccaggaccaccuggagaaaagggacagaugggacuuagcuuccaggggccaaaaggggacaaaggcgaucagggcguguccggcccccccggagugccgggucaagcccagguucaggagaagggggacuucgcaaccaaaggugagaaagggcagaagggugagccaggguuucagggaaugccagguguaggagaaaagggcgagccggggaaaccaggaccucgaggcaaacccgggaaagacggcgacaagggagaaaagggcagcccuggcuucccuggggaaccuggguaucccggguuaauaggaagacagggaccucagggagaaaagggcgaggcuggcccccccggaccaccaggaauuguaaucggaaccgguccgcuaggggagaaaggagagcgcggauacccaggcacuccaggaccaagaggcgaaccugguccaaaaggcuuuccaggccuccccggucagccggggccucccggccuucccgucccagggcaagcaggcgcgccuggcuuccccggagaacgaggugagaaaggagaucgaggguucccuggcacauccuuaccuggaccaucagggcgugaugggcuuccggggcccccagggucaccagggccuccaggccaaccuggguauacaaacgggauugucgaaugucagccuggaccuccgggcgaccagggcccccccggaaucccuggacagccaggcuuuaucggcgagauaggagaaaagggucagaagggagagagcugcuugaucugugacauugacggauacagagguccaccuggcccgcagggcccccccggcgagaucggauuuccugggcagccuggugcuaaaggcuugccagguauuacuggucagucuggccugccaggucugccugggcaacagggagcgccugggauaccaggauucccagggucuaagggggagauggguguuaugggcacccccggucagccagggucuccggguccugucggcgcaccaggucuccccggcgagaagggagaucauggguuuccuggauccagcggcccacgcggagaucccgguuuaaagggggauaagggagacgucgggcuuccaggaaagcccgguucuauggauaagguugauauggguucuaugaaaggacaaaaaggagaucagggcgaaaaggggcaaauuggcccgaucggcgagaaagguucuaggggcgaccccgggacuccggggguucccggcaaagauggacaggcuggacaacccggacaacccggaccuaagggggacccugggaucucaggaacaccgggcgccccuggacuaccgggacccaaaggaucagugggcggaauggguuugccagguacuccuggggaaaaaggugugccaggaauuccugguccacaggggucccccggacugccaggagacaaaggagcuaaaggggaaaagggacaggcaggccccccagggauagguauacccggcuugagaggagaaaaaggugaucaggggauugccggauuuccggggagcccaggcgaaaaaggagagaaagguagcaucggcaucccgggaaugccuggaagccccggucugaaaggcucuccuggcaguguaggauauccuggaucuccagggcugccuggugagaaaggcgacaaaggacuucccggacuagauggcauucccggagugaagggagaagcugggcuucccggcacuccgggcccgaccgguccugcaggacagaaaggcgagcccgggucagacgguauccccggcucugcgggagagaagggcgaaccugggcucccagggagaggcuuucccggauucccaggggcgaagggcgacaaagggagcaaaggagagguggguuucccugggcuggcaggaucucccggcauaccaggcuccaaaggagagcaaggcuucaugggcccuccugggccacagggacagccgggacugccaggcucuccaggacacgccacggagggaccuaagggagauagagggccacagggacagccuggucugccuggauugcccggaccaaugggaccuccugggcugcccgguauugacggagucaaaggcgacaagggaaacccagguuggccgggggcacccggagugcccggccccaaaggcgauccaggauuccaaggcaugcccggcauuggcgggucacccggcaucacaggcagcaagggggacaugggaccaccaggcgugcccggguuucaggggccuaagggccugccagggcugcaagguaucaagggugaucagggugaccaaggcguucccggggccaaaggacugccaggaccucccggacccccaggaccuuacgauauuauuaaaggugagcccggacuuccuggaccugaaggaccccccggacucaagggacuacagggucuuccuggcccaaaaggccagcaaggcgugacaggguugguagggaucccuggcccacccggcaucccaggcuucgauggugcuccgggccagaagggagagaugggaccagccggcccaaccgguccgcgcggcuuuccaggaccacccgguccugacggauugccaggaucuaugggcccgcccggcacuccuucgguggaccacggcuuucuaguuacacgacauucucaaacaaucgaugacccucaguguccuuccgggacaaagauccuauaccauggcuauuccuugcuguacguucaagggaacgaacgcgcacauggucaggaucuggguaccgcgggaucuugccucaggaaauuuuccacuaugcccuuccuuuucuguaacaucaauaaugucugcaacuucgccucccguaacgauuacucauacuggcuuuccacccccgaaccgaugccaauguccauggcgccuauuaccggcgaaaauauuagacccuucauauccaggugcgcugucugcgaagccccagcuauggugauggcuguccacucccaaaccauccagaucccacccugccccuccggauggucaucucuuuggaucgguuauucauuugucaugcauacaucagcaggagcugaaggcuccggucaggcccuggcgucuccgggcucuugucuggaagaauuucgguccgcccccuucauugagugccacgggagagggacauguaacuacuaugccaacgccuacaguuuuuggcucgcaaccauugagagaagugaaauguuuaagaaaccuacacccucuacccuaaaagcuggggagcugagaacccacgugaguagaugucaagugugcaugaggagaacauag

SEQ ID NO: 5356 - RNA, 1560 nt, Artificial Sequence
  Description of Artificial Sequence: Synthetic coding sequence
auggggccaaggcugucaguguggcuucuccuccuacccgccgcacugcuacuacacgaggagcacucucgcgccgcugcaaaaggaggcugugcuggaucuggcugcggaaagugcgacugccauggaguuaagggacagaaaggagaacgggggcuuccuggccuacagggcgugauuggcuuuccuggcaugcaggggccagaaggaccacagggaccacccggacagaaaggggauacaggggagccaggucuacccgggacaaaggggacaagagggccuccaggggccuccgguuauccugguaacccgggccucccaggaauccccggacaggauggaccuccaggaccacccggaauuccuggauguaauggcacaaagggagaacgcggcccacuaggcccgccaggucuuccaggauuugcaggaaaccccggacccccugggcuucccgggaugaagggcgacccuggagagauucuggggcauguaccaggcaugcuucucaagggugagaggggcuuucccggaauucccggaacucccggccccccuggucucccaggucugcagggccccgucggaccuccgggguucacagggcccccaggacccccuggcccuccaggaccuccaggggagaaagggcaaaugggcuuguccuuccagggcccuaaaggcgacaagggagaccagggcguaagugguccuccuggcguuccaggacaggcgcaaguccaggagaaaggggauuuugcgacaaagggggagaagggacagaaaggagagcccggauuucaaggcaugcccggggucggagaaaagggggagcccgguaagccagggccccgagguaaaccagguaaagacggggauaagggagagaaaggauccccaggauuuccaggcgaaccuggcuaucccggccugauuggacgccaaggaccgcagggagagaaaggugaggcuggcccccccgguccaccaggaaucguuauuggcacugggccuuugggagaaaaaggugagcggggcuaccccgggaccccuggccccaggggggaaccugguccaaaagguuucccagguuuacccgggcagccaggccccccgggucugccaguacccggucaagcaggcgcaccuggcuucccaggcgaaagaggcgaaaagggcgacagaggcuuuccaggcacaucuuugccugggccaagcgguagagacgggcuucccggacccccaggaucccccggcccacccggccagccagguuacacaaacgggauaguagagugucagcccggcccacccggagaucaaggccccccuggcauucccgggcagccaggcuuuaucggagaaaucggcgaaaaaggccagaagggcgaaucaugucuaauuugugacauugauggguacaggggcccuccaggaccacaagguccgcccggcgaaauuggguucccuggucagcccggcgcuaaaggugauagagggcucccagguagagauggcgucgcaggggucccauuauuguuucagauacacaaauag

SEQ ID NO: 5357 - RNA, 252 nt, Artificial Sequence; identical to SEQ ID NO: 5242
  Description of Artificial Sequence: Synthetic coding sequence

SEQ ID NO: 5358 - RNA, 2070 nt, Artificial Sequence
  Description of Artificial Sequence: Synthetic coding sequence
auggcagcugcaacggccaguccacgcucucuccuuguucugcugcaggugguuguccuagcucuagcccaaauccgaggaccccccggugaaagaggacccccaggaccccccgguccgcccggugugccuggcagugaugguauagacggcgacaacgggccgccaggcaaggccggcccucccggacccaaaggagagcccgguaaggccggaccugacggccccgacgguaagccgggaauagacggguuaaccggcgcuaaaggcgaacccgguccaauggguauacccggcguuaaagggcagcccggucugccaggucccccaggccugccgggcccaggguuugcuggacccccaggcccuccuggaccuguugggcuuccaggcgagauuggcauuagggguccuaagggugaucccggcccagauggccccuccggaccaccuggcccuccuggaaaacccggucggccgggcacuauacaggguuuagaaggcucagcggauuuccugugcccuacuaacugcccuccggggaugaaagggccuccaggacuccagggagucaaaggacaugcagggaaaagaggcaucuuaggagacccaggccaucagggcaaacccggaccuaagggagauguuggcgcaaguggcgagcaggggauacccgguccucccggcccucaaggaauuaggggauauccaggcauggccggcccuaaaggagagacuggaccucauggcuauaagggcauggugggggccaucggugcaaccgguccuccaggagaagaaggacccaggggcccaccggggagggcuggagaaaaaggagacgagggcagucccgguauaagaggcccccaggguauuacuggcccuaaaggagccaccgggccaccgggcaucaacggcaaagacgggaccccaggcacacccgggaugaaggguuccgcaggccaggcagggcagccgggcucacccggacaccaggggcucgcaggcguucccggacaacccggcaccaaaggugguccaggugaccagggugaaccaggcccccaaggacuuccgggcuucagcgguccaccaggaaaagagggugaacccggcccccggggagaaauagguccgcagggcauuaugggacaaaaaggcgaucaaggcgagcgcgguccggugggacagccuggaccucagggucggcaaggccccaaaggagagcagggaccuccggggauaccaggaccacagggccugccgggcgucaaaggggauaagggcucgccuggaaaaaccgggccuagagggaaggugggugauccuggugucgcaggcuuaccaggagagaagggggagaaaggggaaucgggugaaccuggcccuaagggucagcagggagugcgcggagaaccaggguauccuggucccagcggcgacgcaggagccccgggcgugcaggguuauccuggacccccuggaccaagaggucuggcgggaaacagaggagucccgggucagcccggcagacaggguguugaaggcagggacgcaacugaucagcauaucguagauguagcucuuaaaaugcuccaggaacagcuugccgaaguggcugugagugcgaagcgagaagcgcugggugcugucggaaugaugggcccaccugggccuccaggaccucccggcuaucccgguaaacaggggccacauggccaucccgggccaagaggagucccagguaucguaggagcggugggccagaucgguaauacagguccaaagggcaaaaggggugaaaaaggggacccaggcgaagugggucgaggacauccaggcaugccugguccucccggcauccccggguugccuggucggccugggcaggccaucaacgggaaagauggagaucgcggcucuccaggcgccccaggcgaagcgggcaggcccggccuccccggccccgucgguuuaccaggguuuugcgaaccugcagcuugccucggcgcguccgcguacgccucagcaagacugacugaaccuggaucaaucaagggaccguag

SEQ ID NO: 5359 - RNA, 2055 nt, Artificial Sequence
  Description of Artificial Sequence: Synthetic coding sequence
auggccggaccacgugcaugcgcuccacugcugcuguuguuauuacugggcgagcuucuggcggcggcgggcgcacagagaguuggcuuaccaggcccccccgggccucccggcccuccgggcaaacccggacaagauggcauagacggugaagccggcccacccgggcucccggggccuccaggaccaaagggugcuccaggcaaacccggaaagcccggcgaggcuggauugccugggcuuccuggugucgauggacuuacugggagagacggaccaccuggaccuaaaggagcccccggcgagcgcggcagucucgggcccccuggcccuccuggccucggcggaaagggacugccagguccccccggcgaagcuggaguuagcggcccccccggugguauuggacuuagagggcccccaggccccucuggccugccaggccugcccggucccccggggccuccugguccacccggucauccuggcgugcucccagaaggugcuaccgaccugcaguguccaagcaucuguccuccuggaccaccuggcccacccggcaugccaggcuucaaaggacccacgggcuacaagggagagcagggagaaguaggcaaagauggugaaaaaggagaccccggaccccccggacccgcgggcuuaccagggucuguugggcuucaggguccccggggacugagaggguugccuggcccauuaggaccuccuggagaucggggaccuaucgguuucagagggccuccuggaauaccuggagcuccaggcaaagcgggugaucguggagagaggggacccgagggauuuagggguccaaaaggagauuuaggacggccaggcccgaagggcacuccgggagucgcugggccuagcggcgaaccggguaugccagguaaggaugggcagaauggggucccugggcucgauggacagaaaggagaggcuggaaggaauggagcccccggcgagaaaggacccaaugggcugccuggccugccaggcagggcagggagcaaaggugaaaagggggagagggggagagcaggagagcugggggaagcuggcccgaguggagagccaggaguuccgggcgaugcugggaugccuggggagcggggggaggcagggcaccggggauccgcuggggcacuaggaccgcagggcccuccaggcgcuccaggcgugcgaggauuccagggccaaaaaggcaguaugggagaccccggacugcccgggccccagggcuuaaggggggaugugggagacaggggaccuggaggggcugcuggaccaaaaggcgaccagggaauugccggcagugacggucuucccggcgacaagggggaguugggaccaucuggccucguggggccuaaaggagaaucaggaagcagaggggagcucggaccaaagggaacacagggaccuaacgggacaagcggcguucagggcguuccugggccacccgggccccuuggacugcaggggguucccgggguacccgguauuacuggaaagccaggcguuccuggcaaagaggcuagugaacagagaauccgagaacugugcggugggaugaucuccgagcagauagcacagcucgccgcacaucugagaaagccacuggcucccggaucaauuggacgcccgggaccugcugguccaccaggcccccccgguccucccggcaguaucggccauccaggcgcacgcggaccacccgguuauaggggccccaccggggaacuaggugacccaggcccuagggguaaccaaggcgauagaggcgauaagggcgcugcuggugcuggucuagacggacccgagggggaccaaggaccacaaggcccucaaggcguaccagggacaaguaaagacgggcaagacggggcgccaggcgaaccuggcccuccaggcgacccuggccuccccggcgcaaucggggcgcagggaaccccuggaaucugugacaccagugccugucagggagcagugcuaggcgguguaggagagaaaucugggagucggucauccuag

SEQ ID NO: 5360 - RNA, 576 nt, Artificial Sequence
  Description of Artificial Sequence: Synthetic coding sequence
augugguggaguagcacacaaaaugcuggaacugagggagaggcuggcccccccggacugccggggccaccaggucccaaaggcgccccaggaaaaccuggcaaaccaggugaggcgggauuaccuggucugcccggggucgacggccugacgggaagagacggaccucccggcccgaaaggagcccccggggagcggggaaguuuaggaccuccggguccccccggccugggcggaaaaggcuuaccaggaccucccggugaagcuggaguaucaggcccuccaggcgggauuggauugagaggcccuccgggucccuccggccugccuggacugccuggcccacccggaccgcccgggcccccaggucaucccggcguucugcccgagggggcuaccgaucugcaguguccauccauauguccuccuggcccuccuggaccacccggcaugcccgguuuuaaagggccaacuggauacaaaggggagcaaggagaaguuggcaaggacggagagaaaggcgacccuggcccaccagguccugcuggccugccgggaagcgucggucuucaguag

SEQ ID NO: 5361 - RNA, 576 nt, Artificial Sequence
  Description of Artificial Sequence: Synthetic coding sequence
augugguggucuagcacacagaaugcugggacugaaggagaagcuggucccccuggccuccccggcccccccgguccgaagggcgccccagguaaaccuggcaagccuggcgaggccggucuucccggcuuaccuggagucgauggcuuaaccggacgcgauggccccccgggucccaaaggggcucccggcgaacgaggaucucuugguccuccgggaccuccggguuugggagguaaaggucugcccggacccccaggcgaagcuggagugucaggucccccaggagggaucggucugcgaggaccaccaggucccucuggccuccccggucucccaggaccaccaggccccccagguccacccgggcacccugggguacugcccgaaggcgcaacugaccugcaaugccccagcauuugcccuccaggcccaccaggaccaccuggaaugccaggcuucaagggcccgacgggauauaagggcgaacaaggagagguuggcaaagauggcgaaaaaggagauccagguccaccaggcccugccggacugccagguucuguuggccugcaauag

SEQ ID NO: 5362 - RNA, 1128 nt, Artificial Sequence
  Description of Artificial Sequence: Synthetic coding sequence
auggggccuccuggcuugccuggacucaaaggagacucugggccuaaaggagagaagggucauccaggauugaucggacugauaggucccccgggggaacaaggagagaaaggggauaggggacuccccgguccacaagguagcagugggccuaaaggagaacaaggcauuacuggcccgagcggcccaauaggccccccuggaccucccggcuuacccgguccuccaggcccuaagggugcaaaagggucuagcggcccgaccggcccuaaaggggaagccggccauccuggcccgcccggaccuccaggccccccuggggaggugauacaaccccuucccauucaagccucccgcaccagaaggaauaucgaugcaucacaacuguuggaugauggcaacggcgaaaauuacguggacuaugccgaugggauggaagaaauuuuuggcagccucaacucccugaaacuagagauugagcaaaugaaacguccauuagggacccagcagaacccagcacgaacaugcaaggaccugcaacuuugucacccugauuuuccagauggcgaguauuggguggacccuaaucagggcuguucccgagacagcuucaagguuuacugcaauuucacagcuggcggaaguacauguguguucccugacaaaaaguccgaggguagcaagauggcccgcuggccuaaagagcagccaucuaccugguacagccaauauaaacgugguucgcuguugucuuauguagaugcagaagguaacccagucggaguugugcaaaugacuuuccuaagacugcuuucagcuuccgcccaucagaacguaacauaucauugcuaucagagcguggcguggcaagaugccgcuacaggaucauacgauaaggcccuucguuuccuugggucuaaugacgaagagaugagcuaugauaauaacccuuauauccgugcucuuguggaugggugcgcuaccaaaaaaggauaucagaaaaccguuuuagaaauugacaccccuaagguggaacaggugccaaucguggacaucauguuuaacgacuucggagaggccucccaaaaguuuggauucgagguggggccagcgugcuuuaugggauag

SEQ ID NO: 5363 - RNA, 5517 nt, Artificial Sequence
  Description of Artificial Sequence: Synthetic coding sequence
auggacgugcauacuagauggaaggccagguccgcacuaaggccuggggccccuuugcugccgccacuccugcuuuuacuccuuugggcucccccaccaaguagggcagcacagccagccgaccuacugaaaguccucgauuuccacaaccuacccgauggcaucaccaagacuacaggcuuuugugcuacgaggaggucuucaaagggaccugaugucgcauauagggugacuaaagaugcccaacucuccgcaccaacuaaacaacuguacccugcaucugccuuuccugaggacuuuuccaucuugaccacagugaaagcuaagaaaggcucccaggcauucuuggucucuauauauaaugaacagggcauucagcagaucggccuggagcucggacggaguccagucuuccucuaugaagaucauaccggcaagcccggaccugaagacuauccucucuuucgaggcaucaauuuauccgacggaaaauggcauagaaucgcacugagcgugcacaaaaagaacgugacacugauucuggacugcaagaagaaaacuacuaaauuccuggaccgaagugaccacccaaugaucgacaucaauggcauuauuguguucggaacacggauuuuggacgaagaaguuuuugagggggauauucaacaacugcuguuuguuuccgaucaccgggcggcauaugauuauugcgagcauuacagccccgacugugacaccgcgguucccgacacaccccaaucacaggaucccaauccagacgaguacuacacggaaggggacggcgagggagaaacuuauuacuacgaauacccuuauuacgaagacccggaagaucuaggcaaagaaccaaccccaucaaaaaaacccgucgaggcagcuaaagagaccacagaggucccagaggaacuuacaccuaccccuaccgaagccgcccccaugcccgaaaccagugagggugcugggaaagaagaggacguuggaaucggagauuacgacuauguccccagcgaagacuacuauacccccagcccuuacgacgaccucacuuacggagaaggagaagagaauccugaucaacccacagaccccggagcuggagccgaaauccccacuuccacagcugacacuucuaauucuaguaacccagcaccuccucccggagaaggggccgaugaccuugagggcgaauucacggaagagaccauccggaaccuugacgagaauuacuaugauccauacuaugacccaacuucaucaccuagcgagaucggcccagggaugccugcaaaccaggauacaauuuacgaagggaucgguggcccccgcggagaaaagggacagaaaggggagccugcuaucauugaaccaggaaugcuuauagagggcccgcccggaccugaaggaccugcaggucuccccggucccccaggcacaaugggucccacgggccagguaggagauccaggcgagagagggccgccuggucgaccuggucuuccuggagcugacggucugcccggccccccugguacaauguugaugcugccuuucagguucggcggaggaggagaugccggcaguaagggcccaaugguaucagcgcaggagagucaggcccaagcaauacugcagcaggcuagacucgcacuccgaggcccagcaggucccaugggauugacagggcgcccaggcccagugggucccccugguaguggaggauuaaagggcgaaccuggugauguggggccacaaggaccucggggugugcaaggccccccuggaccggcuggcaaacccgggagacgcgguagggcugggucagacggagcacgaggaaugccaggacagacaggacccaaaggcgaucgagguuucgacgggcucgcaggucugccaggggagaaagggcauagaggcgaucccggcccgagcggcccaccaggaccuccuggggacgauggcgagagaggugaugauggcgaagucgggccccggggacugccgggcgaaccaggaccuagaggucugcuuggacccaaaggcccuccugguccaccuggaccacccggggugacaggaauggacggccagccuggcccaaaagggaauguuggaccacagggggaaccagguccucccgggcaacaaggcaaccccggcgcucagggccugccagggccucagggcgcaauaggccccccuggagaaaaaggcccccuaggaaaaccuggccucccugguaugccaggcgccgacggccccccaggacaccccggaaaagaaggccccccaggugagaaagguggacaggggccucccgggccacagggaccaauaggcuaccccggaccaaggggcgugaagggagccgacggaauacgugguuuaaaaggcacuaaaggagagaagggcgaagauggauucccuggcuuuaagggcgauaugggcauuaaaggggacaggggggaaauaggaccgccuggaccuagaggcgaggauggacccgaggggccuaagggacgcgguggucccaacggagaucccggaccucucggcccuccuggcgagaaaggaaaacugggcgugccuggacuucccggauaccccggaagacagggaccuaaaggaucaaucggcuucccagguuuuccaggggcaaauggggagaagggcggacgcggcacucccggcaaaccagggccaagaggacaacgggggccuaccgggccucguggagaaagaggaccccgcggcauaacaggaaagccaggaccaaaagggaacagcggaggggauggccccgcuggaccucccggcgagcgcgguccgaacggcccucaggguccuaccgguuuucccggaccgaagggaccgccgggcccccccgguaaagacggacugccaggacacccaggacagcgaggugaaacaggcuuccaaggcaagaccgggccgccaggaccgcccggaguagucgggccacagggaccgacaggugagacagguccuaugggagagagggggcaccccgggccuccuggaccgccaggagagcagggauuacccgguuuggccggcaaggaaggcacaaaaggggacccugguccagcaggauugccugguaaagacggucccccuggcuuaagaggcuucccgggcgacaggggacugccgggccccguuggugcucugggacucaaggggaacgaggguccaccgggucccccuggaccggccggauccccaggcgagcgaggaccugcuggcgccgccggaccaauagggauucccggcagacccggaccacagggccccccuggaccugccggcgaaaagggcgcuccuggcgagaagggaccacaggggccugcaggaagggauggguugcaggggccggugggucugccuggcccagccgggcccguuggccccccaggcgaggacggagauaagggcgaaaucggagaacccggccaaaaaggcuccaagggagauaagggugagcaagguccgccugggccuaccgggccucaggggccaaucggacagccuggaccaucuggagcggauggcgaaccagggcccagggggcagcaagguuuguuuggacagaaaggagaugaaggcccacgcggauuuccuggaccuccgggucccguuggacugcagggcuugcccggcccucccggcgagaagggugagaccggggacgucggccaaaugggccccccuggcccucccggaccacgaggcccuuccggggcgccaggcgcugauggcccucaaggaccaccaggcgggauuggcaaccccggcgcaguuggggaaaagggagaaccuggcgaagcuggagaacccgggcuaccgggcgaggguggcccccccggucccaagggagaaagaggggagaagggagaaucugguccuaguggugccgcagguccccccgguccaaaaggcccgccuggcgacgacggaccaaaaggaucuccugguccugugggcuuucccggagauccaggcccacccggcgaacccggacccgccgggcaggauggccccccaggugauaaaggcgaugauggagaaccaggacaaaccgggucaccaggccccacuggcgaaccuggcccuucagggccucccggaaaacguggccccccuggcccagcagguccugaagggcggcaaggugaaaagggagccaagggcgaagcaggcuuggagggcccuccggguaaaacaggcccuauuggcccucagggugcgccuggaaagccuggcccugaugggcucagaggaauucccggucccguaggcgagcaggguuugccagggaguccuggacccgaugggccacccggaccaaugggaccuccaggacugcccggacugaagggcgauaguggaccaaagggugagaagggacaucccgggcugauuggccugaucggaccuccaggagagcagggugagaaaggcgaucguggcuugccggggccucaaggaucuuccggacccaaaggggagcaggguaucaccgguccaagcggaccuaucggaccucccggaccaccaggccuuccuggcccacccggaccaaagggugcuaaggggaguagcggaccuacaggccccaagggagaagcaggccaucccggcccaccuggcccuccaggcccuccuggcgagguaauccagccacucccaauucaagcuucgagaacacggcguaauauagacgccucccagcugcuggaugacggcaauggcgagaacuacguagacuaugcggauggcauggaagaaauauucggaucacuaaacucccugaaacuggagauagaacagaugaaacggccucucgguacucagcagaauccagcacgcacaugcaaagaccuccagcuuugccauccagauuucccagauggagaguacuggguugauccuaaccagggcugcucaagggacucuuuuaagguguacugcaauuucacugccggggguucaacuuguguguuucccgacaaaaaaagugaaggcgccagaauuacaagcuggccaaaggagaauccuggcuccugguuuuccgaguucaaaagagggaagcugcucucguacguagacgcagaaggcaauccgguuggcguuguucagaugaccuuccuucgacucuugucagccagcgcccaccagaaugucacuuaccacugcuaccagucuguugccuggcaggaugccgccaccgggaguuacgauaaagcccugcgguucuuagguucaaaugaugaagaaauguccuaugauaacaauccauacauaagagcgcucgucgacggcugugcaacaaaaaaagguuaccaaaaaaccguacuugagaucgacacaccaaagguugaacaaguaccaaucguggacauuauguuuaaugacuucggagaggcgucacagaaauuuggauuugaagucgggccagccuguuucaugggguag

SEQ ID NO: 5364 - RNA, 633 nt, Artificial Sequence
  Description of Artificial Sequence: Synthetic coding sequence
ugacgcaccagaaggaacauugaugcaagccaauuguuggaugauggcaauggggagaauuauguggacuaugccgaugguauggaggaaauuuucgggucccugaacagccugaaguuggagaucgagcaaaugaaacgcccgcugggaacucaacagaacccugcucguaccuguaaggaccuucaacucugucacccugauuuuccugacggcgaauauugggucgaccccaaucaagggugcucucgagauaguuucaagguguauugcaauuuuacagcaggggggucuacuuguguuuucccugacaagaaauccgaaggcagcaaaauggcacgauggccaaaagaacagccuagcaccugguacucucaguacaagcgcgggucucuucuuucuuauguggaugcugagggcaacccuguugggguaguccaaaugacuuucuugcggcuguugagugcuuccgcgcaccaaaaugugaccuaccauuguuaucaauccguugccuggcaggacgcagcuacugggagcuaugacaaggcgcuucgauuuuuagguagcaaugaugaggaaaugaguuaugauaauaaccccuacauuagagccuugguagacgguugugcuuag

SEQ ID NO: 5365 - RNA, 9534 nt, Artificial Sequence
  Description of Artificial Sequence: Synthetic coding sequence
augaggaaacacaggcaucucccacuggucgcugucuuuuguuuguuuuugucaggauucccaaccacgcacgcacagcagcagcaagcagacgugaaaaacggugcagcagccgacaucaucuuccugguugacuccuccuggaccauaggugaagaacacuuccagcucguccgcgaauuccuuuaugauguggucaagucccuggccguaggcgagaaugauuuccauuuugcucuugugcaguucaacggcaauccacauacagaauuuuugcugaauacuuaccguaccaaacaggagguucugucacauaucucaaacaugucuuauauugggggcacaaaucagacggggaaagggcuugaguauauuaugcagucacaccucaccaaggcggcaggcucucgcgccggcgacgguguuccucaaguuauugucguucugacagauggacacucuaaggacggucuggcucuucccagugcugaauugaaaucugcggacguuaauguauuugcuauaggcguggaagacgcugacgaaggagcauugaaggagauugcauccgagcccuugaacaugcauauguuuaaucucgagaacuuuacuucccugcacgacaucgucggcaauuugguauccugcguacacaguagugugagcccagagagagcuggugacacugagacuuuaaaagacauaacagcccaggacagcgcugacauuauuuuuuugauugacggguccaacaauacugguagcguuaacuuugcuguaauucuugauuuccucgugaaccugcucgagaaguuacccauuggaacacagcaaauucguguuggcguggugcaguuuucagaugaaccccggacuauguuuucucucgacaccuauucuacaaaagcccaaguucucggagcgguuaaggcacuaggauucgcagguggugaacuggccaacaucggguuagcucuugacuucgugguagagaaccauuuuaccagagcuggugggucccgcguugaggagggagugccccaagucuugguucugauuucugcgggcccaucaucugaugaaauacgauaugggguaguugcacucaagcaggccucugucuuuagcuuuggauugggcgcacaggccgcuucuagagcagaacuccagcacaucgcuacagaugacaauuuaguguucacaguccccgaguuccggucuuucggugaccugcaagagaaacugcugccauacaucgucggaguagcacagcgccacauaguucugaaacccccaacaaucgugacacaagugauagaaguaaacaaacgagacauuguguuucuaguggauggcucuuccgcccuaggauuggcuaacuuuaacgcaaucagagauuuuaucgccaagguaauccaacgcuuggaaaucggccaggaucuuauucagguugcuguggcucaauaugcggacacaguacgaccagaguuuuacuuuaacacccaccccacaaaaagagaggugauuaccgccgucaggaaaaugaaaccacucgacgggucugcacuguauacgggcuccgcacucgauuuugugcgcaacaaucuuuucacaucuucugccggauauagggccgccgagggaaucccaaaacuguuaguccugaucacuggagguaagucccuggacgaaauuucccaaccagcucaagaguuaaaaagaucuuccauuauggccuucgcgauaggaaauaaaggggcggaucaggccgaacucgaagagauugcguucgacuccucacuugucuucauuccagccgaauuccgugccgcaccucugcagggcaugcugccaggucuauuagccccacuccguacccuuagcgggacccccgagguucauaguaauaagagagacaucauauuucugcuagaugguucugcaaacgugggaaagacaaacuuccccuacguuagggacuucguaaugaauuuaguuaauucucucgacaucggcaacgacaacauaagaguuggauugguccaguucuccgacacaccaguuacggaauuuucauuaaacaccuaucagaccaaguccgacauacugggacaccuucgacagcuacaacugcagggcggguccggccucaacacuggcucugcccuaucuuacguauacgccaaccacuucaccgaggccggaggaagccgcauucgagaacacgugccgcaacugcuguuacugcuaaccgcuggccagagugaggauucuuaccugcaagcugcuaacgcccugacucgagcggguauccuaaccuucugugucggugccucucaggcaaauaaggccgagcucgaacagaucgcuuuuaauccuucucuuguguaucucauggacgacuuuuccaguuuacccgcccuuccacagcaacugauccagccccugacaaccuauguuucagggggcguggaagagguuccccucgcccaacccgagaguaagcgugauauucuuuuucuguucgacgggucagcuaaccuuguaggccaguuuccagucgugcgcgacuuucuguauaagauuaucgacgaauugaacguuaagccagaggguacgagaauagccguugcucaauauucugacgaugugaagguggaguccagauuugaugagcaucaaucaaaaccagaaauccugaaucuggucaaacguaugaagauuaaaacgggcaaggcccugaaucucggguacgcucucgauuacgcacagcguuauauauuugucaaaucugccgggucuaggaucgaggauggcguuuugcaguuccugguguuauuagucgcagggcgcuccuccgaucgagucgauggcccagcgagcaaucuuaagcagagcgguguggugcccuuuauauuucaagcaaagaacgccgacccggcugagcucgaacaaaucguuuuaagccccgcguucauuuuggcugcugagucccugccaaaaauuggagaccuucacccccaaauaguuaacuugcuaaaaucugugcauaacggcgccccugcaccagugagcggugaaaaagaugucgucuuucugcuagaugguagcgaaggaguaagauccggauuuccucugcugaaggaauuuguucagagggucgucgagucccuggauguaggccaggacaggguccgaguagccgucguucaauacagugaccgaacaaggccugaauuuuaucugaacucuuauaugaacaaacaggauguggugaacgcagugcggcaguuaacacuucugggcggucccacccccaacacaggagcagcuuuggaauuuguguuacggaauauacucgucucuucugccggauccagaauuacagagggggugccucaacuauuaauaguccuuaccgcugaccgcagcggcgacgauguuagaaauccuagcguuguggugaagcggggaggugcggugccgauaggaaucgggauaggaaacgcagacauuacagaaaugcagacaauauccuuuauaccagacuucgcuguagcaauaccaaccuuuagacaauugggcacuguucagcagguaaucucagaaagggugacccagcugacccgagaagaacuuucuagacuccaacccguacuacaaccccuuccauccccaggcgugggcggcaaacgagacguuguguuucuaaucgacggcucacagucugccggcccagaguuccaguacgugagaacccuuaucgagaggcucguggauuacuuggacgucggcuucgacacuacccgcguagcggugauccaauucucugacgacccaaaaguggaauuccuccugaacgcccacucuucaaaagacgaagugcagaacgccguucagcgcuuaagaccuaagggcgggcgacagauuaacgucgggaaugcccuggaauaugugagccggaauauauuuaagcgccccuugggcaguagaauugaggaaggcgugccucaauuucucgugcuuauuaguucaggaaaaucugacgacgagguugacgaucccgcaguagaauuaaaacaguuuggaguggcgccauuuaccaucgcuaggaacgcugaucaggaagaauuggugaaaaucucucucucucccgaguacguauucucuguaagcacuuuccgcgaacuucccucauuagagcagaaacuucugacgcccaucaccacgcucacauccgaacagauccaaaaauugcuggccucgacaagauacccuccccccgccguugaguccgaugccgccgauauaguguucuuaaucgauagcagcgagggagugcgucccgauggcuucgcccacauccgggauuucguuucaagaauuguucgucgccugaauaucggaccuaguaaagugagagucggaguugugcaauuuaguaaugacgucuuucccgaguucuaucucaagacguauagaucccaggcgccgguccucgacgccauccgacgacuucgccuccgcggcggcagcccucucaacacugguaaagcccucgaauuuguggcaaggaauuuauuuguuaagucagccgggucuaggauagaggacggcgugccucaacacuuggugcugguccuggguggaaagagccaggacgaugucucgagguuugcccaaguuauucgaaguuccgggauuguaagucuggggguuggagacagaaauaucgacagaacugaguugcagacuaucacaaacgauccuagacuggucuucacuguccgcgaauuuagagagcuuccgaacauugaggaacggauuaugaauuccuuuggaccuuccgcugccacuccugcucccccaggggucgauacuccaccuccaucacggcccgagaaaaagaaagcugacaucguguuccugcuggacggaucaauuaauuuccguagggauuccuuucaggaggugcugcgguucguaucagaaaucguugacacagucuacgaggacggcgacagcauccaggucgguuuaguucaguacaauucugauccuacugacgaauucuuucuaaaagauuuuucuacaaaacgucagaucaucgaugcgauuaacaaagugguauauaaagggggucgacaugccaauacaaaggucggacuggaacaucucagagucaaccauuucguuccagaagcugggucccgccucgaccagcgcgucccccagaucgcauuugucaucacuggagguaaaucuguagaagacgcacaggacguuucccuugcucugacucaaaggggggucaaaguuuuugcuguaggaguucgaaauauugacuccgaggaagucggcaaaaucgccucaaauucagccacagcuuuccgagugggaaacguacaagaauuaucagaguuaucagaacagguguuagagacuuugcacgacgccaugcaugaaaccuugugccccggagugacggaugccgcuaaggccugcaaccuagacgucauuuugggauuugaugguagcagagaucagaacguauucgucgcacagaaaggguucgaaucuaaaguggaugcuauucucaauagaaucucccagaugcaccggguuagcugcuccgguggacgcucaccgacagugcgcgucucagucguggccaauacgcccuccggaccagucgaggcuuucgacuuugaugaauaccagcccgagaugcuagaaaaauucaggaauaugagaagccaacaccccuacguacuaaccgaggauacauuaaaaguguaccuuaauaaguuuagacagagcuccccugauuccgucaaggucguuauacacuucacagacggcgccgacggcgaucuugcugaccuccacagagccucagaaaauuugagacaagaaggcgugagagcacucaucuuaguuggacuagagagagugguaaaccuggagcgucucaugcaccuagaauucggcaggggcuuuauguaugauaggccguuaaggcuuaacuuauuggaucuggacuacgaacuagcugagcaacucgacaacaucgccgagaaagcuugcugcggggugccuuguaaguguucggggcagagaggagaucgcgguccuaucggcaguaucgggcccaaaggaauucccggcgaggacggcuauagagguuauccuggagaugaagguggcccuggggagcgcggcccaccuggcgucaaugguacucagggcuuccaaggauguccaggacagaggggggugaagggaucacgagguuucccuggagagaaaggggaaguaggugaaaucggauuagauggccuggacggggaggacggcgacaagggauuaccaggguccagcggagaaaaagggaauccagggagaaggggugauaaagguccucguggcgagaagggagagagaggcgauguaggaaucagaggggaucccgguaacccugggcaggacagccaggagcggggcccgaagggagagaccggcgacuuagggccuaugggugucccagggagagacggcguaccaggcggucccggcgagacagggaagaacgguggcuucgggcgccggggaccaccuggggcuaaaggaaauaagggcggacccggccaaccuggcuuugaaggcgaacaagguacaagaggugcucaaggccccgcgggaccggcaggacccccgggccucaucggcgagcaagguaucagcgguccacgcggcagugggggugccgccggggcucccggagaacgcggccgcacagguccucuaggccggaaaggggaaccuggagaacccgggccaaaggguggaaucggaaaccgcggaccaagaggugagacuggagaugacgggagagacggugugggcucagaaggccggcgagggaaaaaaggugagcgcggcuuuccgggauaucccgguccaaaagguaauccuggcgagcccgggcugaaugggacuacaggacccaaaggaaucagggggagacggggcaacaguggaccuccugguauagugggacagaagggagauccgggcuauccaggcccagccggaccuaaaggcaaucggggcgauucuauagaucagugcgcuuuaauccagagcauaaaagacaagugcccaugcuguuauggcccccuugaaugccccgucuuuccaaccgagcuugcauuugcucucgauacaagugaaggcgugaaucaagacaccuuuggucgcaugagagacguugugcuaagcauuguaaacgaccugacuaucgcagaguccaauugcccaagaggcgcccgggucgcagucgucacauacaacaacgaagugaccacagagauccgcuuugcagauucuaaaagaaaauccguacuccucgacaagauaaaaaauuuacagguggcccugacgucgaaacagcagucgcuugagacagcuauguccuucguugcuagaaauaccuuuaagagagugcggaauggauuuuugaugagaaagguugcuguauucuuuucuaacaccccaacccgugcaucgccgcaacucagagaagcuguucuaaaguugucugacgcugggauuacgccucuguuucugacacgucaggaggaccgccagcuuauuaacgcauuacaaauuaacaacaccgcugucggccaugcccugguucugcccgcugggagagaucugaccgauuuuuuagagaaugugcucaccugccacgugugccuggacauuugcaacauugaccccuccugcggcuucggcucuuggagaccaucauuccgggauaggagggccgccggauccgauguggacauagacauggccuuuauuuuagauucugcugaaaccacaaccuuauuccaauucaacgagaugaagaaguauaucgccuaucuggucagacaacuugacaugucacccgauccaaaagccagccagcacuucgcccggguagcugucgugcagcacgcaccuagcgaaagcguagacaaugcuucgaugccgccugugaaaguggaguucagucucaccgacuauggaaguaaggagaagcucguggauuuccuuagucgugggaugacucagcuucaaggcacacgcgccuugggcuccgcuaucgaauauaccauagagaauguguucgagucagcgccaaauccaagggaccuaaagaucguuguacuuaugcucacuggagaagugccugaacagcaacuggaggaagcacagagggugauacugcaagcaaaguguaaaggguauuucuucgugguccuggguauugguaggaaaguaaauauuaaggaaguauacacuuuugcaucugaaccaaaugauguauucuucaagcuugucgauaagucuacagagcugaaugaagagccucucaugagauucggacggcugcuaccuuccuucgugaguagcgagaaugcauucuaucugagccccgacauccguaaacagugcgauugguuucaaggagaucagccuaccaaaaauuuaguuaaguucggacacaaacagguuaacgugccaaacaaugucacaucuuccccuacaucaaaucccguuacaacaacuaaacccgugacuacuacuaagcccgugacaacgacaacaaagccaguaacuacaacaacuaaaccugucaccauaaucaaccaaccuuccguuaagccugccgcugcaaaacccgcaccagcgaaaccaguggcagcaaagccuguggcuaccaagauggcuaccguacgcccaccuguagccgugaaacccgccaccgccgcaaaaccugucgcagccaagccugccgcaguucguccccccgcagccgcugccgcuaagcccguggccaccaagccugaaguuccucgcccccaggccgcuaaaccugccgccacaaagcccgccaccaccaaaccuauggucaagaugagcagagaggugcaaguuuuugagauuacggaaaacucagcaaaacuucacugggagcgugccgagcccccuggcccguauuucuacgaccugacggucacuagugcccacgaccagagccucguuuuaaagcagaaucugacugucacugaccguguuauaggcggacuacuugcuggccaaaccuaccauguggccguugucuguuaucuucgaagccagguccgggccacauaccacgguagcuucucaaccaaaaagucucaaccgccaccuccucagccagcccgaagugcaaguucgaguacaauuaauuuaauggugagcacugaaccacuggcccugacugaaacggacaucugcaaacuacccaaagaugagggaaccugucgugacuucauucucaagugguacuaugauccaaauacaaaauccugcgcacgcuuuugguaugggggaugcggaggcaacgaaaauaaguucggcucacagaaagaaugcgaaaaagucugugcuccagugcuggcaaagccaggugugauuucuguaauggguacuuag

SEQ ID NO: 5366 - RNA, 8934 nt, Artificial Sequence
  Description of Artificial Sequence: Synthetic coding sequence
augagaaagcaccggcaucugccccuaguugcaguguuuugccuguuucuuucaggauucccgacgacccacgcucagcagcaacaagcagacgugaagaauggcgccgcagcugacauuaucuuccugguggauucauccuggacaaucggagaggagcacuuucaauuagucagagaguuuuuauaugacguuguuaaaucuuuagcaguuggagaaaaugauuuccacuucgcauuaguacaguucaacgguaacccucacacagaauuccuccucaacaccuacaggaccaagcaggaaguccuuucccacauuuccaacauguccuacauuggcggaacaaaucaaacgggaaagggacucgaauauauuaugcagucacaucuuacaaaagcggcagggagcagggcaggcgacggagugccucaggucauugugguacugacagauggucauucuaaggacggacucgcguuacccucagcugagcugaaaucugcugacgucaauguuuucgcgaucggcguggaggacgcagacgagggugcacugaaggaaaucgcuuccgaaccucugaacaugcacauguucaaccucgaaaacuuuacuucacuucacgauauagugggcaaccuuguauccugcguacacaguagcgugagcccggaacgggccggagauaccgaaacccucaaagauauuacugcacaagauucagcagacauuauuuuuuuaaucgauggaucaaauaacacaggaagugugaauuuugcuguuaucuuggauuuucucguaaaccuccuggagaaacuaccaauagggacacagcaaauucgugugggaguuguucaauuuuccgaugagccaagaacaauguucuccuuggacacuuacagcacuaaagcccaagugcuaggcgcugucaaggcccugggauucgcaggcggugagcuggccaacaucgguuuagcuuuagacuuuguggucgagaaucacuuuacaagggccggggguucaagaguggaggaaggcgugccgcaggugcuuguuuugaucagcgcaggaccuagcagcgaugagaucagauauggcgucguugcccugaagcaagccaguguguuuaguuuuggauuaggcgcucaagccgcuuccagagcggaauugcagcauauugcaaccgacgacaaccuggucuuuaccgugccggaauuucguucuuuuggagaucugcaagaaaaacuccugccauauaucgucggaguugcgcagagacauaucgugcuuaagcccccuaccauugugacgcaggugauugaagugaacaaacgggacauuguuuuccuuguugacgggaguucugcucuuggcuuagcuaauuucaacgccauaagagacuuuaucgccaaagugauccaaagacuugaaauuggacaggaucucauucagguugccguagcacaguaugcggauaccguuaggcccgaauuuuacuucaacacgcaucccacuaagcgagagguaauuaccgccguuagaaaaaugaagcccuuggacgggagugcacuauacaccggaucugcacuagauuucguuagaaauaaccuuuucacgucaucggccggcuacagagcagcugagggaauuccaaaacuccucgugcugauuacugggggaaaaucuuuagacgagauuagucagccugcccaggaacugaaacgcaguuccauuauggcuuucgcaaucgguaacaaaggcgcugaccaggcagagcuggaagaaauugcauuugacucuagcuuaguguuuauaccagccgaauuccgcgcugccccucugcagggcaugcugcccggccuccuugcuccucugcgaacucuaucuggaaccccugaggagagcaagagggacaucuuauuucuguuugaugguuccgcaaaccucguagggcaauuuccaguuguucgggacuuccucuauaaaaucauugaugagcugaaugucaagccagaagguaccagaauugcugucgcccaguauagcgacgaugugaagguugagucuagauucgacgagcaucaguccaaacccgaaauccuuaaccuuguaaaacggaugaaaauaaagaccgguaaagcacugaaucugggcuaugcuuuagauuaugcgcagagauacaucuuugugaaaagcgccgguucacgaauugaggaugggguccuccaauuccuggugcugcugguggccggaagauccuccgaucgcguugacggaccugcaagcaaccugaagcaaagugguguuguaccuuucauauuccaggccaagaacgccgacccggcugagcucgaacagauuguauuaagccccgccuucauuuuagcggcugaaagcuuaccuaagauaggagaccuucauccucagaucgucaaucugcucaagagcguucacaauggcgccccagccccaguaucuggugaaaaagaugugguuuuccugcuggauggcucagagggcguaagaagcgguuucccccuucugaaagaauuuguucagcgagucguagagucacucgauguuggucaggaucgcgugcgaguagcuguaguacaguauucugaucggacaagaccagaguuuuaucuuaacaguuauaugaauaagcaggacguagucaacgccgugcgucaauugacacuucuuggcgggccuacaccgaacacuggagcugcguuggaauuugugcugcggaauauucuagucagcucagccggcucccgcauuacagagggcgucccacagcuucuaauaguacuaacugcugacagaucuggagaugauguuaggaacccaucuguuguagugaaaagagguggugcagugccuaucggaauaggaaucgggaacgcugauauuacagagaugcagaccauuaguuucaucccugauuucgcuguggccauuccuaccuucagacagcucggaaccgugcagcaggucauuucagagagagugacccaacuuacgagagaggaguugagcagauugcagcccguguuacagccucuaccaagcccgggaguagggggcaaaagagauguggucuuccuuaucgacggcagucaguccgcagguccugaguuccaguaugugcgcacacugauagagagacugguggauuaucuugacguaggcuucgacacuaccagaguugccguuauccaguuuucugaugacccaaaggucgaauuuuugcugaacgcccauucgagcaaggaugaagugcagaaugcagugcagcggcuuagaccaaaaggaggcaggcaaauuaacguaggcaacgcucuugaauauguaucucgcaacaucuuuaagcgaccuuuagggucucgcaucgaagaaggcgucccacaauucuuggugcugaucucuaguggaaagucagacgaugaaguggaugacccugcagucgagcucaagcaauuuggaguagcaccuuucaccauugcaagaaacgccgaucaggaagagcuggucaagaucagccuuucacccgaauaugucuuuucaguguccacuuucagggaacugcccagccuggagcagaaauugcuaacacccaucacaacucugaccagcgaacagauucaaaaacuguuggcuuccacccgcuacccgccccccgccguugagucagaugcagcggauaucguauuuuugaucgacuccagugaaggcguucggcccgacggguucgcacauauuagagacuucgugucucgcauaguuagacgacuuaauaucgguccgucgaaaguuaggguaggugucguccaguucucuaacgauguauucccagaauuuuaccuuaagacauaucgcucccaggcaccuguguuagaugcuauucggcgauugagacuucgggggggaucaccauuaaacacuggaaaagcgcuggaguucguggcucgcaaccuguuugugaagagcgcuggaucucgaauugaggacggcgugccucaacauuuagugcugguguuggggggaaaaucacaggacgacguguccagguuugcucaaguuauccgaucuagcgguauuguuucuuugggcgucggggacaggaauauagaccgaacugaacugcaaacuauuacuaaugauccuaggcucgucuuuaccgugagagaauucagggaguugcccaauaucgaagaaagaaucaugaacucuuuuggacccuccgcugccacucccgcuccuccuggcgucgacacgccccccccauccagacccgaaaaaaagaaggccgauauuguauuucugcucgaugguucaauuaacuuccgccgcgauuccuuucaagaaguucugcgguucgucagcgaaaucgucgacacuguguaugaggauggcgacaguauucaaguaggccuggugcaguacaauuccgacccgaccgaugaauucuuccugaaagacuuuuccaccaaaagacagaucaucgacgcgaucaauaaagugguguauaaaggaggacggcacgcaaacaccaagguuggccuggaacacuugagggugaaccauuucguacccgaggccggaucucgacuggaccagcgggucccacaaaucgcuuucguaauuacagguggaaaguccguugaagacgcccaagacguuucccuggcccugacacagagaggggugaaagucuucgcuguuggcgucagaaacaucgacucagaggaggucgggaagauugcuuccaacagugcuacugcauuucgaguagggaaugugcaggagcuuagcgaacuuucagaacaaguguuagaaacucugcacgacgcuaugcaugagacacucugcccaggcgucaccgacgcugcgaaagcgugcaacuuagaugugauccucggauuugacggaucaagagaucagaacguauuugucgcacaaaaaggcuucgaauccaagguggacgcuauacuuaauagaaucucucagaugcaccgaguaagcugcucaggcgggaggucuccaaccgucagggugucugucgucgcuaacacccccucugguccgguggaggcguucgacuuugacgaguaccagccagagaugcucgaaaaauuuagaaacaugcgcagccaacacccuuauguacugaccgaggauacacucaagguuuaucucaacaaauuccgacagucuucucccgauucagucaaaguagucauucauuuuaccgauggggccgacggagaccuggcugaccuccaccgggcuagugaaaaccuuagacaggagggcgugagagcucuaaucuuggucggccuugagaggguugugaaucuggaacgccuuaugcaccucgaguucggaaggggcuucauguaugaccgaccauuacgcuuaaaucuuuuagaucuggauuacgaauuagcggaacaauuggauaauauugcugagaaagcuuguugcggagucccuugcaaauguuccggacagcgcggcgaucgaggccccauugggaguauuggaccaaaaggaaucccuggcgaagacggcuaccgcggauacccuggugaugaaggcggucccggggaacgugggccccccggagugaacggaacccaaggcuuccaaggcugucccgggcagcgcggugugaaggggucccgaggauuuccaggggagaagggagaaguuggcgaaaucggauuagacggauuggacggcgaagacggcgauaaaggcuuacccgguagcagcggagaaaagggcaacccgggccgaaggggugauaaaggcccuaggggugaaaaaggagagaggggagauguggggauacgcggagacccgggaaauccuggacaggacucucaagaaagagguccuaagggggaaacaggcgauuuagguccaaugggggugccaggacgcgacggagugcccggggguccgggagagacaggcaaaaauggcggguuuggccgacgaggaccuccaggagccaaagguaacaaaggcggccccggucaaccgggauuugagggagaacaaggaacgcggggggcacaaggaccugcgggccccgccggccccccaggucuuauuggcgaacagggcaucucgggacccagggguaguggcggcgcagcuggagcuccaggugagaggggaaggacgggaccacucggucgaaaaggggaaccaggggagccgggcccaaaagggggaauaggcaauagggggccgagaggagaaacgggcgaugacggccgggacggggucggcuccgagggaaggagaggcaagaagggcgagcggggauuuccaggguacccaggaccaaaggggaaucccggagagccuggucucaauggcacaacaggccccaaaggaauacgugggaggagaggaaauagcggacccccaggaauuguagggcaaaaaggagauccaggauacccugggccggccggacccaaaggcaacaggggagacagcaucgaucaaugcgcacuuauucaguccauaaaggauaaaugcccaugcugcuauggcccccuggaaugcccaguuuuucccacggaacuggccuuugcucucgauacaagugaaggcgugaaucaagacacuuucggacggaugcgggacguaguacuaucuaucguaaaugaccugacaauagcugagucuaacugcccucgcggggcuaggguagcagucgugacguacaauaacgaggugaccaccgagauucgcuuugcugacagcaagagaaaaagcguccucuuagacaagaucaaaaaccuucaggucgcucuuacuucaaaacaacaaagccucgagacggcaauguccuuuguggcacggaacacauucaagcgcguccgcaacggguuucugaugagaaagguagcgguauucuucucuaacaccccgacgagagccucuccucaacuucgggaagccgugcucaaacuaagugaugccgggaucacccccuuguuccugacacgccaagaggacagacaauuaauaaaugcccugcagauaaacaauacagcugugggacacgcccuugugcugcccgcuggucgcgaccucacagacuuccuugaaaauguucugacaugccacgugugcuuagacaucuguaacaucgauccuuccuguggguuuggauccuggcgaccgucuuuuagggaccggcgagcagcaggcucagauguugauaucgauauggccuucauucuggacagcgcugagacaacgacgcuauuccaauuuaaugaaaugaaaaaauauaucgcauaccucguuagacagcuugacaugucccccgacccaaaagcaucucagcacuucgcccgaguggccguugugcaacacgcacccucugaauccguggacaaugcuucuaugcccccugucaagguugaguucucacucacagauuauggaagcaaagaaaaauugguggacuuccugucgagagggaugacccaacugcagggaacucgcgccuugggaucagccauugaguauaccaucgaaaauguguuugaguccgccccaaacccuagagaucugaaaauuguggucuuaaugcuuacuggugaagugccagaacagcagcuggaagaagcacagcgaguaauuuugcaggccaaguguaaaggguacuuuuucgucgugcuuggaauagguagaaaggucaacauaaaagagguguacacauucgccuccgaacccaaugauguguucuuuaaacuggucgauaaauccaccgaacugaaugaagaaccgcugaugcgcuucggaagacugcucccguccuucgugaguucugagaacgcuuuuuaccugucacccgacauccgcaagcaaugcgauugguuucaaggagaccaaccuacuaagaaccuggucaaauucggucauaagcaggucaacgugccuaauaauguuacuagcagcccgacaucaaacccugugaccacuacaaagccaguaaccaccacuaaaccugugacuacaaccacuaagccggugacaacuacuaccaaaccaguaacuauaaucaaucagcccagugugaaacccgcugcugcaaagccagccccugcuaaaccagucgccgcuaagccgguggccaccaagauggcaaccguccgcccuccaguggcagucaaaccggcuaccgccgcuaaaccugucgccgccaagccugcugccgugagaccucccgccgccgccgcagcuaagcccgucgcuacaaagcccgaaguuccccggccccaggcagccaagccagcagccaccaagcccgcaaccacuaagccuauggucaaaaugagccgcgagguacaggucuuugaaaucaccgagaauagcgcuaagcugcacugggagagagccgaaccuccagggccuuauuuuuacgaccuuacuguuaccucugcccacgaucaaucucucguccucaagcaaaaccuuaccguuacagauagggugaucggaggccuucucgcaggacaaaccuaucacguggcugugguaugcuacuuacggagucagguucgcgccacuuaccacggcucuuuuuccaccaaaaaaucucagccccccccaccacaacccgcccgcagcgcaagcuccucuacaaucaaccuuauggugaguaccgaaccucuggcuuuaacggaaacugauauauguaaguugccuaaggacgagggcacuugucgagacuuuauacuuaaaugguacuacgacccuaauacaaagagcugugccagauuuugguaugguggcugcgguggaaaugaaaauaaguucgguucucagaaggaaugugaaaaggucugugcaccuguauuagccaaacccgggguuauauccgugaugggaacauag

SEQ ID NO: 5367 - RNA, 8931 nt, Artificial Sequence
  Description of Artificial Sequence: Synthetic coding sequence
augagaaagcauaggcaccuucccuugguggcaguauuuugcuuguuccuaucagguuuuccaacuacccaugcgcagcagcagcaggccgauguuaaaaacggagccgccgccgauauaauuuucuugguagauagcucuuggacaaucggugaagaacauuuucaguugguuagagaguuccuguaugauguugucaaaagccucgccguuggcgaaaacgacuuccacuucgcucuugugcaguucaacgggaauccucauacugaauuccuacugaauacauauaggacuaaacaggaggugcucucccauauaucuaauauguccuauaucgggggaaccaaucagacagguaaaggucuagaauacaucaugcagucccauuuaacaaaggccgcgggaucacgagcuggagaugggguuccucaggugaucgucguucugaccgauggacacaguaaagacggccuggcacuccccuccgccgaacugaaaagcgcugaugugaauguguucgccauuggagucgaagacgcugacgaaggugcacucaaagaaaucgccucugaacccuugaauaugcacauguucaacuuagaaaauuucacguccuugcaugauauuguugggaauuuggugaguugugugcauagcagcguuaguccggaacgugcuggugauaccgagaccuuaaaggacaucacugugauugaaguaaacaagagagacauuguguuccugguagauggauccagugcccucggccuggcaaauuuuaacgcaauuagagauuucauugcuaaaguaauucagcggcuggaaaucggccaggaccugauccaagucgcugucgcucaguacgcugacaccguucggcccgaguucuacuucaacacccacccuacuaagcgggaggugauuacugccgucaggaaaaugaaacccuuggaugguuccgcccuguacacuggauccgccuuggacuucguacggaacaauuuguuuaccucuucagccggcuauagagcugccgaggggaucccuaagcugcucguuuugauaaccggaggaaaaucuuuggacgagaucucccagccagcucaggaacuuaaacgcucuuccaucauggcuuucgcuaucgggaacaagggagcugaccaagcugaacuggaagaaauagcauucgauucuucacugguuuucaucccugccgaauucagagccgcuccacugcaagggaugcuuccaggacugcuugcgccucugagaacauugaguggaaccccagaagugcacucuaauaaaagagauauuauuuuccugcuagacgguagcgcuaaugucggaaaaaccaauuucccauacgugcgcgauuucgucaugaaccugguaaauagccucgauaucggcaacgacaacaucagaguaggucuuguucaguucucugauacaccggucaccgaguucucgcuaaacacuuaucagacaaagucagacaucuuagggcauuuacggcagcugcaacugcagggcgguagcggacuuaauacaggcagcgcauugucauacguuuaugcuaaccauuucacugaggcuggcggcagcaggauucgugaacacgucccucagcugcucuuacuguuaacugcuggucaaagcgaagauucuuaucugcaggcugcaaaugcacucaccagggcugguauacugacuuucuguguuggcgcgucccaggccaacaaagcugaacucgaacagauugcauuuaacccgucccucguguaucucauggacgauuucaguagucuucccgcucugccacagcaguuaauccagccccucacaacuuauguguccggcgguguggaagagguaccacuugcccagccugaaucaaagcgggauauucucuucuuguuugauggaucugcaaauuuagugggacaauucccugucguaagggacuuucuguacaagaucauugacgaauugaacgugaagccagaaggaacccggaucgcggucgcccaguauucugacgaugucaagguggaauccagauucgacgaacaccaguccaaacccgagauucuuaaccugguuaagcgaaugaaaaucaagaccggcaaggcucugaaucugggauaugcgcuugauuacgcacagcgguauauuuucgugaaaucugcuggguccaggauugaggacggaguucugcaauucuuaguguuacucguugccggccgcuccucugaucgcguggaugggcccgcaucaaaccuuaagcagaguggaguugucccuuuuauauuccaggccaagaacgcugaucccgcugaauuggagcagauaguuuugaguccggccuucauucuggcagccgaaucauuaccuaagauaggcgaucuccacccucaaaucgugaaccuccugaaguccguucauaacggcgcaccagccccagucagcggagagaaagaugucguguuccugcuggauggcagugagggagucagaucuggguucccgcuguugaaagaguuugugcagagaguaguagagucccuggacgucggccaggacagaguuagaguggccguagugcaauauagcgacaggaccagacccgaauucuaccuaaauucauacaugaauaaacaggaugucguaaaugcgguucggcaguugacacuccuuggagggccgacaccaaauaccggggccgcccuggaauuuguccugaggaacauuuuagugucaagugcugggucuaggauuacugaaggagucccgcagcugcugauaguguuaacagcugacaggucuggugaugacgugaggaacccuucuguuguggugaagaggggaggagcaguacccauugggaucgguauuggcaaugcggauauaacagagaugcaaacaauuaguuuuauaccagauuucgccgucgcaauuccuacauuccggcagcuuggaacagugcaacagguaauuagugaacgaguuacgcagcugacccgagaggaacuuagccgauugcagccggucuuacagcccuugccauccccaggugugggaggcaagcgggacguaguguuccugaucgauggcagccagagcgccggacccgaguuucaauacgugagaacacuuauugagagacuugucgauuauuuagauguugguuuugacaccaccagagucgcugucauucaauucucugacgacccuaagguagaauuucuucugaaugcgcauuccucaaaggacgaaguccagaacgcugugcaaaggcuucgaccuaaaggagggaggcagauuaaugucggaaacgcacucgaguacguuagccggaacaucuucaaaagaccacugggaagucguauugaggaaggagucccucaguucuuaguucugauuucguccgguaaguccgaugacgaggucgacgaucccgcuguugagcucaaacaguuuggcguggcuccauuuacgaucgccaggaaugcagaccaggaagagcucguaaaaauuagccugagucccgaauauguuuucaguguuucuacguucagggaacuaccuagcuuagagcagaaauugcugacaccgauuacuacccucaccucugaacaaauucagaaacuccucgccucaaccagauauccccccccagccguggaaagugaugcagccgacaucguauuccugaucgauaguagugaaggcguucgcccggacggcuuugcccacauucgcgauuuuguauccagaaucgugcgcagacugaacauagguccuucuaaagugcggguggguguagugcaguuuucuaacgacguuuuuccugaguucuaccugaagacuuaccggucucaagcccccguccuggacgccaucagacgucugagacuucguggcggcagcccguuaaacacuggaaaagcccuggaauucguggcaaggaauuuguucguuaaauccgccggcagcagaauagaagauggagucccccagcaccugguuuugguacucggaggcaagucucaagaugacguuucucgguuugcacaagucauccgaucuucuggcaucguuucuuugggugugggggaccgcaacauagaucgcacagaacuacagacuauuacaaaugauccccgccugguuuucacuguccgugaguuucgcgagcuaccaaacauugaagaacgaauaaugaauagcuuuggcccaagugcugcgacgcccgccccccccggcguggacaccccaccacccaguagacccgagaagaaaaaagcagauaucguauuuuugcuggauggauccauuaacuuuagaagggauucauuccaggaagugcuccgguuugugagcgaaauaguugacacuguuuacgaagacggcgauagcauccagguaggacugguucaguacaacucugaccccaccgaugaauuuuuccuaaaggauuuuagcacuaaacgacaaaucauagaugcgauaaauaaagucguuuauaaaggcggacggcaugcaaacacuaaggucggguuggagcaccuaagagucaaccacuuugugcccgaagcggguuccagacuagaucagcguguaccgcaaauagcuuuugucaucaccgggggcaaaucuguggaggaugcucaagacgugagccuggcccugacccagaggggaguaaagguguucgccgucggagugagaaacauugauagcgaagaaguaggaaaaauugccucuaacagcgcaacugccuuccgugucgguaauguacaggagcugagcgagcucucagaacaaguacucgagacacugcacgacgcuaugcacgaaacacucuguccgggugugacagacgcagccaaggccugcaaucucgauguuauucucggauuugacgguucuagagaucagaauguuuucguggcccaaaaaggguucgagucuaagguggacgcaauacugaaucgaauuucccagaugcacagggucucuugcucuggcggccguucccccacagugcgcguuucggucgucgccaacacaccuuccgguccaguggaagccuuugauuuugaugaauaccaaccagagauguuggagaaauuuaggaauaugcguucacagcacccuuauguuuuaacagaagauacccuuaaaguuuaucugaacaaauuccggcagagcaguccagacuccguuaaaguugugauccacuuuacagauggcgcugauggagaccuggcggaccuucacagggccagugagaaucuucgacaagagggcgugagggcacuuauccuugugggccuggaaagagucgugaaccuagaaagacuuaugcaucucgaauuuggccgcggauuuauguacgaucgcccccugcgccucaacuugcuugaccucgacuaugaacuggccgaacagcucgauaauaucgcugagaaagccuguugugggguucccuguaaguguagcggacaaaggggggacagaggacccauugggagcauaggcccaaaaggaauuccuggugaagauggauaucggggcuauccgggggacgaagguggaccaggggaacgcggcccuccuggcgugaauggaacgcagggcuuucaaggaugcccgggucagcgcggcguaaaggggucuagaggcuuuccaggugagaagggcgaggugggcgagauuggauuggacggacuggacggugaagacggugauaagggguuaccagggagcucaggagaaaaaggaaacccaggccggagaggggacaagggaccccggggagaaaaaggcgagagaggugacgugggcaucaggggagacccagggaaccccggccaggauucgcaggaaagagggccgaagggagaaacuggagaucuuggucccaugggcgugccuggacgggacggcguucccggcggacccggcgagacaggcaagaauggaggguucggucgaagaggaccacccggcgcgaagggcaacaagggaggaccuggccagccuggguuugaaggggaacagggaacucgaggugcucaggggccugcugguccagcugggccuccuggccucaucggugagcaagguauaucgggcccuagagguaguggcggcgccgcaggggccccaggcgagagaggcaggaccggaccucugggaagaaaaggggagcccggcgaacccggccccaagggggggauuggcaauagagggccacgcggagagacaggcgaugauggacgugacggcguggguucagagggccgccggggaaagaaaggggagaggggguucccagguuauccaggccccaaggggaaucccggugaacccggucucaauggcacgacuggacccaaagguauucgcgggcggcgcgguaauaguggucccccaggaauugugggccagaaaggggauccaggcuaucccggcccggccggcccuaagggaaaccgaggcgauucuaucgaucagugcgcccucauucaaucuauuaaagauaaaugcccauguuguuauggcccguuggaguguccaguguuccccacugaacuggccuuugcacuggauacgagugaaggaguuaaccaggauacauucgggaggaugcgcgacgugguacugaguauagucaacgauuuaaccauugcugaguccaacugucccaggggugcccgcgucgccguuguuacauauaauaaugaaguuacaacagaaauccgcuuugccgauucaaagagaaaguccguguugcuggacaaaaucaaaaaucugcaaguggcacuuacuuccaagcagcagucccuggagaccgccaugaguuuuguggcuaggaauacauucaaacggguuagaaauggcuuccugaugagaaaagucgcaguguucuucuccaauacuccaacaagagcaucaccccaacugagagaagcuguucuuaagcuuagcgacgcuggaauuaccccccuauuucugacccgacaggaggaucgacaacugauaaacgccuuacagauuaacaauacagccgucggacacgcccuggucuuacccgccggcagagauuuaaccgauuuucuggagaaugugcugaccugccacgucugucucgauauaugcaacauugacccuucuuguggauuugguagcuggagacccaguuucagagacaggagggccgcagguuccgacgucgauaucgacauggccuuuauccuugacagcgccgaaacgaccacuuuauuccaguucaacgaaaugaaaaaguacauagccuaucucguacgacagcuagacaugagcccggaucccaaggcuagccagcauuuugcacgcguggccguagugcagcaugcaccuagcgaaucaguggauaacgcaagcaugccccccgucaaaguggaauucucauugacagauuacggaucaaaggagaaguugguggacuuucugagcagggggaugacccaauugcagggaacucgugcucucggaucugcaaucgaguauaccauagagaaugucuucgaaagcgcuccuaauccucgggaucuuaagaucgucgugcuuauguuaacuggcgaggugccagagcagcaguuagaagaagcccaacgcguaauauuacaggcgaaaugcaagggguacuucuuuguugugcuggggauugguagaaaagugaauaucaaggaggucuacaccuucgcauccgaaccaaacgaugucuuuuuuaaacugguagacaagucaacagaauugaaugaggaaccacugaugcgguucgggcggcugcucccaucauuugucaguucagagaacgccuuuuaccuauccccagauauccggaaacaaugcgauugguuucagggcgaccagccuaccaaaaaucuuguaaaauuuggccacaagcaagugaaugugcccaauaacguuacgucauccccaacuucuaaccccgugaccaccacaaaaccagugaccacuacaaaaccuguaacuacaacuaccaagccagugacaacuacuaccaaaccaguaacaaucauuaaucagccgucugugaagcccgccgcugcuaagccugcgccagccaagccuguggccgcaaagcccguggcgacuaagauggccaccguucgccccccugucgcugugaaaccugcuaccgcagccaagcccguugccgcuaaaccagccgccguccgcccuccagccgcugccgcugccaagcccguggcgaccaaacccgaggugcccagaccccaagcagccaagcccgccgccacuaagccagcuacuacgaaaccaauggucaaaaugucaagagagguccaaguauucgagauuaccgaaaacagugcgaagcugcauugggagagagcagagccaccugggccauauuucuaugaucuuacagucacaagcgcucacgaucaaagccucguucucaagcaaaaucucaccgugacggacagggucaucggagggcuccuggcugggcagaccuaucacguugccgucguguguuaucuccgaucucaagucagggcuacauaccacggaucuuuuucuaccaaaaagucccaaccuccccccccucagcccgcgcgcagcgcauccuccucaacuaucaaucucauggugucaaccgaaccacuagcucuaaccgaaaccgauauauguaagcuaccuaaggaugaggggacaugcagggacuuuaucuuaaaaugguacuaugacccuaacacaaaguccugcgcccgcuucugguaugggggguguggaggaaaugagaauaaauuugggagccagaaagaaugcgaaaaagugugcgcacccguguuagcgaaacccggagugauuagcgugauggggaccuag

SEQ ID NO: 5368 - RNA, 8916 nt, Artificial Sequence
  Description of Artificial Sequence: Synthetic coding sequence
augaggaaacaccgucaucugcccuugguggccguuuucugucuguuccucuccggauucccuacaacccaugcucagcagcaacaggcggcccaggauagcgccgacauuauuuuucuuauugacggcuccaacaauacugguagugugaauuuugcugugauccuggacuucuuagugaaccuccuugaaaaacuuccuauagguacccaacaaaucagggucggcgucgugcaguucuccgacgaaccccgcaccauguuuucauuagacacuuauucuacgaaggcucagguguugggagcaguaaaggcuuugggauuugcuggcggggaguuagccaauaucgggcuggcacucgacuuuguuguggagaaucacuuuacacgggcaggaggcagccggguugaggagggcgugccgcaaguuuuaguucugauuagugccggcccuucaucagacgaaauccgauacggcguaguugccuugaaacaagcaaguguauucuccuucggacucggagcacaggccgcuucaagggcggaacugcagcacauugccacugacgauaaucucguguucacggugccagaauuucgaucguucggggaccugcaggagaaauuauugccguauaucguggguguugcccagcgccauaucguucuaaaaccuccuaccaucguaacacaagucauagagguaaacaaacgugauauuguguuccucgucgacggaucuucagcacucggacucgcuaacuucaaugccaucagggacuuuauugcuaaagugauccaaagacuugaaaucggacaagaucucauacagguagccguagcucaauacgcugacaccgugcgcccugaguucuauuuuaacacgcauccuacuaagagggaggugaucacugccguucguaaaaugaaaccgcuggauggcucugcccuguauacaggcucugcucuagauuuugugcgaaacaaccuuuuuaccagcuccgccggguaccgcgccgcggagggcauuccuaaacuucucgugcucauuacaggugggaaaucuuuagaugaaaucucccaaccagcccaggaacugaaacgaucuucuaucauggcauucgccauuggaaauaaaggugccgaccaggcggaacucgaggaaaucgcuuuugacucuucacugguguucauacccgcugaguuucgggccgcuccucugcaaggcaugcugcccggacuacuagcaccccuccggacucucucaggaacgcccgaaguacacucuaauaagcgcgacaucauauuuuuacuggacgguuccgcaaacgucggcaagacaaacuuuccauacguucgugacuuugucaugaaccugguaaacucucuugacaucgguaaugauaacauccgcguaggcuugguccaguucuccgauacuccaguuacugaguuuucucugaauaccuaucaaaccaaaucagauauccuuggccauuugagacaacugcaguugcaagguggcaguggacuuaacacggggagugcauuaaguuacguuuacgcaaaccacuuuacagaagcuggcggcucccgcauccgcgaacacgugccucaacuccuacuccuguuaacggccgggcagucagaagacuccuaccuacaagccgcaaaugcacuuaccagggcagggauccuuacuuucugcgucggggccucccaggcaaacaaagcggaguuagaacagaucgcguucaacccgagccuuguguaccugauggaugauuucuccucccuucccgcacuuccccagcaauugauucagccccuuaccaccuauguuagcggcgggguugaagagguaccucuugcgcaacccgaguccaaaagagacauccucuuucuauucgacgggucugcgaaucugguagggcaauucccagucgugcgugacuuuuuguacaagauaauagacgagcuaaaugucaaaccagaaggcacucggaucgcaguagcucaguauagcgacgacgucaaggucgagucaagauuugaugagcaccagucaaaaccugaaauacucaaccuggugaaacgaaugaagauuaaaacggggaaagcgcucaaccuuggauacgccuuggauuacgcccaaagguacaucuucgugaaguccgcaggcagcagaauugaggaugggguuuuacaguuccuaguccugcucguagcugggagaaguagcgauagaguggauggucccgcuagcaaucuuaaacagucugguguggugccuuucaucuuucaggcuaaaaaugcugaccccgcagaacuugaacagauugugcuuucaccugcuuucauauuggcugcugaaagccugccuaagauaggggaccuacacccccagauuguuaaucugcucaagucugugcauaacggcgcuccagcaccugucuccggcgaaaaggacgugguuuuccuacuggaugguuccgaaggugugcggagcggcuuuccuuugcugaaggaguucgugcagcgcgucgucgagagucucgaugugggccaagauagagugagaguugcaguuguccaguacuccgacagaacacgcccugaguuuuaucucaauucuuacaugaauaaacaggauguggugaaugcaguaagacagcucacguugcucgguggaccaacacccaacacuggggcggcucuggaauucguucuccgaaacaucuugguuucuagcgcagggucgagaaucaccgagggggugccgcagcuucucauaguuuuaacagcugauagaucuggggaugacguccgcaacccuucugugguugugaaacgagguggugcugucccaauuggaaucgggauugggaaugccgauauaacugaaaugcagacaaucaguuuuauacccgacuucgcuguagccauaccgaccuuuagacaacuggguacaguccagcaggucauaucagagagggucacgcagcucacccgggaagagcugucacgccuucagcccguccuucagccccuccccagcccuggagucggaggaaagcgcgaugugguguuccucauugaugggagccaaagugcaggucccgaguuucaguacguaaggacuuugaucgagcggcuaguggauuaccucgacguaggcuuugacaccacacgaguagccgucauacaguuuagcgacgaccccaaaguagaauuccuccugaaugcucauuccaguaaggacgaaguucaaaaugccguacagagacugaggccuaagggcgggcggcaaauuaacguaggcaaugcccuggaguaugugucccgcaauaucuucaagagaccacucggcucacgcaucgaagaaggugucccacaguuuuugguccuuauaucauccgguaaaucugacgacgaaguugacgacccagccguugaguuaaagcaauuugguguagcuccauuuacuaucgcccggaaugccgaucaggaagagcugguaaagauaagccuguccccugaauacguguucuccgucucaaccuuucgcgagcucccaucccuggagcagaagcuacucaccccuaucacaacccugacaagugagcagauccagaaacuucuagcuagcaccagauauccaccucccgccguggaaucugacgccgcugacauuguguuccuuaucgacuccuccgaaggugugcgcccugaugguuucgcccauauaagagauuucgucucgcgaauugugcgacgucuuaauaucggcccgagcaagguucgcguggggguaguucaauucagcaacgacgucuucccagaauuuuaccucaagacuuaccgcucccaggcccccguacuggacgcaauccgcaggcuacgccuccgggggggaagcccacugaauacagggaaagcgcuugaguucgucgcaagaaaccuguucgucaaaagugcagggucucguauugaggauggggucccacaacauuugguucuggugcugggggggaaaucucaagaugacgugucaagguucgcgcagguaaucagaaguuccggcauugugucacugggcguuggggacagaaauauagauaggacugagcuccagaccauuacuaaugauccccgacugguauuuacagugcgcgaauucagagaauugccuaauaucgaagagcgaauaaugaacucauucgguccguccgcugcaacuccugcuccuccuggaguugacacuccuccacccagcagaccagaaaagaagaaagcugacaucguguuucuauuggacgguaguaucaauuuccggagagauaguuuccaagaagugcuucgauucguaucugagauagucgauaccguuuaugaggacggcgacucuauccagguaggccuuguacaguauaacuccgacccaacagaugaauuuuuccuaaaggacuucucuacaaagcgccaaauuauugacgccaucaacaagguaguguacaagggcggacggcacgcuaacaccaagguugggcucgagcaucuaagggugaaucacuucguuccagaggcaggcuccagauuggaccagcgagugccacagauugcauuugucauuacagggggaaaaucaguugaagaugcccaagauguuucucuggcccuuacucagaggggugugaaaguuuucgccguuggcguccgcaauauagacagcgaagaaguggggaaaauagcaagcaacucagccaccgcuuuucggguaggaaacguccaggaacuuuccgagcuaucugaacagguguuagaaaccuugcaugacgccaugcacgagacgcuguguccgggcgugacagaugcagcuaaggccugcaaccuugauguuauucuugguuuugacggcagucgcgaucagaaugucuuuguagcgcagaaaggcuucgaaucaaaggucgacgccauucuuaacagaauuucucaaaugcaucguguaucauguagcggcggcaggagccccacaguccgcgucagcguuguggccaacacccccagcggaccaguagaggcauucgacuucgacgaguaucagcccgaaaugcuggagaaauuccgaaacaugcggucucagcacccguauguauuaacagaagacacgcugaaagucuaucugaauaaauuucgccaguccuccccagauagugugaaaguggugauucacuuuacagauggugcugacggagauuuagcagauuuacaucgugcuuccgagaaccugagacaagagggcgugagagcacugauuuuggugggccuugagagagucgucaauuuggaaagacucaugcaccuggaauucggccgagguuucauguacgacaggccccucagacugaauuugcuugacuuagacuacgaacucgccgaacaguuggauaacaucgcagaaaaggcauguugugguguuccauguaagugcucuggccagcgaggugaccgcggccccaucgguuccauuggucccaaaggcauuccaggggaagacggcuauaggggauacccaggugacgagggcggaccaggagaaagaggacccccaggcgucaacgggacucagggcuuccagggcugcccagggcagcggggugucaaaggcucuagaggcuuccccggagaaaagggagagguuggcgaaauuggccuggacgguuuggauggcgaggauggcgauaaaggacuccccgggaguucaggugaaaaaggaaauccuggaagacgcggugauaaggggccuagaggggaaaagggggagcggggugauguugguauucgaggagacccgggcaacccggggcaggacagucaggagcgaggaccuaaaggggagacgggagaucucggcccaaugggagugccaggcagagauggcguuccuggaggaccaggcgagacaggcaaaaauggcgguuuuggccgcagaggucccccaggcgccaagggcaauaaaggggggcccggacagcccggauucgaaggugaacagggaacacgaggggcacagggacccgcgggcccugcuggcccccccggacugauuggugaacaggggauaucugggccacgaggauccggaggugcugccggcgcaccaggcgagaggggacgcacagggccacuggggagaaaaggcgagccuggggagcccggaccaaaaggaggcauuggaaaucgaggucccaggggugaaacuggugaugacggccgcgaugggguggggagcgaaggacgccgaggaaagaaaggugaacgaggauucccaggguacccuggcccuaaagguaacccaggcgagccgggacugaauggcaccacugggccgaaagggauucggggcagacgggggaacucagggccuccugguauugugggccagaagggggaucccggauacccuggcccagccggucccaagggaaaucgaggugauagcauugaccaaugugcacugauccaaaguaucaaagauaaaugcccaugcugcuacggcccacuugagugcccgguguuccccacugaacuagcauucgcucuggauacaucugaagguguaaaccaggacacauuuggucgcaugagagacgugguacuuaguauugugaacgaucugacgaucgcugagaguaauugucccagaggggcgagggucgcgguagugacguauaacaaugaggucacaacggaaauucgauuugccgacagcaagaggaagucgguacuucucgauaaaauuaaaaaccugcaagucgcucucaccagcaagcaacagucccuagagacagcgaugagcuuuguagcgagaaauacauucaaaaggguuaggaacggcuuucugaugaggaaggucgccguguucuuuuccaacacgccuacacgagccaguccucaacugagagaggcggugcugaaacugucagaugcaggcauuacacccuuauuucuuacucgccaagaagacagacaacuuauuaaugcgcuacagauuaacaacacagcaguaggccaugcauuaguacucccugccggacgcgaucugaccgacuuccuugagaauguauuaacuugucacgugugucuugauauuuguaauauugaucccagcuguggguucggguccuggagaccgagcuucagagaucgaagagccgcaggaagugacguugauauugacauggccuucauucuggauuccgccgaaacuacaacacuauuucaguucaaugagaugaagaaauauauugccuaccucgugagacaacuggacaugucaccugauccuaaagcgucucagcauuucgccagaguagccgucgugcagcaugcuccgucggagaguguggacaaugcaucaaugccgcccgugaaggucgaauuuucuuuaacggacuaugguagcaaggagaaacugguugauuucuuaucacgagggaugacccaacuucaaggcaccagagcguugggguccgcaaucgaguauaccauugagaauguguucgagucugcaccuaacccaagagaucugaaaauagucguguuaaugcuuacuggugaaguaccagaacagcagcuggaagaagcucagcgagugauccugcaggcaaaauguaagggcuauuucuuuguugugcugggaaucggacgcaagguaaacauuaaagaaguguacacuuucgcaagugaaccaaacgacguguuuuuuaaauuggucgacaaaucaacggaacuuaacgaggaaccccugaugcgcuuuggacgauuacugcccuccuucgugucgagugaaaaugccuucuaccucuccccugacauccgcaaacagugcgauugguuucagggugaucagcccacaaagaaucugguaaaauuuggccauaagcaagucaacguacccaacaaugucacuucuucaccuaccucuaacccaguaacaacaacuaaacccgucacaaccaccaagccagugacuacgacaacgaaacccgugaccaccaccaccaagcccgugaccaucaucaaucaaccgucagugaaacccgcugccgccaagcccgcucccgcuaagccugucgccgcaaagccaguugcaacaaaaauggcgacaguuaggccuccaguugccgugaaacccgcuacagcugcuaagccgguugcugcaaagccggcagcugucagaccucccgccgcugcagccgcuaaaccagucgcaaccaaacccgaagugccccgaccacaggccgcuaagccagccgccacuaagcccgccacgacuaagcccauggucaaaaugaguagagaaguucaagucuucgagaucacagagaacuccgcuaagcugcauugggaacgggccgaaccuccaggcccauacuucuacgaccugacagucacauccgcccacgaccagucucuuguccucaagcaaaaccugacugugacugauaggguuaucggcgguuugcucgcuggccagaccuaccauguugcugucguauguuacuuaagaagccaggugcgagcuacguaccacggcucauuuuccacuaaaaaaagccagcccccuccuccacagccugcccgcucugccuccucgagcacuaucaaccugaugguuaguacagaaccucucgcccuaacagagacugauauaugcaaauugccaaaggacgaggguaccugcagagacuucauacugaaaugguauuaugacccaaacacaaaauccugcgcaagauucugguaugguggaugcggggggaacgagaacaaguuugggagccagaaagaaugcgagaaggugugugcuccaguacuggcuaagcccgguguuauuucugucaugggcacauag

SEQ ID NO: 5369 - RNA, 3111 nt, Artificial Sequence
  Description of Artificial Sequence: Synthetic coding sequence
augagaaagcaccgccacuuaccuuuagucgcagucuucugucucuuccucagcgguuuuccuacaacccacgcucaacagcagcaagccguuauagaggugaacaaacgugauaucgucuuccucguggacggcucgucugcucuuggccuugccaauuuuaacgcgauuagggauuucaucgccaaggucauccagcggcucgagauuggacaggaccucauccagguggccguugcccaguaugccgauaccguccgucccgaauucuacuuuaacacccaccccaccaaaagagaggucauuaccgcuguaaggaaaaugaagccucuggacggauccgcuuuguauacgggcuccgcuuuagacuuuguucgcaauaacuuauuuaccaguagcgccggauaccgggccgccgaaggaauccccaaguuacuaguacugauuaccgggggcaagagccucgaugagaucucacaaccagcucaggaacuaaagagguccuccauuauggcuuucgcgauuggaaacaagggagcagaucaggcugaauuagaggaaauugcguucgauucuaguuuaguguucauuccugcugaguucagagccgccccccugcaaggcaugcugcccggucugcuagcuccccugagaaccuuaagugguacaccugaagugcauaguaacaagagagacaucaucuuucucuuagacggcagcgcaaacguuggaaagacaaauuuucccuacgugagagauuucgugaugaaucuggucaacucucucgauauuggcaaugauaacauccgggucggccucguccaguuuagcgacacuccugucacagaguucaguuuaaacacauaccaaacaaaaucagacauccucggccaccuacgacaguugcaguuacagggaggcuccggacuaaauacugggucagcgcugagcuaugucuaugcaaaucauuuuacagaagccggaggcagccggauccgagaacacgugccucaguuguuacuccuccuaacugcaggucaguccgaagauagcuauuuacaggcugccaacgcccuuacuagagccgggauucuuacauuuugcguuggugcuucacaggcuaacaaagcagaauuggagcagauugccuucaacccuagccuuguguaucugauggacgacuucagcagccugcccgccuugccccagcaacuuauccaaccccucaccacauacgucucuggaggcguggaagaggucccccuugcacagccugagucuaagagagacauccuguucuuauucgauggaagcgccaacuuggugggacaguucccuguagugagagacuuucucuauaaaaucauugaugagcugaacguuaaaccugaaggcacacgcaucgccguagcucaguacuccgacgacgugaagguggaaucaagauucgaugaacaccagagcaaacccgaaauccugaaucugguaaagagaaugaagauuaagaccgguaaagcacugaacuuaggguaugcguuggauuacgcucaacgcuauaucuuugugaagucagcugggucuagaaucgaagauggcguuuuacaguuccucguacuucuaguggcaggacggagcagcgaucguguagauggacccgccucuaauuuaaaacagucagguguggugccuuucauuuuucaagcgaaaaacgcagaccccgccgaauuagagcaaauuguguugucgccugccuucauccuggcugcugaaagucuaccuaagaucggagauuugcacccacagauagugaaccugcugaaaagcguccacaauggagcaccggccccugugucuggcgagaaggacguuguguuucuguuagauggcagugagggugucagauccggguuuccccugcugaaagaauuugugcagagagucguggagucucuugauguggggcaggaucgcguaagagucgcaguaguccaguacucugauaggacacgaccagaauuuuaucugaauucauauaugaauaaacaagauguggugaaugcaguccggcaacuuacucugcugggcgggccaaccccgaacacgggggccgcucucgaguucgugcuacguaauauucucgucaguucugcugggagccggaucaccgaaggugugccucaacuauuaaucguccugaccgcugaucgcuccggagaugaugucagaaacccaucagucguuguaaaaagaggaggcgcagugccaaucgggaucggaauugggaacgcugauauuacggaaaugcagaccauaucuuuuauuccggacuuugccgucgcaauccccaccuuucgacagcuggggaccguucaacaggugaucagcgaacgcgucacucagcugacacgggaggagcuuagccgcuugcagccaguccugcagccacuuccaagccccggcgugggggguaaacgugaugugguuuuuuugaucgacgggagucagagcgccgggccggaguuucaauacguucguacccucauugagcggcugguggacuaccucgacguaggguuugauacaacgagaguggccgugauucaguucuccgacgaucccaagguugaauuccuguuaaacgcccacagcagcaaggaugaaguccaaaaugcaguacaacggcuucgccccaaaggaggucgccagaucaauguugguaacgcuuuagaguacgugagccgcaauaucuuuaagagaccucugggcagcagaauugaagagggagugccgcaguuucuugugcuaauuucaucugguaagucugacgacgaagucgacgacccggcggucgagcucaaacaguuuggggucgcuccauuuaccauugcccgcaacgcugaccaagaggaacugguuaagauuucacugagcccugaauacgucuuuuccguguccacauuccgugagcugccaagucuugaacagaaauuauugacaccuaucacuacgcugaccucagagcaaauucagaaacuucuggccaguacacgguacccuccccccggcgaaaugggagcgagugaaguccugcuaggugcauucuccauauag

SEQ ID NO: 5370 - RNA, 8916 nt, Artificial Sequence
  Description of Artificial Sequence: Synthetic coding sequence
augagaaagcacaggcaccugccucugguggcaguuuucugccucuuucugagcggcuuccccacaacucacgcccagcaacagcaggccgcccaagauuccgcagacaucaucuuccugauugacggcucuaauaacacuggcucuguaaacuuugcagucaucuuggauuuucuggucaaucuccucgagaagcugcccauuggcacacaacagauacgagugggaguagugcaguuuucugaugagccuagaacuauguucucccuugauacuuauucuacuaaagcacaggucuugggcgcuguuaaagcucugggguuugcagggggcgagcucgccaauaucggccucgcucucgauuucguuguggaaaaucacuucacuagggccgggggcucccggguagaagagggcgugccgcagguccugguucucauuagcgccgguccuagcagcgaugaaauuagauacggagucgucgcauugaaacaagccucagucuuuucuuuuggccucggggcacaagccgcuucuagagcugaguugcagcauaucgccacagacgacaaccugguuuucacuguuccugaguuuagaaguuuuggcgaccuacaggaaaaauugcuuccguauaucgugggcguggcacaaagacacaucguguuaaaaccuccaacaaucgucacgcaagugauugaaguaaauaaaagggacaucgucuuucucgucgauggcucuagcgcauuaggacuagcuaauuucaaugcaauccgggacuucauugcaaaggucauucagcggcuggaaaucggucaagacuuaauucagguggcagucgcccaauaugccgauacaguacggcccgaauuuuauuucaauacucaucccacuaaacgggaagugaucacugcaguacggaaaaugaaaccccuugauggcucugcuuuguacacugggagcgcacuagacuuuguccgaaacaaucuguucacauccuccgccggguaucgagccgccgaagggauucccaaacuccucguacucauuacaggugguaaaucacuggaugagauaagucaaccugcacaagaguuaaaaaggagcuccauuauggccuuugccauuggcaauaagggagccgaucaagccgaauuagaagaaaucgcguucgacagcagccucguguuuaucccugccgaauuccgggcugcuccacuucaaggaaugcugccaggcuugcuugccccacugaggaccuugucagguacucccgaagugcauuccaacaaacgcgacauaaucuuccucuuggacggcuccgcuaacgucggcaaaaccaauuuuccauacgugagggacuucguuaugaaccuggugaauucacucgauauagguaacgacaacauaagggucggacugguccaguucagugauaccccugucaccgaauucucacucaauacuuaucagacaaagagcgacauacugggccaccucaggcagcuucagcuucaaggcggcuccggucucaacacagguucugccuugagcuauguauacgcuaaucauuuuaccgaggccggcggcucucgcauccgugaacacguuccacaacugcuuuuacugcuuacagcuggucaguccgaagauucuuauuugcaagcagccaacgccuugaccagagccggcauccugacuuuuugcgucggggcaucucaggcuaauaaagcugaacuagaacaaaucgccuuuaaccccucacugguuuaucucauggaugauuuuucuucgcuucccgcucucccccaacaacuuauccagccgcuaaccacauauguuucuggcggaguggaggaggucccucuugcccagcccgaaucuaagagagauauccuuuuucuuuucgauggauccgccaaucuagugggacaauuuccaguugugcgcgauuucuuguauaagauuauugacgagcuuaacgugaagccggagggaacacgcauugcaguugcucaauacucugaugaugucaagguugagucaagauuugacgaacaccagucaaagcccgagauacugaauuugguaaagcgcaugaaaaucaaaaccggaaaagcccuaaaucuggguuacgcccuugacuacgcacagagauacaucuucgucaaauccgcaggcucacguaucgaggacggcguacugcaauuuuuaguuuuacuuguggccgggagaaguagcgaccggguggaugggcccgcaucgaaucugaagcaguccgggguugugcccuuuauauuucaggccaagaaugccgacccagcggagcuggaacagaucgugcugagccccgcauucauuuuagcagcugaaucauugccgaaaaucggcgauuuacauccgcagaucgugaaccuacugaaaagcguacauaauggagcgcccgcacccgugucuggggaaaaagaugugguauuucuucuugauggguccgagggcguuagaucuggcuuuccacuccuuaaagaguucguucagaggguagucgaauccuuggaugugggacaggaccggguaaggguggccguagugcaguacucagaccgcacccgaccagaguuuuaccuuaacucuuacaugaauaaacaggacguggucaacgcagugcgacagcugacucugcuagggggaccuacucccaacaccggagccgcauuggaauucguauugaggaauauccucguaagcuccgcagggucccgcaucacugagggggugccacaguuacuaauaguguugaccgccgauagguccggagaugacguuagaaauccuucagucgucgugaagcgagggggagcaguuccuaucggcaucggcauaggaaaugcugacaucaccgagaugcagacaaucaguuuuauuccagauuucgccguagcaauccccacauuucgccagcugggcacugugcaacagguuauuucagaacgcguaacacaacugaccagagaggaauugucccgucuccaaccagugcuacagccacucccuucuccuggagucgggggaaagcgcgacguuguuuuccugauugacgguucucaauccgcaggccccgaauuucaauacguccggacucuaauugaaaggcugguggacuaucuggacgucggguucgauaccaccagaguagcugugauccaguuuucagacgacccuaaagucgaauuucuucugaacgcccacuccucuaaagacgaaguucagaaugccgugcagcgucuuagaccaaagggaggaagacagaucaacguugggaaugcacucgaguaugugucuagaaauaucuucaagcguccccucggaucuaggaucgaggaagggguaccucaauuccucguguuaauuuccagcggaaagucugaugaugagguugacgauccugccgucgagcuaaaacaguuuggcguagcuccauucaccauagcccggaaugcagaccaagaggagcuggucaagauuucccuaucccccgaguauguguuuagcgugucuacuuuccgugagcugccuucacucgagcaaaaacuguuaacaccaauuaccacucuuaccucagaacagauucagaagcuguuggcuucuacacgauacccaccaccagcuguggagucagacgcugcagacauuguguuccuuauugacucuagugaaggcgugagaccugauggcuucgcccacauccgugauuucguuucccguaucgugagacgguuaaacauuggcccuucuaaaguuaggguugggguuguccaguuuuccaaugauguguuccccgaguucuaucugaagacuuacagaagccaggcuccgguucuggacgcaauccgcagauugagguugcguggcggguccccccuuaauacaggcaaagcucuugaguucguagcacgcaaucuguucguuaaaucggccggcucacguaucgaggauggaguaccucaacacuuagugcugguccugggcgguaagucacaggacgauguuagcagauuugcucaggugauccgguccagugggauugugucacuagguguuggcgacaggaacaucgauaggacugaacugcagaccauuacaaacgauccucgguuagucuucaccgugcgggaguuuagagaguuacccaacauugaagaaagaauaaugaauuccuuugggccaucugcagccacuccugcgccccccggcgucgacaccccaccaccuucgcgaccagagaaaaaaaaggccgacaucguuuuucugcuggauggcagcauuaacuuuaggcgugauuccuuucaagagguacugcgauuugucagugagauuguggacacuguguaugaggauggcgauuccauucaaguagggcucguucaauauaacuccgacccgacagacgaauuuuuucugaaagauuucuccaccaagcgacaaauaaucgacgccaucaauaaagucguguacaagggcggccgccacgcuaauaccaaagucggacuugagcaccucagagucaaccacuucgugcccgaggccggcucucggcuggaccagagaguaccccagaucgccuucguaaucacuggggggaagucugucgaggacgcacaggaugucucacuagcacuuacacagagagggguuaagguguuugcggucggagugaggaauauugacagugaggaagucggcaaaaucgcaagcaauuccgcuacagcuuuucgaguuggcaauguccaggaacuguccgaacuuagcgagcagguacucgaaacacuucaugaugcgaugcaugagacccuguguccuggcgugacugaugccgcuaaagcauguaacuuggacgugauucucggguuugauggcagcagagaucagaacguguuuguagcgcaaaaaggauuugaauccaaggucgacgccauucugaacagaaucucccagaugcauagagugucuuguagcgggggcagaagcccuacaguaagaguuucaguuguggcuaauacaccuagcgggccuguggaggcauuugauuucgaugaauaucagccagagaugcuugagaaguuucggaacaugaggucacagcacccauauguucucacugaagacacccugaaaguuuaccucaauaaguuuaggcaguccucucccgacucgguuaaggugguuauucacuuuacagauggugcggauggagaccuggccgaccuacaccgggcuagcgaaaaucucagacaagaaggaguucgggcccugauucucgucggucuugagcgcgucgugaacuuagagagacuaaugcaccucgaauuugggcgaggauucauguaugaccguccccugagacucaacuuacucgaucuggacuacgaauuggcagaacagcuagauaacauugccgaaaaagcuuguuguggggugccuugcaaauguucagggcagcgcggggauagggggcccaucggcucuauuggcccuaaaggcauuccaggcgaggauggcuauagaggguacccaggagaugaagggggacccggagagcgcggcccgccaggcguuaacggcacucagggguuccaaggaugcccaggacaaaggggagugaaaggaagccgaggguuucccggagaaaagggagaggugggggagauaggacuugauggccucgacggugaggauggagauaaagggcugccagggucaagcggagaaaaaggcaauccaggcagacggggggauaagggaccaagaggagagaaaggagagagaggcgacgugggaauccggggugaucccggcaaucccggccaggauagucaggagcgagggccaaagggcgaaacgggcgaucucggcccaaugggcguccccggaagagauggcgugccaggagguccuggcgagacggggaagaauggcggauucggaaggcgcggcccuccaggugcaaaggggaacaaagggggcccaggucaaccaggguuugagggugagcagggaacucgaggagcucaaggaccagccgguccagcgggcccuccaggguugauaggagaacaggguaucuccggaccuagaggaaguggaggugcggccggcgcgcccggagagcggggaagaacaggcccacuuggacgaaaaggcgaaccaggggagccgggucccaaagggggaaucggcaaccggggucccaggggagaaacgggcgaugauggucgugacggaguagggucagaaggcaggagaggcaagaaaggcgaaagaggguucccaggguacccuggcccuaaaggaaacccaggagagccagguuugaauggcacaaccgggcccaaaggaauucguggcagacguggcaacuccggacccccaggaaucguaggacaaaaaggagauccgggcuacccagggccggcuggcccaaaaggaaaccggggugacucuaucgaccagugcgcgcuaauacagucaaucaaagauaaaugucccugcuguuacggaccauuggagugcccaguguuccccacagaacuggcuuucgcucuugauacaucugagggagugaaccaggacacguucgggagaaugagggacguaguucugucuauugugaacgaucugacaauugccgaaaguaacuguccucgcggagccagaguugcugucgucacauacaauaacgagguaacuaccgaaaucagauuugcugacucuaagcgaaagagcgugcugcucgauaaaaucaagaaucuacaggucgcuuugaccagcaagcaacaaucucuugaaacugcuauguccuucguugccagaaauacauuuaaacgcgugcgcaacgguuuucucaugcgcaaaguugcgguguuuuuuucuaacaccccuacccgggccucgccccagcuaagagaagccgugcuuaagcugagugacgcuggaaucaccccgcuauuuuugacacgccaggaggaccgucaguuaaucaacgcccuccagaucaacaauacagcagugggacacgcauugguccucccggccggucgcgaucugaccgacuucuuagagaaugucuuaacuugucauguuugccucgauaucuguaacaucgaccccucguguggcuuuggaucuuggagaccuagcuuccgagaccgcagagccgcuggauccgacguugacauugacauggcuuucauccuugacucugcugaaacuacuacccucuuccaguuuaacgaaaugaaaaaauacauugcguaucucgugcgacaauuggauaugagcccugaucccaaagcuagccagcacuucgccaggguggcaguugugcaacacgcaccgagugagaguguggacaacgcuagcaugcccccaguaaaagucgaauucagccugaccgauuacggcagcaaagaaaaacugguugacuuccugagcagggggaugacgcagcuucaggggacacgggcucuuggaagugccauugaauacacaauugaaaacguauucgagucugccccaaacccacgcgaucugaaaauuguagucuuaaugcugacaggggaggugccggagcaacagcuggaggaagcccaacgcgucauucugcaggccaagugcaaggguuacuucuucguugugcugggaaucgggaggaaaguuaauauuaaagaggucuauaccuucgccucugagccuaacgacguguucuuuaaauuaguggauaaaucaacugaacucaacgaggagccgcucaugcgauuugguaggcuuuuaccuucuuucgucaguucagagaacgccuucuaucucagccccgauauaagaaaacagugcgacugguuccaaggcgaccaacccacaaagaaucucgucaaguucggccauaagcaaguuaauguuccaaacaaugucaccuccagcccuacuuccaacccugugaccaccacaaagcccgugacgaccacaaagccugucacgacuaccaccaagcccguaaccacuacaaccaaacccgugacaaucaucaaccaaccuucagugaaacccgcagccgcuaaaccagcgcccgcuaagccugucgcagccaagccagucgcaacaaaaauggcuaccgugcgcccacccguggccgugaaaccagcuaccgcagccaagccagucgcggcuaagccagcagcugucagaccaccagcggcagccgcagcgaagcccgucgcuacgaaaccagaggugccgagaccacaggccgccaaacccgcagccacuaaacccgccacaaccaagccuauggucaaaaugucucgagaaguucaaguuuuugagaucaccgagaauuccgccaagcuccacugggagagagcggagccgccaggacccuauuucuacgaucuaaccgugacaucugcucacgaucagucccugguucucaaacagaacuuaaccgugacggaccgugugauuggaggucuccuggccggacagaccuaucaugucgccguggugugcuaccuacggagccaaguuagagccacuuaucacgggaguuucaguaccaagaaaagccagccaccucccccacaaccugcaagaagcgcuuccaguucuacaaucaaccugaugguuucaacggagccccuggcccucacugaaacugacauuugcaaauugcccaaagaugaggggacguguagagauuuuauuuugaagugguauuacgauccaaauacuaagucuugcgcuagguuuugguacggcggaugcgguggaaaugagaacaaguucggcagccagaaagaaugugaaaaggugugcgcucccguucuggcuaaaccaggugugauuucugugauggggaccuag

SEQ ID NO: 5371 - RNA, 7848 nt, Artificial Sequence
  Description of Artificial Sequence: Synthetic coding sequence
augaagauucuccuuaucauauucguacugaucauauggaccgagacccuagcugaccagucuccaggacccggaccuguguaugccgacgugguguuucugguagacucaucugaucaccuaggacccaagucauuccccuucguaaagacuuuuauaaauaaaaugaucaauucucugcccauagaagcaaacaaguaccgcguagcauuggcccaguacucugacgaauuucauucugaguuucaccuuucuacuuucaagggccgcagcccaaugcucaaucaccucaagaagaauuuccaguuuaucggaggaagcuuacagaucggcaaggcucugcaagaggcucaucgaacauauuuuagugcgccuauaaacgguagggacagaaaacaauuuccaccuauauugguaguuuuagcuucugcagaauccgaggacgaagucgaggaagccuccaaggcucugcagaaagauggcgugaagauuauuucagugggggugcagaaggcaagugaggaaaaucuaaaggcaauggccaccagucacuuucauuucaaucugagaacaauacgggaccugaguaccuuuagccaaaacaugacacaaauaauuaaggauguuacuaaauacaaagaaggagccguagacgcagacaugcaggugcacuuucccauaucuugccaaaaggauagccuugccgaucugguuuuucuuguugaugagucccuuggcacgggagguaauuuaagacacuuacagaccuuccuggaaaacauuacuucuaguauggacgugaaagagaauuguaugcgcuuaggccugauguccuacucgaauucagccaaaacuaucucauuucugaagaguaguacuacccaauccgaauuucaacagcaaaucaaaaaucuguccauucagguaggaaagagcaacacaggugcagcuauugaucagaugcgccgagauggguucucagagucauauggaaguagacgggcacagggagucccccagaucgccguacuagugacgcacagacccagcgacgacgaggugcaugacgcagcccucaacuugaggcuggaagauguuaacguguucgcucugagcauucaaggggcuaacaacacccaacuggaagagauaguuucauacccccccgaacaaaccaucaguacucuaaagaguuaugcugaccuggaaacuuacucuaccaaauuucuaaagaaacuucagaacgaaauauggucacagaucaguacuuaugccgagcagagaaaccuggacaaaacuggauguguggauacuaaggaggcggauauucacuuccugaucgauggaucaucaagcauccaagagaaacaguucgaacagauaaaaagauuuaugcuggaggucacggagauguuuuccauuggacccgacaagguuagggucggugugguucaauacagugaugauacagaagucgaauuuuauaucacagauuauaguaacgacaucgaucuuagaaaagcuaucuucaacaucaaacaacugacgggcgguacauacacaggaaaggcccucgauuauauucugcagaucauuaaaaaugguaugaaagaucguaugucaaaggugccaugcuacuuaaucguccugacggauggcaugucaaccgaucgcgucguagaacccgccaaacggcuccgggcugagcagauuacagugcaugccgucggcauuggggcagccaauaagaucgaacuacaggaaauugcaggaaaggaagagcggguuucauuuggacagaauuucgacgccuugaaaagcauaaaaaacgaaguggugcgggagauaugugccgagaaagguugugaggauaugaaagcagacaucauguuccuggucgauucaaguuggagcauuggaaaugagaacuuucgaaaaaugaaaaucuucaugaagaaucuguugacuaaaauccagaucggagccgacaaaacacagauaggcgugguccaguucuccgauaagaccaaagaggaguuucagcuaaacagauacuuuacccagcaggagaucucugacgcgauugacaggaugaguuuaauuaacgaagggacacugacgggaaaggcacugaacuucgugggacaguacuuuacucacaguaaaggcgcaagauugggggccaaaaaauuucugauucugauuacugauggcgucgcucaagaugacguaagggacccugcccguauucuccgugggaaggacgucacuaucuucuccguggggguguauaaugccaaucgaucgcaguuggaagaaauuucuggagacucaucccuaguguuucacguagagaacuucgaucaucuaaaggcccuggagcgaaaauugauuuuucgagugugugcacugcaugauuguaagaggaucacucuccuugacguaguauuuguucuggaucacuccggcuccauuaagaagcaguaucaagaucacaugauuaaccugacaauccaccugguuaagaaggcugaugucggacgagaccgcgugcaguuuggagcccucaaauauucagaucaaccuaauauacuuuucuaccuuaacaccuacagcaauagaucugccauuauagaaaaccugaggaaacgacgagauacuggcggaaauacuuacacugccaaagcccugaagcaugccaaugcccuguucaccgaagaacacgguuccagaaucaaacaaaaugugaagcagaugcugaucgugauuacagacggagagagccaugaccaugaccaacugaacgacaccgcacuugaauuaaggaacaagggaauuacgauauuugccguagguguagggaaggcuaaccagaaggaacucgaagggauggccggcaacaaaaacaauaccaucuacguggauaacuucgacaagcucaaggacguuuuuacgcucguucaggaaaggaugugcacagaagccccggaggucugccaucuccaggaggcggauguuauauuccuuugcgacggcuccgaucggguguccaauucagacuuugugaccaugacgacguuuuuaagugacuuaaucgauaacuucgacauccagucucaacguaugaaaauagguauggcccaauucggauccaacuaucaaucuauuaucgagcuaaaaaauucucugacaaagacucaauggaagacacagauacaaaacgucucaaaauccgggggcuucccacgcauugauuuugcgcugaagaaagucagcaauauguucaaucuucaugcaggggguaggagaaacgccgguguuccucagaccuuagugguaauaacaagcggagacccaagauacgacguugccgacgcggucaaaacccugaaggaccuuggcaucugcgucuuggugcugggaaucggggaugucuauaaagagcaccuucuccccauuaccggaaacucagagaagauuauuacauuccaggauuuugacaaacugaaaaacguugacguuaaaaaacguaucauucgcgaaauaugccaaaguugcgguaagacaaauuguuucauggauaucgucguuggauucgacauuuccacacaugugcagggacaaccauuauuccaaggccauccccagcuagaguccuaccuuccuggaauucucgaagauauuagcuccaucaaaggcgucucaugcggagccggcaccgaggcgcaggucucacucgcuuuuaagguuaacagcgaucagggauuucccgcuaaauuucaaaucuaucagaaggccguauucgacucacugcugcaggugaacguuuccggaccuacccaccuaaacgcgcaguuucugagaucuuugugggauacguuuaaagacaagucugccucuagaggacaggucuuauuaauuuuuucggacggguugcaguccgaaucgaacauuauguuggagaaucagagugaucgccugcgcgaagcggggcuggaugcacuccuugucgucagccugaauacgaccgcccaccacgaguucucaagcuucgaguucggcaaacguuucgacuauagaacccacuugacaauugguaugagagaauuaggcaagaagcuaucgcaguacuugggcaacauugccgagcgcaccugcuguuguaccuucuguaaauguccaggcauccccgggccacacggcacgagaggcuugcaggcgaugaagggaucacaggguuugaagggaucgagaggccauagaggagaagacggcaauccuggugugcguggcgacacggguccccagggggacaaggguauagccggaugccccggagcuuggggucagaaaggacuaaagggauucucaggaccuaagggugggcacggggacgaugggauugaugguuuagacggcgaggaggggugccacggauucccagggauuaaaggggagaagggugauccaggcucucagggcucgccagggaguaggggcgcuccaggccaauacggcgagaaggguuuuccuggagauccggggaacccgggacagaacaauaacauuaagggacagaaggguucaaaaggcgagcaggggcggcagggacggagcgggcaaaaaggggugcagggguccccaaguagccgagggagucggggcagagaagggcagcggggacugcgcggugugaguggcgagccuggcaacccuggacccaccggaacacucggcgcagagggucuccaggguccacaggguucucaaggcaacccagggaggaaaggugaaaagggcucucaaggucaaaagggcccacaaggaaguccuggauugaugggagccaaaggcucaacuggaaggcccggauugcuagguaaaaaaggcgagccuggccuccccggggaucucggaccugugggacagacaggucaaaggggaaggcagggcgauucaggcauaccgggcuacgggcagaugggaaggaagggggugaaagggccacgcggguuuccuggugacgcgggacagaagggggacauaggaaauccugguauccccggcgguccaggcccaaaagguuucagaggacuagccuuaaccguuggauugaaaggcgaagaaggcagcagaggccuucccggcccuccggggcagagaggaaucaagggaauggccggccagccaguguauagccagugugaccuaauccguuuucuucgcgagcacuccuuaugcuccuuggaaaaguguccagccuacccgaccgaguugguuuuugcucucgauaauucuuacgacguaaccgaagaauccuucaacaaaacaagagauaucauuaccucuauagugaaugaccugaacauacgugagaauaauugcccaguuggcgccaggguugcuaugguaagcuauaacucagggacguccuacuugaucagguggucagauuacaauagaaaaaagcaacuucuccagcagcucucccagaucaaauaccaggacacaaccgagccaagagacguggggaaugcaaugcgguucguaacgcgcaacguguucaagcgcacauacgcaggagccaacguccgucgggucgccgucuuuuuuagcaauggacagacugcaucacgauccucuauuauaacugcgaccauggaguucagugcucucgauaucaguccaaccguuuuugcuuuugaugaacguguuuuccucgaagcguucggauuugacaacaccggaacuuuucagguaauucccguuccucccaacggugagaaucagacuuuagaaagacucaggaggugugcucuuugcuacgacaaguguuucccgaaugcauguaucagggaagcuuucuugccugaagauucuuauauggauguaguuuuucucaucgauaacucccgcaauaucgcaaaggacgaauucaaagcggucaaggccuuggugagcucuguuaucgacaacuuuaauaucgccagugauccauugauaucggauucaggcgauaggauugcgcuucucucuuacagcccuugggagucuucccgcagaaagaugggaacuguuaaaacagaauuugacuuuauuacauacgauaaccagcugcuaaugaagaaucacauccagaccucauuucaacagcuuaauggcgaagcuacaauuggccgcgcucugcuguggacaaccgaaaauuuguuuccugaaacaccuuacuuaagaaagcauaaagucauauucguggucagcgcaggagagaauuacgagcguaaagaauuugugaaaaugauggcccuucgagcaaagugccagggcuacgucaucuucguaauuagcuuaggcuccacgcggaaagacgauauggaagaacucgcuucauacccccuagaucagcaccugauccagcucggucguauccauaaacccgaucugaauuacauagcaaaauuccuaaaaccauuccuguacucgguacguagaggcuuuaaccaauacccacccccgaugcuggaagaugcuugucgccuuaucaauuuagguggugaaaauauucagaacgacggcuuccaauuugugacagaacugcaagaggacuuuuuagggggcaaugguuucauaggacaggaacugaauuccggaagggaaucaccguuugugaaaacagaggauaauggaucugauuaccugguguaucuacccucccagauguuugaaccccaaaagcugaugauuaauuacgagaaagaccaaaaaagugccgagauugcaagcuuaaccagcggacaugagaacuacgggaggaaggaagaacccgaucauacuuaugagccaggcgacguuucucugcaggaauauuacauggacguugcauuccuaaucgaugccagucagagagugggcucugacgaguucaaggaagugaaggcuuucauuacaucagugcuggacuacuuucauaucgcuccuacacccuugacuucaacccugggagacagaguugccgugcuuuccuacucuccacccggcuauaugccuaauaccgaagaaugcccuguuuacuuagaguucgaccuugucaccuacaauucuauccaccagaugaaacaucauuugcaagauucccagcagcuuaauggggauguguucaucgggcaugcccugcaguggaccauugauaauguguucgucggcacacccaaucuacgcaagaauaaagugauuuucgugauaucagccggagaaacuaauucacuggacaaggacguguugaggaacgugagccugcgcgcaaagugccagggguauucuaucuucgucuucucauucggacccaagcauaaugauaaagaacuugaggagcuugcuucgcauccacuagaccaccauuuaguacagcuggggagaacucacaaaccagauuggaacuacauuauaaaauucgucaagcccuucguacaucugauuaggcgagcaauaaauaaguaccccacagaagauaugaaagccaccugcguaaacaugacgucgccgaacccagaaaacggcggaaccgaaaauaccgugcuauuacugccuggcaucuaugagaucaagaccgaaaauggagaucuguuugaugaauuugacagccaagcacagcaccuccuggucuugggaaauaaccacucuucaggcucugagacagcaacugacuugaugcaaaagcuguaccuguuauuuucuaccgagaagcuugcuaugaaagauaaagaaaaggcccaccuggaggaaaucucagcucucgugguggauaagcagcaggagaaggaagacaaagagauggaagcgacagacauauag

SEQ ID NO: 5372 - RNA, 7848 nt, Artificial Sequence
  Description of Artificial Sequence: Synthetic coding sequence
augaaaauacugcuaaucauauuugugcugauaaucuggacugaaacccuggccgaucagucacccggccccggcccuguuuaugcagacguuguguucuugguagauucuucugaccauuuaggccccaagagcuuuccauucguaaagaccuuuauaaacaaaaugaucaauagucucccaaucgaagcaaacaaguacaggguggccuuggcacaauauuccgaugaauuccauuccgaguuccacuuaucuacauuuaaaggacggucacccaugcugaaccauuugaagaagaacuuccaguuuaucggggguucacugcagauugguaaagcccuacaagaagcucaccgaacauauuuuuccgcccccaucaaugguagagaccgcaaacaauucccaccaauccuggugguccuggcuagugccgaguccgaggaugagguggaggaagccagcaaagcacuccagaaagacggcguaaaaaucauaagcguuggcguucagaaagccagcgaagaaaaucucaaggcaauggcgacaagucacuuccauuuuaaccuacgcacaauaagagaccuaucaacuuucagccaaaacaugacccaaaucauaaaagauguaaccaaguacaaagaaggcgccguggacgcggacaugcaaguucacuuccccauuucgugccagaaggacuccuuagcugaccucguauuucugguggaugagagcuugggaacugggggaaaccugaggcaucuacaaacauuucucgaaaauauuacaucuagcauggauguuaaagaaaauugcaugcgacugggccuuaugucuuacucuaacucggcaaaaacuaucucuuuucucaaguccaguaccacacagucagaauuccagcagcaaauaaaaaacuugaguauccaggucggaaagucaaauacaggagcagcaauagaccagaugcgcagggacgguuuuucugagucguauggaucucgcagggcccaaggcgugccacagauugcaguguuggucacgcacagacccagugacgaugaaguccaugacgccgcccugaaccuucgccuugaagaugucaauguauuugccuuaucaauacaaggagccaauaauacccagcuggaggaaaucguuuccuacccuccugagcaaacaaucagcacucuuaagucuuaugcagaccuggagacuuacaguaccaaauuucugaaaaaacugcagaacgaaaucuggagucagauuucuacuuacgcagagcagcgaaacuuagacaaaacagguugcgucgauacuaaagaagcugauauccauuuccucauugacggcucuucaucuauacaggaaaagcaauucgagcagaucaagcgcuucauguuagaggugacagagauguuuucuaucgguccagacaaagugagagugggcgugguccaguacagcgaugauacggaaguugaguuuuacaucaccgauuauuccaaugacauugaucuccgaaaagccauuuuuaauauaaaacaacuaacaggaggaaccuacacagggaaagcgcuggauuauauccuccaaauuauaaaaaacgggaugaaagaucgaaugagcaaaguccccuguuaucugauugucuuaacagauggaauguccacagaucgagugguggagccugccaaacgauuaagagccgaacaaauuacaguucaugcagucgggauaggggcggcaaacaaaauagaacugcaggaaauagcuggaaaggaggagcgggucuccuuuggacaaaauuucgaugcacucaaaaguauuaagaacgaaguuguacgcgaaaucugugcugaaaaaggcugcgaggauaugaaggcugacauaauguuucuaguggauagcucauggagcauugggaacgaaaacuuuaggaaaaugaaaaucuuuaugaaaaaucuucucaccaagauucaaauuggggccgacaaaacccaaaucggagucgugcaguucagugacaagacgaaagaggaauuccaacucaauagguauuuuacucagcaagagauuucagacgcgaucgacagaauguccuugaucaaugaaggcacuuuaacuggaaaagcucugaauuuuguuggccaguacuucacucauucaaaaggagcucgacugggcgccaaaaaauuucugauacugauuacugacggcguggcccaggacgacguacgcgacccggccagaauuuugcgaggaaaagacgugacuauuuucagcguggggguuuauaacgcaaaucgcagccaguuggaggagauaaguggcgacaguagccuuguguuucauguggaaaacuuugaccaccuuaaagcccuugagcggaagcuuauuuuucgcgucugugccuugcaugauugcaaaaggaucacacuccucgauguuguauuugugcuggaucacucuggcaguauuaagaaacaguaucaggaucacaugauuaaccugaccauccaucucguuaaaaaggccgacgucggucgggaucgcguccaguucggcgcucuuaaauacuccgaccagccuaauauccucuuuuacuugaauacauacucuaaccguucugcuauuauugaaaaccuccguaagcgccgugacacaggaggaaauaccuauacagccaaggcucugaagcaugcgaacgcccuguuuaccgaggaacauggauccagaauaaaacaaaacgucaagcaaaugcucaucgugauaaccgacggagaaucacacgaucacgaccaacuaaacgacacagcucuugaacugagaaauaaggguauuacaauuuucgccgugggcguggggaaggcuaaccaaaaagaacuagaagggauggcuggcaacaagaauaauacaauuuauguggacaacuucgauaagcucaaggacgucuuuacucuggugcaggaacguaugugcacagaggcacccgaggucugccaucuccaggaagccgaugugaucuuuuugugcgacggaucugauagagucagcaauagcgauuucgugacuaugacuaccuuucucuccgaccucauagacaacuuugauauccagagccagagaaugaagaucgguauggcucaauuugggaguaacuaucagucuauuaucgagcugaaaaauagccuuacaaagacccaguggaagacccagauucagaaugugagcaagucaggcggcuuuccaagaaucgacuucgcccugaaaaaagugucuaacauguuuaauuugcacgcuggugggagacguaaugcagguguaccucagacgcucguaguuaucaccucaggggauccuagauaugauguugcugacgccguuaagaccuugaaagaccuuggaauuugugugcuggucuuaggaaucggcgauguuuacaaggagcaccuacuucccauuacaggcaauagcgagaagauuaucacuuuccaggacuuugacaagcucaaaaaugucgacgucaaaaaaagaaucauuagagagaucugccagucuugcggaaagaccaauugcuuuauggauauuguggucggcuucgacauuagcacgcacguccagggacaaccccucuuucagggacacccacagcuggaaaguuaucugccagguauucucgaggacauauccaguauuaaaggggucucguguggugccgguaccgaggcucaggucucccucgcuuucaaggugaauucugaucagggcuuuccugcuaaauuucaaauauaucagaaggcuguuuucgacucacuucuucagguuaacguuucuggaccaacgcauuugaaugcacaguuucuaaggagccugugggacaccuuuaaggacaaaagcgccagccgcgggcaggucuugcugaucuucuccgacgggcugcaauccgaauccaauaucaugcuggagaaucaaucggacaggcugcgcgaagcuggacuggaugcacugcuaguagugucccucaacaccaccgcacaccacgaguucucuagcuuugaauuugguaaaagauucgacuacaggacccaucugacaauugguaugagagagcuaggaaaaaaguugucccaguaucuaggaaacauugcugaacgaacauguuguugcacuuucuguaagugucccggaaucccugggccccacgggacacgagggcuccaggccaugaaaggaucacagggacucaaggggagccgcggacacagaggagaggacggcaauccuggcgugcggggggacacuggaccacaaggggauaaagggauagcaggcuguccaggcgcuuggggucagaaaggacuaaaagguuuuucaggcccgaaagggggccauggugacgauggaauugacggccuggauggggaagaagguugccaugguuuuccugguaucaaaggugagaagggggaucccggcucucagggcucgccaggaucaaggggagccccagggcaguacggagagaagggauucccuggagauccugggaacccuggccaaaacaauaacaucaaggggcagaagggcucaaaaggagaacagggccgacagggacgaagcgggcagaagggaguucaaggcucaccaagcaguagaggaaguagggggagggaaggacaacgggguuuacggggggugucaggagagcccgguaaccccggcccaaccggcacgcuaggggcagagggacuucagggaccgcagggcagucaagguaaccccggcaggaagggcgaaaaaggaagccagggccaaaaaggaccucaagguuccccugggcucaugggcgcgaaaggcaguacaggacgacccggauuguugggcaagaagggcgagccgggucugccaggggauuuaggcccaguaggacaaacuggccagcguggcaggcagggggauucagggauaccugguuaugggcagaugggacggaagggagugaaaggaccucguggauucccaggagacgcuggccaaaaaggugacaucggcaacccaggcauccccggcgggccuggaccuaaaggauuucggggccuagcuuugacuguaggccugaagggagaagaggggucgcgcggucucccagguccuccaggacagcgcgguaucaagggaauggccggccagccuguguacagccaaugugacuuaauacgcuuucugagggagcauucuccuuguuggaaagagaaauguccagcguauccaaccgaacuggucuuugcacuugacaauagcuacgacgugacugaagaguccuucaauaagacccgugauauuauuacguccaucgugaacgaccucaauauuagagaaaauaacuguccggugggagcucgaguggcaauggugucauacaacagcggcacaucuuaucugauacgcuggucugauuauaaccgaaaaaaacaacuguuacaacagcucucacaaauuaaauaucaagacacaacagagcccagagaugucggcaacgcaaugcguuucgugacccgaaacguuuuuaaaagaacauacgccggcgcuaauguacgcaggguggccgucuucuucaguaacgggcagaccgcuuccagauccucaauuauaacagcuacuauggaguucuccgcacuggauauuagcccuacggucuuugccuuugacgagagaguguuccuggaagcuuucggauucgauaauacaggaaccuuccaggugauccccguaccaccgaacggagaaaaccagacccuagaaagacugcggagaugugcccuauguuaugacaaaugcuuuccaaacgcguguaucagagaggccuuccuucccgaggauucauacauggaugugguguuucucauugauaacagccgaaauaucgccaaagaugaauuuaaggcugucaaagcccuagugagcucugucauugauaauuuuaauauugccucagauccccucauauccgauucaggcgaccggauugccuugcuuaguuacucaccaugggaaagcucacgcaggaaaauggggaccgucaaaacagaauucgacuucauaacauacgacaaucaacuacugaugaagaaucauauucagacaucauuccaacagcugaacggggaggccacaaucggacgggcucucuuauggacaaccgaaaaucuguuuccagaaaccccauaucugaggaaacacaaaguuauuuucguugugucagccggagaaaacuacgaacgaaaggaguuugucaagaugauggcccugagagcuaagugucaaggcuaugugauauucgucaucucucuaggguccacacgaaaagacgauauggaggaacuggcuuccuacccccuggaccagcaucugauucagcuagggcgcauccacaagccugauuuaaacuacauugccaaauuccuaaagccauuccuguauuccgugagacgcggauucaaucaguaccccccucccaugcuagaagaugccuguagacugaucaacuugggaggugagaacauucaaaacgauggauuucaguuugucaccgaacugcaagaggacuuuuugggcgggaacggauuuauuggccaggaacugaacaguggccgcgagucacccuuugucaagaccgaagauaacggaucugauuaccuggucuaccucccgagccagauguuugaaccacaaaagcugaugauuaauuacgaaaaagaucagaaauccgcagaaaucgcaucccugaccuccggacaugaaaacuauggccgaaaggaagagccagaccacacauacgagccuggagaugucagccuccaagaguacuauauggacgucgcauuucugauugaugccucccaacgcguuggaucagacgaguuuaaagaagucaaagcauucauaacuucagugcuugauuauuuccacaucgcaccuacgccucuuacuaguacccugggugaucguguggcuguuuuguccuauucgccuccaggauacaugccuaauaccgaagaauguccuguuuaccuugaguucgaccucgugacauacaacagcauucaucagaugaagcaucaccuccaagacagucaacaauugaacggagaugucuucauaggacacgcgcuacaauggacuauagacaacguguucgucggaacucccaaccugaggaaaaauaaagugauuuuugugauaagcgccggagaaacaaacagccucgacaaagacguucugcgcaauguuagccucagggcaaaaugccaaggauacucaauauucguuuuuuccuucgggccgaagcauaacgauaaagaacuggaagagcuugcuucucacccccuggaucaccaccuuguacaguuggggcgaacccacaagccagauuggaacuacauuaucaaguucgucaagccuuucgugcaccugauucgaagagcuauaaauaaauauccaacggaagacaugaaggcuacuuguguuaauaugacuucaccuaauccugagaauggcggcaccgagaacaccguguuacuccuucccggcaucuacgaaauuaagacugagaacggcgaccuauuugacgaauucgauucccaggcgcagcacuugcuuguauuagguaauaaucauucaucuggcuccgaaaccgcgaccgaucugaugcaaaaacuuuaccuccucuucaguacugaaaaacuggcuaugaaggauaaagaaaaggcgcaccuugaggaaauaagugcucucguuguagauaaacaacaagaaaaagaagauaaggagauggaagcuacagauauauag

SEQ ID NO: 5373 - RNA, 1674 nt, Artificial Sequence
  Description of Artificial Sequence: Synthetic coding sequence
auuggaagagcguugcucuggacaaccgagaacuuguucccagagaccccauauuugagaaaacacaagguuaucuuuguugugagcgccggcgaaaauuacgagagaaaggaauucguuaaaaugauggcucuaagggcuaagugccaaggcuacgugauauucgugaucagucucgguagcacaagaaaagacgauauggaagaacucgcuucuuacccacuggaccagcacuugauucaacucggacguauucacaagccugacuugaacuauauugcuaaauuccuuaagcccuuccucuacaguguccgaagaggguuuaaccaauacccaccuccuaugcucgaggacgcuugcagacuuauaaaccugggcggggagaacauccaaaaugacggcuuucaguuugugaccgaauuacaggaggauuuuuuaggcgggaacgguuuuauuggacaggagcugaauucaggacgcgaaucgcccuucgucaagaccgaagauaauggcucugacuaucucgucuaccuaccaagccagauguucgagccucagaagcugaugauuaacuaugaaaaagaccagaaauccgcagaaaucgcaucucuaacuucaggccacgagaacuacggacguaaagaagaaccugaucacaccuacgaaccaggggacgucagccuccaagaguauuacauggaugucgcuuuccugaucgacgcgucucagcgggucggauccgacgaauuuaaagaagugaaagcauuuaucacaagcguucuagacuauuuccauaucgccccaacacccuuaaccucgacccuaggagaccgaguggccguguuauccuauucaccccccggguauaugccuaacacagaggaaugccccguguaucuggaauuugaccucgugacguacaacucuauacaccagaugaagcaucacuuacaggauucccagcaacugaauggggauguauucauuggccaugcgcuacaauggacgauugauaacguauucguuggcacacccaaucugcggaaaaauaagguaauauucgugauuucugccggggaaacuaacucguuagauaaggauguacucagaaacgucagucuucgggccaaaugucagggauacuccaucuuuguuuuuuccuucgggccaaaacacaacgauaaagaguuagaggagcuagccucacaccccuuagaccaccaucuagugcaguugggccgaacacauaaacccgauuggaauuauaucauuaaauuuguaaaacccuuugugcaucuuauucgucgcgccaucaauaaguacccuacagaggacaugaaagccacgugugucaauaugacuucuccaaaucccgaaaauggcggaaccgagaacaccguguuacugcugcccggaauuuacgaaauaaagacagaaaacggugaucuauucgaugaauuugacucucaggcgcagcaucuacuugugcuggguaauaaccauuccuccgguucagaaacugcgacggaucucaugcagaaacuguauuuacuguucucuacugaaaaauuggcaaugaaagauaaggaaaaggcacaccuagaagaaauauccgcgcucguaguggauaaacagcaagagaaggaagauggcgaagauacaagaucaucauag

SEQ ID NO: 5374 - RNA, 7581 nt, Artificial Sequence
  Description of Artificial Sequence: Synthetic coding sequence
augaaaauacuccucauuaucuucguuuugaucaucuggaccgagacucucgcagaucaaucuccuggcccgggacccguauacgcugacgugguguuccucgucgacucgagcgaccaccuuggcccaaagagcuuucccuuugugaaaacauucauuaauaaaaugauaaauagucugccuauagaagcaaacaaauaccgagucgcauuggcccaguauucugaugaguuucacucggaauuccaucucucaaccuucaaaggacgcucaccaaugcuuaaccacuuaaaaaagaacuuucaguucaucggaggaucucugcaaauuggcaaggcucuccaggaagcacaccggacuuacuuuuccgcaccuauuaacggacgcgaccgcaagcaguucccuccuauucuuguuguccuggccagcgcugagagcgaggacgagguggaagaagcaagcaaggcucuccagaaggauggagucaaaauuaucucggucggagugcaaaaggcuagcgaggagaaucuaaaagcuauggcuaccucucauuuucauuucaaucugagaacaauucgugaccuguccacauucagccaaaacaugacgcagauuauuaaggacgucacaaaguacaaggaaggagcgguggaugccgacaugcaggugcacuuuccaaucagcugucaaaaagauucucuugcugaucugguauuccucguggaugagagcuuaggaaccggcggcaaccugcgacaccugcagacuuuuuuagaaaacauaacgaguucaauggaugugaaagagaauugcaugagguuaggccugaugaguuauaguaauucagcgaagacaauauccuuucugaaaagcucaacaacccaaucagaguuccagcagcagauaaaaaacuuaucuauucaggucggaaagucuaauacgggcgcagcgauagaucagaugagacgagauggcuuuucugaauccuauggcagcaggcgagcccaggggguuccacagauagcagucuuggugacacacagaccuucagaugacgaggugcacgaugcugcauugaacuuaagacuugaagacgugaacguguucgcuuuaucgauucagggcgcuaauaacacacagcuugaggagauuguaucauacccucccgagcagacgauuucaacucucaaaucuuacgcugaucuggagacuuacagcacaaaauuuuuaaagaagcugcagaacgagaucuggucccaaauuucuacuuacgccgaacagcggaaucuagacaagaccggguguguggauacgaaagaggcggacauacacuuccuaaucgaugggucauccuccauucaagaaaaacaguucgaacagaucaaaagguucaugcuggagguuacugaaauguucucuauugguccggauaaggucaggguggguguggugcaauauucugaugauaccgaggucgaauucuauauuacugauuacaguaacgacaucgaucuacgcaaggccauuuucaacauaaaacaacucacuggagggacauacacaggcaaggcucuugacuacauucuccagaucaucaagaacggaaugaaagaccgcaugagcaaggugccuuguuaccugauugugcugaccgaugguaugagcacugacagggugguagagccagcaaagcgacuaagggcugaacagaucacagugcacgccguaggaaucggugcugcgaauaagauagaguugcaggaaaucgcuggaaaggaggagaggguaucauuuggacaaaauuuugaugcucugaaguccauuaagaacgaagucguccgggaaauuugugccgagaaagggugcgaagacaugaaagccgacauuauguuucucguugacuccucuuggucuauuggaaacgaaaauuuuagaaaaaugaagaucuuuaugaaaaaucuccugacaaaaauucagauuggagccgacaagacacagauuggaguggugcaguuuagcgacaagacuaaggaggaguuucaguugaaucgauacuucacccagcaggaaaucucugaugcaaucgaccgaaugucgcugaucaaugaggggacucugaccggcaaggcuuuaaauuuuguugggcaguauuuuacccauucgaaaggcgccagacugggcgcgaagaaguuccuuauccugaucaccgauggcguggcacaggaugauguucgcgauccagcccgcauccugagagguaaagauguuaccauauucucuguugguguauauaaugccaaccgcucccagcuugaagaaauuucaggugauuccaguuuaguuuuucacguagagaacuuugaccaucuuaaggcacuagaaagaaaacugauuuuuagggugugugcccugcaugacuguaaaaggaucacucuacuggaugucgucuuuguccuugaccauuccggguccauuaaaaaacaauaccaagaucacaugauaaaccuaacuauacaucuugugaagaaagcugacgucggccgcgaucgaguucaguucggagcacugaaauauucggaucaaccaaacauacuguucuacuuaaauaccuauucgaacagaucugccaucaucgagaaucuacgcaaaagaagagacacaggaggaaacaccuacacagccaaagcucuaaagcaugccaacgcccuauucacagaggaacauggcucccgaaucaaacagaacgugaagcaaaugcuaauugugauaacugauggagagucucaugaucaugaucagcugaacgauaccgcucuggaacugagaaacaagggcauuacuauauuugccgucggcgugggaaaagcaaaucagaaggagcuggaagggauggccgguaauaaaaacaauacuauuuauguugacaauuuugacaaguugaaagacgucuucacccugguucaagaacgcaugugcacugaggcccccgaagugugccaccugcaggaggcugauguaaucuuucuaugcgacgguuccgacagggucuccaauuccgauuucgucaccaugacuacauuucuuucggaucuuaucgacaacuuugauauccagucccagcggaugaagaucggcauggcccaauuuggcagcaauuaccaaagcauaaucgaacuuaagaacagcuugaccaaaacccaauggaaaacacagauucagaacgugucgaaaucuggaggauuccccagaauagauuucgcccucaaaaaggugucaaauauguuuaacuugcacgccggggggagacggaaugcuggugugccccagacuuugguagugauuaccaguggcgauccucgauacgacguggcugaugcugugaagacucugaaggaccucggaaucuguguucuggugcuugguaucggagaugucuauaaggaacaucuguuaccuauaacagggaacucugagaaaauuauuacuuuccaggauuucgacaagcugaaaaacguggaugugaaaaagagaauuauaagggaaaucugucagagcugcggaaagacaaacugcuuuauggauaucgugguuggcuucgauauuucuacccacguucagggucaaccauuguuccaggggcacccucaacuggagucuuaccucccagggauacucgaggacauaagcaguauuaaaggggugucaugcggugccggcaccgaggcccaaguuucuuuggccuuuaaagugaacuccgaucagggauucccagcaaaauuccaaauuuaccagaaagcaguguuugauagccuccuccaaguuaacgugucgggcccuacccacuuaaaugcucaauuucuucgcucucugugggacacuuucaaagauaaaagcgcuucccgcggccaggucuuguugauuuucagcgaugggcugcagucggaguccaauaucaugcuagaaaaucaguccgauagacuacgggaagcugguuuggacgcccugcugguagucagccugaauacaaccgcccaucaugaguucuccuccuucgaguuuggcaaacgguuugauuaucgcacgcauuugacaauugguaugagagaguugggaaaaaaguugucacaauaccucggaaauaucgcugaacgcacuuguuguuguacuuucuguaagugucccggcauacccggaccccacggaaccagaggacugcaggcuaugaagggaucacaggggcugaagggcucgcgcgggcacaggggggaagacgggaaucccggggugaggggagauacggggccucagggggauaaagggauugccggcugcccgggggcauggggacagaaaggucucaaaggauuuaguggcccaaagggugggcacggagacgacggaauagaugguuuggauggagaagaggggugccacggauucccaggaaucaagggggaaaaaggugauccagggucccaaggaucaccaggcuccagaggggcaccagggcaguauggggaaaaaggguuccccggagaucccggaaauccaggacagaacaauaacaucaaggggcagaagggcucuaaaggagaacaagguaggcagggaaggaguggucagaaaggggugcaaggguccccaagcagcagggguuccaggggucgugaggggcagcgagguuugagaggcgucagcggagagcccgguaauccuggcccgaccgguaccuuaggcgccgaagggcuccaggguccgcaggggagccaaggcaacccagggagaaagggcgagaaaggcucucagggccagaaagguccccagggcucucccgggcuuaugggcgcaaagggaucaaccgggagacccggauugcuagggaagaagggcgaaccaggacugccgggggaucugggaccuguaggacagacagggcagagaggacgacagggggauagugggaucccuggguauggucagauggggcgaaaaggugugaagggacccagggguuuucccggggaugccggucagaagggggacaucggaaauccuggcaucccaggaggaccggggccaaaaggguucagagggcuugcccucacugugggcuugaaaggugaagaaggaucaaggggauugccaggcccucccggucaacgcgggauuaaaggcauggcaggacaaccaguuuacagccagugcgaucucauucgcuucuugcgagagcauucacugugcagucuugagaaauguccagccuacccuaccgagcugguuuucgcacuugacaauagcuaugacgugacggaggagaguuucaauaaaaccagggauauuauuaccucaauagugaacgauuugaauaucagagagaacaauugcccugucggugcacgcguugcaauggucuccuacaauucuggaaccagcuaucuaauucgguggucugauuacaaccggaaaaaacaguuacuucagcaguugucucagauuaaguaccaggauacuacagagccacgcgaugucggcaaugccaugagauuuguuacucggaauguguucaagcgcacuuacgccggcgccaacguccgacgaguugccgucuuuuucucaaacggucagaccgcuucacgcaguucaauaauuacagcuaccauggaauucucagcacuugacauuagcccgacagucuuugcguucgaugagagggucuuccucgaggcauuuggguucgacaauacaggcaccuuucagguaauacccgugccccccaauggagaaaaucagacacucgaacgacugagacgcugugccuuauguuacgacaaguguuuccccaacgcaugcauucgcgaagcauuuuuaccugaagacagcuacauggauguagucuuucugaucgacaacucacgcaacaucgcaaaggacgaguucaaagcugugaaagccuuagucucaucuguuaucgauaacuuuaauauugcgucugacccgcugauuucugacuccggugauaggaucgcuuuacucuccuacucaccuugggaguccucaagaagaaaaaugggaacuguuaaaacagaauuugacuucauuacauacgacaaccagcuucucaugaagaaucacauucagaccucuuuucagcagcuuaacggggaggcgacgauaggucgugcgcuauuauggacuacugaaaaccuguucccggagacccccuaucuaagaaagcauaaagugauauucgucguuucugcuggggaaaacuacgagcgaaaagaauucguuaaaaugauggcgcugcgagcgaagugucaagguuacgugauauuuguuaucucucuuggcucaacacguaaggacgauauggaggagcuagcuuccuauccccuagaucagcacuuaauucagcugggccgcauccauaagccagaucuuaauuauauugccaaguuccuaaaacccuuccucuacagugugcguagaggguuuaaucaguauccccccccaauguuagaagaugcgugccgacucauuaauuuaggcggugaaaacauccagaaugacggcuuucaguucguuacagaacuccaggaagauuuccucgggggcaacgguuucaucggucaagaacucaacagcgguagagaaucuccauuugugaagaccgaagauaaugggucagauuaucuaguuuacuugccuucccaaauguucgagccccagaagcuuaugauuaauuaugagaaggaccagaaaucugccgaaauugccagucuaacuagcggacacgagaacuauggcaggaaagaggaacccgaucauacuuacgaacccggagacgucagccuccaggaguacuauauggauguagccuucuuaauugacgccucacagaggguggguucugacgaguucaaggaggucaaggcuuucauaaccucuguuuuggacuauuuccauauagccccgaccccauugaccuccacccuaggugacagagucgcuguucuguccuauucccccccaggauauaugcccaauaccgaagaaugcccuguuuaccucgaguucgaucuagugacuuacaauuccauucaucagaugaaacaccaccugcaagauucucaacaguuaaauggcgacguguuuaucggccacgcuuugcaauggacaaucgacaaugucuuuguggguaccccaaaucugagaaagaauaaagugauauuugucaucagcgcuggcgaaaccaauucccuugacaaagauguucuccgaaaugugucauugagagcaaaaugccaaggauacagcaucuucguguuuucauuuggccccaagcacaacgacaaggagcuagaagaacuggcaagccauccacuugaucaccaucugguccaauuaggacgcacacacaaacccgacuggaauuacaucauuaaguuugucaaaccauucgugcauuugauaaggagggccauaaacaaguaucccacugaagacaugaaggcgacaugcgugaacaugacuagcccuaacccugagaauggaggaacggagaauacuguacugugguag

SEQ ID NO: 5375 - RNA, 1332 nt, Artificial Sequence
  Description of Artificial Sequence: Synthetic coding sequence
aaccaauauccaccuccuaugcuggaggaugccugcagacucauuaaccugggaggcgaaaacauacagaacgacgguuuucaauuugugaccgaacugcaggaagacuuuuuaggggggaauggguuuauuggacaagaauugaacucaggcagagagucuccauucgugaagaccgaagauaacggaucagacuauuugguguaccugccuucacaaauguucgaaccacagaaacugaugauaaauuacgagaaagaucagaagucugccgagauugcuucacuuacuaguggccacgaaaauuaugguaggaaagaagaaccagaccacacauacgagcccggugaugugucccuacaggaguauuacauggacguggccuuccugauugacgcgagccagagaguggguagcgacgaauuuaaggaggucaaagcuuuuauuaccucugugcucgacuacuuucacauugcgccaacaccucuaacuagcacccuuggagaccgaguagccguucuuucguacagucccccaggauacaugccuaauacugaagaaugccccguguacuuggaguucgauuuaguaacauacaacuccauacaucaaaugaagcaccacuuacaggacucgcagcagcucaacggugacguguucaucggccacgcacuccaguggacuaucgauaaugucuuuguggggacaccuaaucucagaaaaaauaaaguuauauucgugaucuccgccggugaaacaaauuccuuggauaaggacgugcugcgcaacgugucccuucgcgcuaagugccaggguuauaguaucuuugucuucucauucggaccaaagcacaacgauaaagaacuggaagaacuggccucacacccccuagaccaccaucuggugcaacuuggccggacucacaagccagacuggaacuacaucauuaaauuuguuaagcccuuugugcaucugauacgccgcgccauaaacaaauaccccacagaagauaugaaggccacuugcgugaauaugacuuccccgaaucccgagaacggugggaccgagaauaccguccugcuuuuacccggcauauaugaaauuaagacagagaacggcgaccucuuugacgaauuugacucucaagcacagcaucuguugguuuuaggaaauaaucauucaucaggcuccgagaccgccaccgacuuaaugcagaaauuauacuuacuauucaguacagagaaacuugcgaugaaagauaaagaaaaggcucacuuagaagaaaucuccgcacugguuguagauaagcagcaggaaaaagaggaccuguag

SEQ ID NO: 5376 - RNA, 6792 nt, Artificial Sequence
  Description of Artificial Sequence: Synthetic coding sequence
augaugcuucugauacuguuccuggucauaauaugcagccauauaucuguuaaccaagacucagggccugaauaugcugaugugguuuucuuaguggauuccucugacagacuuggaucaaagucauuccccuucgucaaaauguuuaucacuaaaaugauuuccucccugccaauagaagccgacaaguaccgagucgcccuugcccaauacagugacaagcugcacucugaguuccaucugaguacauuuaaggguagaucccccaugcugaaccaucuuaggaagaauuucggcuuuauuggcggcucccuacagaucgggaaggcccuccaggaagcgcaucgaacuuauuuuucugcccccgccaauggccgcgacaaaaagcaauuucccccaauccucguugugcuggcuuccucagaauccgaagacaacgucgaagaggccagcaaagcgcucagaaaagacgguguuaagaucaucuccgugggaguccagaaggccuccgaagaaaaucucaaagccauggcuaccucgcaguuccauuucaaucuuagaaccguaagagacuuaucuauguucucucagaacaugacacauaucauuaaggacgucaucaaauacaaggaaggagcaguggacgauauuuuuguagaggcgugccagggcccauccauggcugacgugguguuucuucucgacaugagcaucaacggguccgaggagaauuuugauuauuugaaagguuuuuuggaagagagcgucucggcucuggacauuaaggaaaauugcaugagagugggacugguggcguauagcaaugagacuaaaguuauaaacagccuuuccaugggaauuaauaaaucugaggucuugcaacacauccagaaucugaguccccgcacaggaaaagccuacacuggcgccgcuauuaagaaacugcgaaaggaaguguuuucugcgcguaacgggucccgcaaaaaccagggagucccgcagaucgcugugcucguuacacaccgcgacagugaagacaacguuacuaaggcugcuguuaaucuuagaagagaggggguuaccauuuuuacauugggcauugaaggagcguccgauacacagcuggaaaaaaucgcgagucacccugcugagcaguauguaaguaagcugaagacuuuugcagauuuagccgcccauaaucaaacauuccugaagaaauuaagaaaucagauuacccacacaguguccguguucagcgaacgcacagagacccucaagagcgguugcguugauaccgaagaagccgacauauacuugcugauugauggaucaggaucuacacaggcuacagacuuucaugaaaugaaaaccuuccuaucugaagugguuggcauguucaacauagcuccccauaaggugcgagucggcgccgugcaguaugccgauagcugggaucuggaauuugagauuaacaaauacagcaacaaacaggacuuagggaaggcaauugagaacauacgucagaugggagggaacacaaacacaggggcagcccuuaauuucacgcucagccugcuccaaaaggccaagaaacagcgaggcaacaagguaccaugccacuuagucgucuugacaaauggaaugucaaaggacucuauauuggagccugccaacagacucagggaagaacauauucggguuuaugcuauaggaauaaaggaagcuaaucaaacucaauugcgggaaaucgcgggugaggaaaaaagaguuuauuacgugcaugauuuugaugcacugaaagacauuaggaaccagguaguacaggagaucugcaccgaagaagcauguaaagaaaugaaggccgauauuauguuccucgucgauagcucugguaguauaggucccgaaaacuuuucaaagaugaagacuuuuaugaagaaucucguguccaaaucgcagaucggacccgaccguguccagaucggcgucgugcaauuuagugauauaaacaaagaggaguuccaacugaacagauucaugagccaguccgacaucucgaacgcgauagaccagauggcccauauuggacaaacaacacugaccggcucugcucucaguuucguuucgcaguauuuuagucccaccaagggcgcccggccaaauaucaggaaauuccucauucuuauuaccgacggagaggcccaggacauuguuaaagagccagcggugguccugcgacaggaggguguuauuauuuauuccgugggaguguucggcucaaaugucacucagcuagaagagauuuccggcagacccgagaugguguucuauguggaaaacuucgauauuuuacaacgaauagaagacgaucuuguguucgggauuugcucaccacgcgaagaaugcaaacgcaucgaggugcuggacguuguguuugucaucgacaguagcggauccaucgacuaugaugaguacaauauuaugaaagacuuuaugauugggcugguuaaaaaagcagacgucgggaaaaaucaggugagguucggagcacugaaauaugcggacgacccagaagugcuguuuuauuuggacgacuucggaaccaaauuagaagugaucagcguccugcaaaacgaccaggcaaugggaggaaguacauacacggcagaggcccuuggcuucucagaucauauguucacagaggcccgcgggucccggcugaauaaaggugugccacaagugcugauugugaucacagauggagagucacacgaugcugauaaacuuaaugcuaccgcaaaagcccugcgcgacaaaggaauucugguccuggccgugggcauugacggcgcuaauccuguugaacuccuggcaauggccggcucuucugacaaauauuucuuuguggagacauuugggggucucaaaggaaucuucagugacgugacugcgagugucugcaauuccucuaaaguugacugcgagauugauaagguagaccuugucuucuuaauggauggcucaacaucaauccagccaaaugauuuuaaaaaaaugaaagaauuccuugcgucugugguucaggacuucgacgugucacucaaccgggugagaaucggugccgcacaguuuagugauacuuaccauccggaguuuccauugggcaccuucauuggcgagaaagaaaucagcuuucagaucgagaauaucaaacagauuuucggcaacacacauaucggcgcggcccugcgggagguggagcacuacuuuagaccugauaugggcucuagaauuaauaccgggaccccccaaguucuccucguccugaccgacggccagagucaagaugagguggcacaagccgccgaagcccugcgacauaggggaaucgacauuuauagugugggaauuggcgacguagaugaccagcaacuaauccagauaacggguaccgcugagaaaaagcugaccguacauaauuuugaugaacuuaaaaagguaaauaagagaauagucaggaauauuugcacaacugcgggcgagagcaauuguuuuguugauguuguggugggauuugacgugagcacacaggaaaagggacagacucuuuuggagggacaaccguggauggagacauaccugcaggacaucuuacgugcaaucucgucuuuaaacggcgucaguugcgaagucggcacugaaacccagguuucuguagcuuuucaggucacuaacgccauggaaaaguauuccccaaaauucgagauuuauucugagaacauucucaauucucuuaaggacaucacugugaaagggccuucauugcugaacgcuaaccuccucgacucccugugggauacauuccagaauaaaagugcagcacgcgggaaggugguacugcucuuuuccgaugggcuagaugaugacguugaaaagcuagaacagaaaagcgaugaacugagaaaagaaggccucaacgcucucauuaccguugcgcucgauggaccugcugacuccucagaucuggcugauuugcccuacaucgaguucggaaagggcuucgaauauagaacacagcugucaauuggcaugcgagagcuaggaucucgccuuagcaaacaauuagugaacguagcugagcgaacauguugcugccuauuuuguaaaugcaucgggggggauggcacaaugggagacccugggccaccaggcaagcguggcccgccugguuucaaaggcucugagggcuacuuaggagaggaggggauagcaggugagaggggagcuccuggaccggugggagagcagggaacuaagggauguuacgguacaaaggguccaaaagggaaucgcggccucaacggacaagagggcgaaguuggcgaaaacgguaucgauggacugaauggcgaacagggagacaaugguuuaccagggagaaaaggggagaagggggacgagggaucacaaggaagcccaggcaaacgcgguaccccgggcgacagaggagccaaggguuugagaggcgacccaggcgcgccaggaguugauucaagcauugaaggaccaacgggacucaaaggugagagggguagacagggcagaagaggauggccaggcccuccuggaaccccuggcagccgaagaaagacagccgcucacggucgaaggggacacacaggcccucaggguacugccgguaucccuggacccgacggguuggagggaagucucgggcugaagggaccacaggggccucgcggagaggcgggcgugaaaggcgaaaagggggguguugguuccaaagguccucagggcccgccaggaccggguggggaggcugguaaccaggguagauuagggagccaggggaacaaaggggaaccaggcgaccuaggggagaaaggggcugugggauuuccaggacccagggggcugcagggaaacgauggauccccaggauacggaucuguaggcaggaagggugcuaaaggacaggaaggguucccaggcgaaagugggccaaaaggagagaucggcgacccaggcggacccggcgaaacuggacucaagggagcucgaggcaaaaugauauccgccgggcugccaggcgagauggggucaccgggggagccagggccuccagggagaaagggaguuaaaggcgcuaaaggucuggcuaguuucagcaccugcgaacugauccaauaugugcgcgacagaagcccuggucgacauggcaagccugaguguccaguacacccuacugagcuuguguuugcacuagaucacucuagagacguaacugaacaagaguucgagagaaugaaggagaugauggcauucuuagugagggacaucaaggucagggaaaauagcugcccugugggagcgcauaucgcaauucuuagcuauaauucccacgcuagacaccuugucagauucagcgacgccuacaagaaaucccaguugcugcgagaaauugaaacuauaccuuacgagcgcagcucugcauccagagagaucggcagggccaugagguuuaucagcagaaacgucuuuaagagaacauugcccggagcccacacccgcaaaauagccacguucuuuucuuccggccaguccgcugacgcccauagcaucacuacagccgccauggaauuuggcgcacuggaaaucaucccaguugucauuacuuuuucuaacguaccuagcgugcgccgggcuuuugccauagacgauacaggaaccuuccaggucaucgugguacccaguggagccgacuauauucccgcacuugaacguuuacaaaggugcaccuuuuguuacgauguuugcaaacccgaugcaucuugugaccaagcccgcccaccccccgugcaaaguuauauggacgcagccuucuuacuagaugccagccgcaacaugggcucggccgaauuugaagacauucgggccuuccugggagcgcuccuggaucacuucgaaaucacccccgaaccggagaccuccguuaccggcgacaggguugcguuacucucccacgcuccccccgauuuucuuccaaacacucagaagaguccuguccgggcagaauucaauuugaccaccuaucgaucgaaaagacuaaugaaaaggcauguucacgagaguguuaagcagcuuaauggggacgcauucauaggucaugccuuacaguggacucuagacaacguauuccucuccacaccuaaccuaagacgaaacaaaguaauuuuugugauuucugccggagaaacuagucauuuggauggcgaaauauugaagaaggagucccugcgggcgaagugucaaggguaugcuuuguuugucuuuucucuaggcccaaucugggaugacaaagaacuugaagaccuggcaucucauccacuugaccaucaccuaguacagcuggggcgcauccacaaaccugaccacucguacggcgugaaguucguuaaaucuuucauaaacagcaucaggagagccaucaauaaauauccuccaauuaauuuaaaaaucaaaugcaaucgccugaauagcauagauccuaagcaaccgccaaggcccuuuaggucuuuuguuccuggaccccucaaggcuacauuaaaagaagaugugcugcagaaagcuaaguucuuccaggauaagaaguaucucucccgcgucgcccgaaguggccgugaugaugcgauacagaauuuuaugcggucuacaucucacaccuucaaaaacggcaggaugauugagucagccccuaagcaacaugauuag

SEQ ID NO: 5377 - RNA, 6792 nt, Artificial Sequence
  Description of Artificial Sequence: Synthetic coding sequence
augaugcugcuaaucuuguuccucgucauuaucugcagccauauuagcgucaaccaagacagcggacccgaguacgcugacguuguuuuccucgucgacucgucugaucgccuuggcucuaaaaguuuccccuucgucaaaauguucauuaccaaaaugauuucaagccuuccuaucgaagccgauaaauaucgaguggcuuuggcccaguacucagacaaauuacacagugaauuccaucugucaacuuucaaagguaggucuccgaugcugaaccaccucaggaaaaauuucgguuucauuggggguaguuuacaaauugggaaagcucugcaggaggcccaccgaaccuacuuuucagcucccgcgaacggccgugauaaaaaacaguuucccccuauccuuguuguacuggcaucuagugagagcgaagauaauguagaagaagcuucaaaggcccugcgaaaggacgguguuaagaucauaucugucggcgugcagaaagcuagcgaagaaaacuugaaggcaauggcgaccagccaguuucacuuuaaucuccgcaccgucagggauuugagcauguucagccaaaacaugacccauauaaucaaagaugucauuaaguacaaggagggcgcuguagacgauauauucguugaggcgugccagggcccuaguauggccgacguaguauuucugcuggauaugucaauuaauggcagcgaagagaauuucgauuaucugaagggguuucuggaggagagcgugagcgcauuggauauaaaagagaacuguaugcgcguuggguuaguggcauacucaaaugaaacuaaagucaucaauucucugagcauggggaucaacaagucggagguucugcaacauauucaaaaccuaaguccaagaaccggaaaggccuacacuggcgccgccaucaagaaacugcgcaaggaagucuucagcgccagaaacgguucacgcaagaaccagggugucccucagauugcugugcugguuacgcauagagacucggaggacaacgugacuaaggcagccgucaaucugcgccgugaaggaguuacuauuuuuaccuuaggaaucgaaggagccagcgauacacagcuggaaaaaaucgcuagucaucccgccgaacaauauguuaguaagcuuaaaacauucgccgauuuagcagcacacaaccagacauuucuuaaaaaacucaggaaccaaaucacacacacagugagcguguucagcgaaagaacugagacccuaaagucugguugcguagauacagaggaagccgauauauaucuacucaucgacgguucagggagcacucaagccacagacuuccacgaaaugaaaacauuuuuaagcgagguggugggcauguucaacauagcgccgcacaagguucgagucggcgccgugcaguaugccgacaguugggauuuagaauucgagaucaauaaguacucuaacaaacaggaucugggcaaagccauagaaaacauucgccagaugggaggaaauacaaauaccggggcugcacugaacuuuacauuaagucuguuacaaaaagcgaaaaagcagagggggaauaaaguuccuugccaccugguggugcuuacuaacggcauguccaaggacagcauucuggaaccugcaaaccgauuacgcgaggagcacauccgcguuuacgccauuggcaucaaagaagcuaaccaaacccaacuuagggagaucgcaggagaagaaaagcgugucuauuacguccacgacuuugaugcacugaaggacauaaggaaucaaguggugcaagaaauuugcacagaagaagccugcaaagaaaugaaagccgauauuauguuccugguugacagcuccgggagcauaggcccugagaauuucaguaaaaugaagacauuuaugaaaaaccucgucuccaaaucccagauugguccagacagaguccagauuggaguuguacaguuuucggacaucaacaaggaagaguuucaacuuaacagguuuaugucucaaucagacauuucuaacgcaaucgaucagauggcucacauuggucagacuacucuuacuggaucagccuuaaguuuugugucucaguacuuuuccccaacaaaaggagcgcggccgaauauacggaaguuuuuaauccugaucaccgacggagaggcccaggauauuguuaaggaaccagccguugucuugagacaggagggggucauuaucuacucuguuggcguguucggcuccaaugugacacaacuggaagaaaucagcgguaggccugaaaugguauucuacguggagaacuucgauauucuacagaggauugaggacgacuugguuuuuggcauuuguucgccaagggaagaguguaaaaggaucgaaguacuagacgucguauucguuaucgacagcuccggaucuauugacuacgaugaguacaacauuaugaaagauuuuaugaucggccucgucaaaaaagcagauguaggaaagaaccaagugagguucggugcccuuaaauacgccgaugacccagaaguuuuguucuaucucgacgacuucggcacaaaacuggaagugauuagugugcuucagaaugaccaggccaugggaggcucgaccuauacagcagaagcucucggauucucugaucacauguuuaccgaagcccgcgguucacgccuuaacaagggugugccucaaguacugauuguaauuaccgacggcgaaucccacgaugcggacaaacugaacgcuacagcuaaggcauugcgugacaaagggauuuuaguucuggcagugggaauugacggcgcuaauccaguagagcuuuuagcaauggcuggaucgagugauaaauacuuuuucgucgaaacuuuuggcgggcucaagggcauuuucuccgacguuaccgcaagcgugugcaacaguuccaaaguugacugcgaaaucgacaaaguugaccuggucuucuugauggaugggucuacuaguauucagcccaaugauuucaagaaaaugaaagaguuccucgccagcgucgugcaagacuucgaugugagccucaaucgcguuaggauaggugccgcacaauucucagauacuuaucacccugaauucccgcuuggaacuuucauaggcgaaaaagagauuagcuuucagaucgagaacaucaaacaaauauucggcaacacucacauaggcgcagccuugagggaaguggagcauuacuuuagaccagacaugggaagcaggaucaauacuggcaccccacagguguugcuuguucuaacagacggccagagucaggacgaaguggcucaggcggcagaagcacugagacaccggggaauagacauauauagcguggguaucggggauguggaugaucagcaguugauccagauaacaggaacagccgagaaaaaguuaacgguucauaacuuugaugaacucaagaaagucaacaagcguauaguucgaaauauuugcacaaccgccggcgaaucaaauuguuuuguggaugucgucgucggcuucgaugugaguacacaggagaaagggcagacacucuuggagggccagccauggauggaaacauauuugcaggauauauugagggcaauuucuucacugaacggcgugucaugcgaagucgggaccgaaacccaagugucagucgcauuccaggugaccaaugcaauggaaaaguacagcccuaaguuugaaauuuacucagagaacauuuugaacucucuaaaggauauaaccgugaaaggcccaagccuguuaaaugcuaaccuccuggauagucugugggauacauuccaaaauaaaagugccgccagagguaaagugguccugcuguuuucugaugggcucgacgacgacguggagaaacucgaacagaagagcgaugaacugagaaaggagggccuuaaugcauuaaucaccguggcacuugaugggcccgcggacagcuccgaucuggcagaccuacccuauauugaguucggcaaaggcuucgaauaucgcacucaacuuaguaucggcaugagggagcucggaucaagacugucaaagcaacuuguaaaugucgcugaaagaacuugcugcugccucuuuugcaaauguaucgguggagacggcacaaugggugacccugguccccccggaaaaaggggaccaccuggauuuaagggcagcgagggauaucugggcgaggaggggauugcaggggagagaggggcccccggacccgugggugaacagggcacaaaagggugcuaugggacaaagggaccaaaggggaaucggggacugaacggacaggaaggggaggugggagaaaacgggauugacggccuuaauggcgagcagggggauaacgguuuaccgggaagaaagggcgagaagggggacgaaggcagucagggaucucccggaaagagaggaacaccaggggaccgaggggcuaaaggauugagaggcgaccccggagcuccagggguggauagcuccaucgaggggccaaccggacuaaagggcgagcgugguaggcagggacgaaggggguggcccgggcccccagguacgccaggaaguaggaggaaaacagcggcccauggcagacgcggacauaccgguccacagggaacugccgggauccccggcccggacggccuggaaggcagcuuaggcuuaaaagggccacaaggaccgcguggggaggcuggcgugaaaggcgagaagggcggcguggggucaaagggaccacagggcccacccgggccuggaggugaggcuggcaaucaaggaagacucggcucacaagguaacaagggagaaccaggugaucuuggugaaaagggagcagugggauucccgggaccaaggggacugcaggggaacgauggaucacccgguuacggcagcguaggccggaaaggcgcuaaggggcaggagggcuucccaggugaaucuggaccgaagggagagaucggcgacccaggagggccaggggagaccggacugaagggugcuaggggcaaaaugaucuccgccggcuugccaggagaaauggguuccccaggagagccagggccuccaggucgcaaaggugucaagggugcaaaggggcuggcuaguuucaguacgugugaguugauucaauacguaagggaccgcuccccaggacagcauagaaagcccgaaugccccguccauccuacugagcuagucuuugcccuugaccauucccgggauguuacugaacaggaguuugaacgaaugaaagagaugauggccuuccuagugcgggauaucaaggugagggagaacaguugccccguuggugcucacaucgccauacugagcuacaacucccaugcccgacauuugguccguuuuucagaugcuuauaagaagagucagcuacugagggaaauugaaacuauccccuacgagaggucuagcgccaguagagagaucggcagagccaugcgauucauuaguagaaacguguuuaagcggacucucccaggagcccacacucgaaagauugcaacuuuuuuuucauccggacagucggccgacgcgcacucaaucaccacugccgcuauggaauuuggggcuuuggagauuauccccguggucaucacuuuuucuaacguccccucuguaagaagggccuuugccaucgaugauacaggaacuuuucaagugaucgucgugccguccggggcagauuacauucccgcucuugaaagacugcagaggugcacauucugcuacgacgucugcaaaccagacgccuccugcgaccaggcgagaccaccucccguucagaguuacauggaugcugcuuuucugcuagacgcaagccguaacauggguucugccgaguuugaagauauucgggccuuucuuggugcccugcuggaccacuuugaaaucaccccugagccggagaccuccgugaccggugacagaguagcccugcuaucacaugccccaccagacuuccuuccaaacacacagaaauccccaguccgcgcggaguucaaccucacgaccuaucgcagcaagagacucaugaaacggcacgugcaugagaguguuaaacagcucaacggcgacgcauucaucgggcacgcccuucaauggacccuagacaacgucuuccuuucgacacccaaccuccggagaaacaaagugaucuuuguuaucucggccggcgagaccucccaccuggauggcgaaauccucaaaaaagagucacuacgagccaagugucagggguacgcucucuucguauucucacuaggccccaucugggacgacaaggaacucgaggaccucgccucccacccucucgaccaccaccuuguacaacuuggcaggauccacaaaccagaucauuccuacggaguuaaguuugugaaaucauucauuaauucuauacgcagggcaaucaauaaguauccaccaauuaaccucaagauaaagugcaaccggcugaauagcauugaucccaagcagccaccucggccauuucgguccuucgugccgggcccacuaaaagccacguugaaagaggacguucuccaaaaggcaaaguuuuuucaggauaagaaauaucugagcaggguagcucguuccggacgcgaugaugcaauucagaacuuuaugagguccacuucgcacaccuucaagaacggcagaaugaucgagucagcccccaagcagcaugauuag

SEQ ID NO: 5378 - RNA, 5211 nt, Artificial Sequence
  Description of Artificial Sequence: Synthetic coding sequence
auggaaagaugcagccgcugucaccgccuucuacugcuucucccucucguccugggacuuagcgccgcaccuggcugggcuggagcaccgccugucgacgugcugcgagccuuaagauuuccgucccuccccgauggcgugcggcgcgcaaagggcauuugucccgccgacgucgcauaccggguugccaggccugcccaauuaucagcuccuacaaggcaacuguucccugggggguuucccaaagacuuuucguuauugacugugguuagaacuagacccggacugcaagccccucuacucacccucuacucagcccagggagugaggcagcuaggucuugagcucggacgaccagugagauuccucuacgaagaucagacgggaaggccacaaccccccucacaacccguguuccgcggcuugagucucgcagacgguaaguggcacaggguugccguugcagugaaaggacaauccgucacucuuauaguugacugcaaaaagcgagugaccaggccccuuccucggagcgcgcgacccgugcuggacacacacggcgugauuaucuucggcgcuagaauccuggacgaagaagucuuugagggugauguacaagagcucgcuauuguuccaggaguccaggcugcguacgagucaugcgagcaaaaagaauuagagugugaaggaggacaaagagagaggccucagaaccagcagccccaccgggcacagcgguccccccagcaacagccuaguagacuucacaggccccaaaaccaagagccacaaagccagccaaccgagucccuguauuacgacuaugagccuccuuacuaugaugucaugaccacgggcacaacacccgacuaccaagauccaaccccgggcgaagaggaggaaauacucgagagcucuuuauugccgccucuggaggaagagcagaccgaucuccaagugccccccaccgccgauagauuccaggcagaggaguauggcgagggugggacagauccaccugagggaccuuaugacuauaccuacggauacggcgacgacuacagagaagagaccgaauuagguccugcccugucagcugagaccgcacauucaggagccgcugcccacggccccaggggccugaaaggagagaagggcgaaccagcaguacuggaacccgggauguuaguggagggaccgccagggccggaaggacccgcuggacugauuggaccuccaggaauucaggguaacccuggcccggugggcgaucccggagagcggggucccccaggcagagccgguuugccaggcagcgauggcgcucccggucccccaggaaccucccuuauguuaccguuuagauucggcuccggcggaggcgauaaagguccggucgucgcagcucaagaggcacaggcucaggccaucuugcagcaggcaagauuggcauuacgcggaccuccagggcccaugggcuacacaggacgaccagguccucuagggcagccuggcucgccaggucuaaagggggaaaguggcgaucugggcccacaggguccucggggaccacagggacugacaggcccgccaggaaaggccggcaggagagguagggcaggugccgacggggcccgcggaaugcccggcgauccuggggugaagggcgauagaggguuugacggacugccaggccuuccuggugagaagggucacaggggcgacaccggcgcacaaggacugcccgggcccccaggggaagauggagaacgcggcgaugauggagagaucggaccacgaggguugccaggcgagucagggccacgugggcugcugggccccaaaggaccaccuggaauacccggcccaccuggagucagaggaauggauggaccacagggcccaaaaggaagccuugggccccaaggggagccugguccccccggccagcaaggcacccccggcacccagggccuucccggaccucagggagcaaucggaccucacggcgagaaaggcccucaggggaaaccaggacuaccagggaugccgggaagcgacggcccaccaggacaccccggcaaggaaggacccccaggcacaaagggcaaucagggaccaucagggccgcagggaccucuuggcuacccagguccccgugggguuaaggggguggacggcauucggggucugaaaggccacaaaggugagaaaggcgaggauggguuuccaggguuuaagggcgauauuggagugaagggagauagaggcgaggugggagugcccgguaguagaggggaggacggaccagagggacccaagggacggaccggaccaacgggagauccugggccacccggucugaugggugagaagggcaagcuggguguuccgggacucccuggcuaccccgggcgccaggggcccaaagggagucuuggauucccugguuuuccuggagcguccggugaaaaaggggcccguggacucucaggcaagaguggaccccgaggugagagaggaccuacaggcccaaggggacagcgcggaccacgaggggccaccggcaagaguggagccaaaggcacguccggaggcgacgguccccauggacccccgggagaaagaggucucccaggaccgcaggggccuaacggcuuucccggccccaaaggaccacccggaccuccuggcaaagaugggcuaccuggccauccuggucagcggggggaggucggauuucagggaaagaccggaccaccuggaccacccgggguugucggaccacagggcgcugcuggagagaccgguccuaugggagagagagggcaucccgggcccccaggucccccgggagaacaaggauuaccugggaccgcugggaaggaaggcacuaagggcgacccagggccaccaggagccccuggcaaggacgguccugcuggacugcgggguuuucccggggagcgaggguugccaggcaccgccggaggaccugguuugaaggggaacgagggacccucuggcccgcccgguccggcugguagcccgggcgagagaggcgcagcuggcuccggcggacccaucgggccaccugggcguccuggcccucaggguccaccaggagcugccggagaaaaagggguuccaggcgagaaaggaccaauuggucccacuggaagggauggggugcaaggcccaguuggauuacccgggcccgcagggccgccuggaguagccggggaagauggcgacaagggcgaggugggcgauccuggacagaaagggacgaaagggaacaaaggugagcauggaccccccggaccaccuggcccuaucggucccgugggacaaccgggggcugccggcgcagauggcgagccuggcgcuagagggccucagggacacuuuggcgcuaagggggacgaagguacacgaggcuucaauggcccccccgggccaaucgggcuccagggacucccagggccuagcggcgagaagggcgaaacuggggauguugguccuauggggccccccggccccccuggaccucgagggccugccggccccaacggcgcugacggaccccaaggaccacccgggggggugggaaauuugggaccacccggggagaagggagaaccaggagaauccggcagcccaggcauacaaggagaacccggagugaaaggaccaagaggcgagcgcggcgaaaagggugagucuggucaacccggugagccagguccacccggaccaaaagggccaacuggcgacgaugggccaaagggaaauccaggucccgucggauuucccggagacccuggaccuccaggugagggcgggcccagagggcaggacggugcuaaaggcgaucguggugaggacggggaaccaggacaaccugguucuccaggcccuacaggggagaaugggccacccggcccccucggaaaacgcggccccgccgggucccccgguagugaaggcaggcaaggcggaaagggcgcaaaaggggacccuggggcuauuggcgcacccggcaagacagggccuguagguccagccggaccugccgguaaaccaggaccagacggucuacgcggucugccugggucagucggacagcagggacggcccggagccacaggacaagccgggccacccggucccguuggcccucccggccucccagguuugaggggagacgcgggagcuaagggcgaaaagggucauccaggacuuaucggacugaucggcccacccggugaacaaggagaaaagggcgacagagguuugccuggcccccaaggcucaccgggccagaaaggagagaugggcauccccggggcaucgggucccauagguccagggggcccucccggucuacccgguccugcuggaccuaagggagcaaagggcgcgacuggacccggcggaccuaaaggggaaaagggaguacagggaccuccaggccaucccggaccaccuggcgaaguuauccagcccuugccaauccaaaugccaaagaagaccagaaggucuguugacggauccaggcugaugcaagaagacgaggcaaucccuaccgguggugcaccugguuccccaggcggacuggaagaaaucuucgguagucuugacagccuuagagaggaaaucgaacagaugaggcgcccaaccggaacacaggacucaccagcucgcaccugccaagaccucaaacuuugucaucccgaacugcccgacggggaauauugggucgaccccaaccaggguugugccagagacgcguuccgcguguucuguaacuucacagccggaggagagaccugcguuaccccuagagacgauguuacucaguucagcuacguagauucugaggguucccccguuggcguuguccaacugaccuuuuuacggcuccuuagcguaucugcucaucaagacgugagcuaucccugcuccggugccgcacgagauggcccccugagacuucgcggcgccaaugaagacgagcucaguccugaaacaaguccauaugugaaggaauucagggauggcugccagacccagcaggggaggacuguguuagaaguccguacuccgguucuggaacagcugcccgugcuugaugcaaguuucuccgaccugggcgccccccccagacgaggaggcgugcuacuuggcccugugugcuuuaugggauag

SEQ ID NO: 5379 - RNA, 5148 nt, Artificial Sequence
  Description of Artificial Sequence: Synthetic coding sequence
auggaacgcugcucuaggugccaucggcuccuuuuguugcuaccguuaguauuaggcuuaucugccgcuccugggugggccggagcaccucccguggacguccuucgugcccuccgguucccaucucucccagauggaguaagaagggccaaaggcauuugucccgccgacguggccuaccgaguagcgagaccagcccagcugagcgcuccaacccgccaacuguucccuggcgguuuuccaaaggacuucucauuguuaacugugguucgcacgcgcccaggucugcaagcccccuuacucacauuguacagcgcacaggguguccggcaacuuggucuggaguuaggacgucccguaagauuucuguaugaagaccaaacgggaagaccccagccuccaucucagcccgucuuucgcggacuuucucuggcagaugggaaguggcaccgagucgccguggcugugaaaggccagagugugacucucauagucgauugcaagaaaagaguuacacgcccacuaccucgaagcgcccggccuguccuggauacucacggugugaucauauuuggagcaaggauucuagacgaagagguguucgaaggggaugugcaagagcuggcaauaguucccgggguccaggccgcauaugaaucaugcgagcaaaaagaauuagagugugagggugggcagcgcgaacgaccccagaaucaacagccacaucgcgcccagcgauccccucagcaacagccuucccgacugcaucggccgcagaaccaggaaccucagucacagccaaccgagucacuauacuacgauuacgagccuccuuacuacgaugucaugacaacaggcacuacccccgauuaucaagaacaaacagauuugcaagugcccccaaccgccgacagauuucaggcagaggaauauggagaagggggcaccgacccgccugaagggccuuaugacuauaccuauggcuacggcgaugacuaccgagaggaaacagagcuugguccggcucugagugccgagaccgcucacaguggagccgcugcacacggaccccgugggcugaaaggugagaaaggagaaccugcuguccuugaaccugggaugcucguggaaggacccccuggucccgaaggccccgcaggccugauugguccucccggaauacaaggcaacccagggccagugggugauccaggugaaagagguccgccuggccgagcagggcuacccggcagcgauggugcaccuggcccaccuggcacaagccucaugcugccauuccgcuuuggcucagguggcggugauaaggggcccguuguggccgcacaagaggcacaggcucaggcuauccugcaacaagcacggcuggcguuaagaggcccuccaggcccaaugggauacacaggcagaccugguccgcuuggucagcccggcucucccggucuaaagggugaaucuggugaccuggggccacaaggcccccgcgggccgcaggggcucacugguccaccuggaaaagcgggcagaagagggcgcgccggcgcagauggagcacgcggaaugccaggagauccugggguuaaaggggacagaggguuugacggacuaccuggguugcccggagaaaaggggcauaggggcgacacaggcgcucagggccuuccaggaccaccuggcgaagacggagagcggggcgaugauggcgagaucgggccacgcggacugccuggugaaucagguccuagaggccuucucgggccaaaaggcccucccgggauuccugguccacccggcgucagggguauggaugguccacagggucccaagggaagccuuggcccucagggagaaccaggucccccgggucagcaggggacgccaggcacacagggacucccuggcccacaaggcgccaucgggccucacggagagaaaggaccacaaggaaaacccggccugcccgguaugccagggagugacggcccgccuggucaccccggcaaggaagguccaccagguaccaaaggaaaucaggguccaaguggcccucagggcccguuagguuauccaggcccuagaggcguuaaggguguugaugguauccgugggcugaagggccacaaaggcgaaaagggagaagauggguucccaggauuuaaaggcgacauuggcguuaaaggugaucggggggaaguaggagugcccggaucccggggagaggacggacccgaggggccgaaagguaggacaggaccaacaggcgaucccggcccaccuggcuugaugggagaaaaaggcaagcucggggugccaggucuaccagguuauccaggacgucagggccccaaagggagucugggauuuccuggcuuucccggugcaucuggugagaagggagccagaggucucagcggaaagagcggcccgagaggugaacgcggaccaacuggacccagaggccaacgcggaccaagaggcgcaacaggcaagagcggugcaaaagguaccucuggaggggacgggccgcauggcccuccuggagagcggggauugccugggccccaaggaccuaaugguuuucccgggcccaagggaccacccggacccccugguaaagacggacuaccuggccaucccggacaacggggugaaguugguuuucaggguaaaacaggcccgccaggaccacccggagucguugggccccaaggcgccgcuggugagacgggaccaaugggcgaaagaggacacccagggccucccgguccccccggggagcagggauugccuggaacggcuggaaaagaagguacgaagggggacccaggcccgccaggugccccagguaaggaugguccugccgggcugcggggcuucccaggcgaaagaggauuaccaggaacagcuggcggaccuggccuaaagggaaacgaaggacccucaggaccuccaggacccgccggaagcccaggggagcgcggggccgcuggcuccggcggccccauuggaccucccggaaggcccggaccccaagguccaccgggugccgcgggggagaagggugugcccggcgaaaagggccccaucggaccaacaggucgugacggcguucagggcccaguaggacucccaggaccagccggaccccccggaguugcuggugaagauggcgauaaaggagaagugggcgacccuggacagaaggggacaaagggcaacaaaggcgaacacggcccucccgggccaccagguccuaucgguccagucggacagccuggagcugcaggagcagacggagaaccaggcgccagggguccucagggccacuucggggcaaagggagacgagggaaccaggggcuuuaacggcccccccgguccaaucggguuacaaggguugccagggcccagcggagaaaagggugagacuggugauguuggaccgauggggccaccaggacccccaggccccagaggucccgccggaccaaacggugccgacggcccccagggaccucccggaggcguggggaaucugggcccacccggggagaagggagaaccaggugagagcggcagcccaggaauccagggagaaccaggcgugaaagggccccgcggugagcguggggagaaaggagaaagcggacaaccaggggaaccaggcccaccaggaccuaagggacccacaggugaugacgggcccaaaggcaacccuggaccggugggguucccgggcgacccgggaccaccgggcgaaggagguccuagaggacaagauggugccaagggugacaggggggaagacggcgagcccggucagccaggaucaccaggaccaacaggcgagaacggaccccccgggccccuuggaaaaagaggaccagccgggagcccagguagugagggaaggcagggcggaaagggagcaaagggcgacccaggggcaauuggggcaccagguaagacaggacccguagguccagcagggccggccggaaagccuggaccagacggacuucgcgggcugcccgguuccgugggacagcagggcaggccaggagccaccgggcaagcuggcccccccggcccugucggcccaccaggguugccaggccugaggggcgaugcgggcgcuaaaggggaaaagggacacccaggauugaucgggcugaucgguccgcccggcgaacaaggggaaaagggugacaggggacucccuggcccucagggcagcccuggccagaaaggagaaauggguauuccaggagcuucaggaccuauuggccccgggggccccccugguuugccagggcccgccggccccaaaggugcaaagggcgcuaccggacccggaggacccaaaggcgaaaagggagugcaggggccucccggccauccgggcccaccaggggaaguuauccagccucugccgauccagaugccuaagaaaacacgcagaagcgucgacggaucccgguugaugcaagaggaugaggccauaccaacaggcggagcaccaggcucaccaggcggacuugaagaaauauuuggcucccucgacucacugcgagaggaaaucgaacaaaugcgaagacccaccgguacacaggacuccccugcacggacuugucaggaccuaaagcuaugucauccugaacuuccagauggugaauauuggguggaccccaaccaggggugcgcacgagaugcuuuucgaguguucuguaacuucaccgcaggaggugaaacaugcguuacgcccagggaugaugugacacaauuuagcuauguggacagugaaggcuccccugugggggugguccaguuaacauuccugcgacuuuugucaguguccgcucaucaggaugugucauacccauguaguggugcggcucgggacggaccccuccgccuccguggugccaacgaggacgaauugucuccagaaaccagccccuauguaaaagaauuccgcgacggaugccagacucaacaaggacgcaccguucucgaggugagaacucccgucuuagaacaauuacccguucuggacgccucauucucagaccugggugccccaccaaggagaggaggcguguugcucggucccgugugcuuuaugggcuag

SEQ ID NO: 5380 - RNA, 4890 nt, Artificial Sequence
  Description of Artificial Sequence: Synthetic coding sequence
auggaacgcugcucgagaugccaccgccucuuacuucuucugccacugguguugggcuugucagcagcaccaggaugggcuggcgccccuccgguagacguccuuagggcacugcgguuuccuucuuugccagauggaguucgaagggccaaagguaucugucccgccgauguugcauaccgaguggcgagaccagcgcagcugagugcuccgacaagacagcuuuucccaggaggauucccaaaggacuuuucauuacucacugucguucgcaccagaccgggacuucaggcccccuugcugacucuguauagcgcccagggaguuagacagcucggacuugaacuuggacgucccgugcgauuccuauaugaggaucagacgggcaggccucagcccccuagucaaccagucuuccgaggauugucauuggccgacgguaaauggcaccgaguugcuguggcagugaaaggucagagcgugacccuaaucguagauuguaaaaagcgcguuacccgcccucugccacguagcgccagaccuguucucgacacacauggcgucaucaucuucggcgccaggauucuggacgaggaagucuucgagggagaugugcaggaacuugcaauagugccaggcguucaggcagcguacgaaucgugugagcagaaggaacuggagugugaagguggacagagagaacggccacagaaccaacaaccucaccgagcacagagauccccccagcaacagcccagccgccuccaucggccccagaaccaagaaccucagagucaggccgcccacggccccagaggccugaagggcgagaagggagagccagcagugcuggaacccgggaugcuuguggaagggccuccaggaccagaagggccugccgguuugauaggucccccugggauucagggcaaucccggacccgugggcgaccccggcgaaagaggaccucccggacgcgcuggucuuccaggaucugauggggcccccgguccacccggcacuucacucaugcucccguuuagauucggaagcggagggggagauaaaggacccgugguugccgcucaggaagcccaggcucaagcgauucuccagcaagcuagacuagcucugagaggcccacccggcccuauggguuauacuggacgaccuggucccuugggccagccugggucccccgggcuaaagggcgagagcggcgaucucgguccucagggaccccgcggaccacaaggacugacugguccaccaggaaaagcgggacgccgaggccgcgcgggagccgacggcgcucgcggaaugccaggggauccaggagugaagggugauaggggguuugauggauuacccggacugccaggugagaagggacaucggggagauacaggggcccaggggcugccaggaccgccaggcgaggauggcgaaaggggggacgacggagaaaucggaccuaggggucugccaggcgagucaggcccaagaggucuguuaggcccgaagggcccuccagggauuccuggcccaccaggcgugcgaggaauggacgggccucagggucccaaagguagucugggcccccagggagagcccgguccuccuggccagcaggguaccccgggaacucaaggccugccugguccacaaggcgccaucggcccucacggcgagaaaggaccccagggaaaacccggucugcccgguaugccaggguccgauggaccacccggccacccgggaaaggaagggcccccaggcacgaagggcaaccaggguccuaguggaccccagggccccuuaggcuauccagggccaagaggugugaaagguguagaugggaucaggggauuaaaaggacacaagggcgaaaagggggaggacggcuucccaggcuucaaaggugauauaggugugaagggagauagaggcgagguuggcgucccaggcucuagaggagaggacggacccgagggaccaaaagguaggaccggaccgacgggggauccaggaccacccggcuugaugggugaaaagggcaagcugggcgugccuggauugccaggcuaucccggccgacagggcccaaaagguagccugggcuuccccggguucccaggugccagcggagagaaaggagccagaggacugucaggcaaaagugggccuagaggcgaacgcgguccaaccggaccacgcgggcagcgaggcccacggggagccacugguaaguccggcgcaaagggaacgagcgguggugacggaccacacgggcccccgggcgagagagggcucccaggaccucagggaccgaaugguuuucccggaccuaaaggaccaccaggaccccccggcaaagacggccuuccuggacaucccgggcagagaggagagguuggauuucagggcaagacggguccccccggcccaccaggugucguugggccccagggggcagcaggagaaaccggacccaugggagagaggggccaccccggacccccaggcccuccaggcgaacagggacuacccggcaccgcuggcaaagaggggacaaaaggcgauccuggcccgcccggggcaccaggaaaagacggcccagcaggacucagaggauucccaggggagaggggcuugccuggaacagccgggggcccaggacuuaaaggaaaugagggaccuucuggucccccugguccagcggguagcccaggggagagaggcgccgcgggcagcggcgguccgaucgggcccccuggaagaccggggccacaaggaccaccuggggcggcaggcgaaaaaggggugccgggagagaaaggcccaaucggcccgacuggaagagauggggugcagggcccagugggucuuccuggucccgcgggaccaccgggagucgccggcgaagauggagauaagggcgaagugggggacccaggacagaagggcaccaaggggaacaaaggcgagcacggaccacccggcccaccgggaccuauaggaccugucgggcaacccggcgcugccggggcagacggagagccgggcgcacgagguccccaaggacauuucggggcaaagggggacgagggaacacgcgguuuuaauggcccccccgggcccauuggacugcagggcuuaccagggccaucaggugagaaaggggaaaccggagauguggggcccaugggaccgcccggacccccagguccucgcgggccugcuggaccaaacggagcagacggaccccaggguccucccggaggcgucggaaaccugggaccaccuggggagaaaggagaaccuggagaaucugguuccccaggaauucaaggagaaccuggcguuaaaggaccgagaggcgagaggggagagaaaggcgaaucugggcagcccggcgaaccugggccccccggaccaaagggucccacaggugaugauggccccaagggaaaucccggccccgugggauuccccggggaccccggcccaccaggugagggugguccaagaggccaagacggggcgaagggagaucgaggcgaggacggggagccagggcagcccggaagccccggaccaacaggcgaaaacggaccaccagguccacuaggcaaaagaggcccagcagguagccccggaagugaaggacgacagggagggaaaggagcuaagggggauccgggagcaaucggggccccuggaaagacggguccagugggaccggccggaccugcagguaaacccggaccagacgggcuccguggacugcccggaagugucggccagcaagggcgccccggcgccaccggacaggcaggcccgccaggucccgugggacccccuggccugccagggcuuagaggggaugccggcgcuaagggcgagaaaggccauccuggucugaucgguuuaaucgggccucccggcgagcagggugaaaagggcgaucgcgggcuaccaggaccucaaggaagcccugggcagaagggugagaugggcauucccggagccucaggacccaucggaccaggcggacccccuggucucccuggcccagcaggaccuaagggugcuaagggagccacaggaccaggcgguccaaagggggaaaaaggcgugcagggcccaccuggccacccugggcccccaggagaggucauccaacccuuaccgauccagaugccuaagaagaccagaagauccguugacggcucacggcucaugcaagaagacgaggcuauuccaacaggaggggcucccggcucuccuggcgggcuugaagaaaucuuuggcagcuuggacucgcuacgcgaagaaauugagcaaaugcgcaggccuacuggcacgcaagacucucccgcuagaacaugccaagaccugaagcucugccaccccgagcuaccugauggagaauauuggguugaccccaaccagggcugcgcucgcgaugccuuucgcguauucugcaacuuuacagccgggggcgagaccugugugacgccucgggaugaugugacacaguucucuuacgucgauagcgagggcucccccgucggugugguucagcucaccuuucugaggcuauuauccguuagugcccaccaagacgucuccuaucccugcaguggggcagccagagauggcccccugagacugagaggcgccaacgaagaugaacuaagccccgagacuuccccuuacgugaaggaauucagagaugggugccaaacgcagcaaggacguacaguacuggaagugagaacgccgguuuuagagcaauuaccaguacuugaugcuucuuucagcgaccuuggagccccgccaaggagaggagguguacuuuuggggcccguguguuuuaugggguag

SEQ ID NO: 5381 - RNA, 4953 nt, Artificial Sequence
  Description of Artificial Sequence: Synthetic coding sequence
auggagcgcuguucaaggugucaccgcuuguuacuucucuugccucuggugcucggccucagcgccgcgccagguugggcuggggcuccucccguagauguuuugagagcccuuagguucccuagucugcccgacggggugagacgugcuaaaggaauaugcccugccgauguugccuaucgagucgcucgcccugcucaguuguccgcgccuacacggcagcuauuuccgggagguuuuccaaaagauuucagccugcuuacagugguuagaacucguccagggcugcaagccccccuacucacgcucuacuccgcccaagggguccgacagcugggccucgaguuaggaagacccguucgcuuucucuaugaagaucagaccggccggccccaaccucccagucaaccaguguuucgggggcucucacuggcugauggaaaauggcaucgagucgcuguggcugucaaagggcaaaguguaacccucaucgucgauugcaagaaaagggugacccgcccacugccacggucggcacgucccgugcucgauacccacgguguaaucaucuucggcgcaaggauauuagacgaggagguguucgaaggugaugugcaggaacuggcaaucgugccaggagugcaggcggcuuaugaauccugugagcagaaagagcuggaaugcgagggagggcaaagagaacggccgcagaaucagcaaccucaucgagcacaacggaguccccagcaacagcccaguagauuacaccggccacaaaaccaggaaccccagucucaggacccaacuccuggugaggaagaagagauccuggagagcucucuguuaccaccucuagaggaggcagcgcacggaccuagaggacuuaagggcgaaaagggggagcccgcugugcucgaaccggguaugcugguugaaggccccccuggcccagaaggccccgcgggacuuauugggccccccggaauccaggggaacccaggaccagucggugaucccggagagagaggacccccaggucgcgcugguuugccggggucugauggcgcgccuggaccaccuggcacuucuuuaaugcuucccuucagauucgguuccggcgguggagauaaaggcccggugguggcugcccaggaggcacaggcccaggccauucuccagcaggcgcgacuugcuuugagggguccucccggaccuaugggauacacuggucguccuggaccccuggggcagccaggcucuccaggucucaaaggagaaagcggcgacuuggguccucaaggcccaagaggaccacaggggcuuacaggcccuccagguaaagcuggaagacgaggccgugccggagcagauggggcucgugguaugcccggagauccaggggucaaaggggaucgcggauucgauggcuugccuggcuuaccgggagaaaagggccaccggggggacacaggcgcucagggacugccaggacccccaggagaggauggggaaaggggggacgacggugagauuggaccaagaggccugccaggggaaagcggcccacgaggucuucugggaccuaaaggaccuccagggauccccggaccaccaggggugcgcggaauggacggaccucagggcccaaagggcucauuaggaccacaaggugagcccggaccucccggacagcaggguacccccgguacacaaggccuuccugguccccagggugccaucggcccucacggggagaaaggaccucaaggaaagccaggacugccagggaugccagggagugaugggccacccgggcauccgggcaaggaaggcccaccugggacgaagggaaaccagggcccuucuggaccgcaaggcccacuggguuacccaggcccaagaggagugaagggaguggauggcauuaggggucugaaggggcacaaaggggaaaagggggaggacgguuuuccagguuucaagggugauaucgggguuaaaggugauaggggagaaguaggcgugccagggagcaggggagaagauggacccgaagguccuaaaggccggaccggcccuacaggcgaucccggaccuccggggcucaugggagaaaaagggaaauugggaguccccggacuaccaggauauccuggacgacagggaccaaaagggucacucggguuucccggguuucccggcgcaaguggcgagaaaggggccaggggccugagcgguaaaaguggcccuaggggcgagagaggacccaccggaccaagagggcagagggggccaagaggcgccacugggaaaucgggggcuaagggaacgucuggaggagacggaccucacgguccuccuggagagagaggcuugccagggccucaaggccccaacggcuuuccuggcccuaaagguccuccaggaccuccuggcaaagacggucugcccggccaccccggacagagaggugaaguuggguuccaagguaagacugguccccccgggcccccuggagugguggguccacaaggcgcugcgggcgaaacuggccccaugggcgagcgaggacaccccgggccaccuggcccuccaggcgaacagggccugccagggaccgcgggaaaagagggaaccaagggugaccccggccccccuggugcaccgggcaaggauggcccugcaggcuugcguggguuuccaggcgagcgaggucuacccgggaccgcugguggacccggccugaaggguaacgaagguccaucggggccaccgggcccggcagguaguccgggggagaggggagccgcaggaagcgggggucccauuggacccccugggcgcccaggaccucagggaccuccaggagccgcaggcgagaaaggaguucccggugaaaaaggcccuauuggacccacaggacgggacggugugcaagggcccgugggccugccugggcccgcuggcccaccaggaguggcaggagaagacggcgauaaaggugaagugggagacccgggucagaagggaacaaaggggaauaaaggagagcacgggccgccugggccaccgggcccuaucggaccagugggacaacccggagcagcaggugcggauggcgaaccaggggcucgaggcccacaaggucacuucggcgcuaagggagaugaagguacccggggauuuaacgggccccccgguccgaucggcuuacaggggcugccugguccaagcggcgaaaaaggggaaacaggagaugugggccccauggggccccccggcccaccuggaccacgcgguccggcgggaccaaacggagcagacggaccacaagggccaccugguggcgucggaaacuuagggcccccaggggagaaaggugaaccaggggaguccgguucccccgguauccagggagagccaggcgugaaaggcccccgcggugaacggggugagaaaggcgagagcgggcagccuggagagccaggaccuccaggcccuaaagggccuacuggcgacgaugggccaaagggaaauccugguccagugggauuccccggggauccaggcccuccuggugagggcgggccacgaggacaggauggagcgaaaggagacaggggggaagacggggaaccgggccagcccggcucgcccggacccacaggcgaaaaugguccacccggaccuuuggguaaacguggucccgcagguaguccagguucagaagguaggcagggaggaaagggcgcuaaaggggauccuggcgcgauuggugcgccugggaagacagggcccguaggacccgccgguccagccggaaaacccggccccgacggacuucgcgguuugccagggagcgugggacagcaaggucgcccuggugcuacagggcaagccgggccccccggacccguugggcccccuggccuuccgggguugagaggagaugcaggagccaagggcgaaaaggggcauccgggauugauuggccugauaggaccuccaggagagcagggggaaaagggugacagaggccuuccagggccccaaggcucccccggucagaagggcgaaaugggaaucccuggcgcuuccggaccaauaggacccggaggcccuccuggccucccaggcccugcaggcccaaagggcgcaaaaggagcuaccggcccaggcggaccuaagggcgaaaagggugugcagggacccccaggacauccaggacccccgggugaaguaauucagccccuccccauucagaugccaaagaaaacacggcggucuguggauggaagucgacugaugcaggaagaugaggcuauacccaccggaggcgccccuggaucaccaggaggccuugaggaaauuuucgggucccucgauagucugcgcgaggagauagaacagaugagacggcccaccggaacacaggacagcccagcccgaacuugccaagaucuaaaacuaugccaccccgagcugcccgauggcgaauacuggguugaccccaaucaaggaugugcucgagacgcuuuuagggucuucugcaauuuuaccgcugggggggaaaccugcgugacacccagagaugacgucacccaguucucauaugucgacagugaaggaaguccggucgguguggugcagcuuaccuuccucagauuauuauccguuagcgcacaucaagacguuucuuaucccugcucaggcgcugcccgagacggaccacucaggcucaggggugccaacgaagaugaacugucucccgagaccucuccguacguuaaggaguuccgggaugggugccaaacucaacagggacgaacagucuuggaagucagaacaccggucuuagaacaacugcccguauuagacgcuucuuuuucagaucugggggccccuccucgccgcgguggcgugcuucugggaccagugugcuucaugggauag

SEQ ID NO: 5382 - RNA, 4968 nt, Artificial Sequence
  Description of Artificial Sequence: Synthetic coding sequence
auggaaaggugcucccgaugccauaggcuuuuacuguugcugccacuuguacugggauuaagugcugcacccgguugggcuggcgccccacccgucgaugucuuaagggcacugagauucccuucuuugccagaugguguccgccgugccaaaggaaucugucccgcugauguggcuuaucgcguggcuaggccagcacagcucucagccccuacucgccaacuguuccccgggggauucccgaaggauuuuucccuguugacugucguaagaacacgaccaggacuacaggcgccucuuuuaacccuuuauucugcucagggcguucgucagcuuggcuuggaacuuggcaggccuguacgcuuccuguaugaagaccagaccggccgcccucaaccccccucucaaccugucuuucgagggcugucacuugcagacggaaaguggcaucgagucgcuguggccguaaaagggcaaagugucacucugaucguggacuguaagaagcggguuacucgaccucugccucggucagcaagaccugugcuagauacucacggcgucauuauuuuuggggcacguauccuugaugaggagguguuugaaggggauguucaggagcuugccaucguuccuggaguucaagcugccuacgaaucaugcgaacaaaaggagcucgagugugaggggggucaacgagagcguccacagaaucagcagccucaccgagcccaacgaucaccacaacaacaaccuagccgccuccacagaccccaaaaccaggaaccucagagccagccaacagagucacucuacuacgacuacgaacccccuuacuacgauguaaugacgacagguacaacuccagacuaccaggcagcacacggaccacgcggccugaaaggagagaagggagaaccugcuguucuugaaccaggaauguugguggaaggccccccugggcccgagggaccugccggacuuaucggcccaccuggaauacaagggaaccccggaccagucggggaucccggagagcggggucccccggguagagccgggcugccaggguccgacggcgcgcccggcccgcccggaacaagcuuaaugcucccuuucagauucgguagcggggguggugauaaaggaccuguuguagcugcgcaagaggcccaagcccaggcgauauuacagcaagccaggcuggccuuaagaggaccgccagggccuaugggauacacgggcaggccuggcccacuggggcaaccggggucaccaggcuuaaagggagagucaggugaucuaggcccacagggcccgagggguccccagggauugacaggaccaccuggaaaagcagguagaagggggagagcuggugccgauggagccagagggaugcccggugaccccggcgugaagggggaucgagguuuugauggacugccaggacugcccggggagaagggucacagaggugacaccggggcacagggacucccaggucccccaggagaagauggcgagcguggcgaugauggcgaaauagguccuaggggacuucccggugagaguggcccacggggucuucuugggccaaaggggccuccagggauucccggcccuccgggugugcgcgguauggauggaccucaaggccccaagggcucccuuggcccccagggggagcccggaccucccggacagcaagguacaccuggcacucagggccugcccgguccccagggagccauaggaccgcacggcgagaaaggaccacagggaaaacccgggcucccggggaugccaggcagcgauggcccuccagggcacccugggaaggagggaccaccaggcacgaaaggaaaucaaggaccuagcggcccgcaaggcccccugggguaccccggcccaaggggaguaaagggugucgacggcauuagaggccugaagggacauaagggagagaagggagaagauggcuuucccggauucaaaggcgacaucggagugaagggcgacagaggcgaagucggggugcccggaaguagaggagaggacgggccggaggggccaaagggcaggaccgguccaacuggagauccuggccccccuggacugaugggcgagaaaggcaagcucggcgucccaggccuuccgggcuacccaggcagacagggucccaaaggcagccugggguuccccggauuuccuggagcuaguggcgagaaaggagcaagaggucucucagguaaaagugggccaagaggagagcgcggaccuacaggcccccgcggacaaagagguccaaggggugcuacggggaaaaguggggcaaaggggaccagugguggggacggcccacauggaccuccuggcgagcggggccugccaggcccacagggacccaauggauuucccgggcccaaggggccuccaggaccucccggcaaggacggccugccaggucaccccggacagcgaggggaggugggauuccagggcaaaaccggaccuccaggaccuccaggagucgugggaccccagggagcugcaggagagacugguccuaugggcgagcgugggcacccaggaccccccggucccccaggagagcaaggacugcccggaacagcuggcaaggaggggacgaaaggugacccagggccucccggagcgccgggcaaagauggacccgccgggcuucgcggguucccaggcgaaagaggacuaccggguacagcgggagggcccggacucaaaggcaacgagggaccuucuggacccccuggaccagcaggaagcccuggggagagaggggcugcaggaagugguggcccaauuggccccccuggucgacccggcccacaaggcccuccgggcgcggccggagagaagggcgugccaggagaaaagggaccuaucgguccuacagguagagaugggguucaggguccgguggggcugccaggucccgcugguccaccaggaguggcaggagaggacggcgacaagggagaagugggagacccaggacagaaaggcaccaagggcaauaagggcgagcacggaccaccuggaccgccuggaccuaucggccccgugggacagcccggagcagcuggcgcggacggggaaccaggagcaaggggcccccagggccacuucggggccaaaggggaugaagguacacguggguucaacggaccaccagggccaaucggccugcaggguuugccgggacccucuggcgagaagggcgaaacuggggacgugggaccaaugggaccccccggcccuccaggaccccgaggaccggcugguccuaauggcgcagacggcccucaaggcccuccgggaggcgugggaaaucuggggccgccuggcgagaagggggaacccggggagagcgggagcccaggcauacagggagaaccaggagugaagggaccaaggggcgaaaggggggagaagggugaguccgggcagccaggcgagccuggaccuccggggccuaagggaccuacuggagaugacgggcccaagggaaauccaggaccggucggauuuccuggcgauccaggcccuccuggggaaggaggacccaggggucaagacggagccaaaggggaccggggugaagacggugaaccuggacaaccuggaucccccggaccuacuggagagaaugguccaccuggcccacuggggaagcguggccccgcaggcucacccggaagcgaaggaaggcaagggggaaaaggugccaaaggggacccuggagcuauuggcgccccagggaagaccgggcccgugggacccgcaggaccagcuggcaaacccggaccagauggccugaggggucuuccagggagugugggacaacaggggcgacccggagccacuggacaagccggcccaccaggccccgucgguccaccuggucugcccggacugcgaggggacgcaggcgcaaagggagagaagggucauccagggcugauaggucucauuggaccaccuggcgaacagggggagaaaggagaccgcggucuuccaggcccacagggaagccccggacagaaaggagagaugggcauccccggggcaucuggacccaucggucccggagguccucccggccuccccggcccugcuggaccaaaaggagcgaagggcgcuacaggaccaggcgggccuaaaggcgagaaaggaguucagggaccuccuggccauccgggcccccccggcgaggucauucagccccucccaauucagaugccuaagaaaaccagaagaagcguggauggcucacgccugaugcaagaagacgaagcuauucccaccggcggugccccuggauccccagguggucuagaagaaauuuucgggaguuuggauagccugcgcgaagagaucgaacagaugcgucguccaacuggaacccaggacaguccagccaggacgugccaagauuuaaaacugugucaucccgaauuacccgacggagaguauuggguugauccaaaccaggggugugcaagagaugccuucagaguguuuugcaacuuuacugccggaggagaaacaugcguuacuccccgugaugauguuacccaauucucuuaugucgacuccgaagggagcccuguuggaguuguacagcucaccuuucuucgccuccuaucugucagcgcgcaccaggacgugagcuauccuuguucaggcgcugcccgcgacggcccccuacgccugagaggcgccaaugaggaugaacuuucaccugaaacaagcccauaugugaaggaguuucgggacggaugucaaacucagcagggucguaccguacuggaagucagaacaccaguucuagaacaguuaccagucuuggaugcaaguuuuucugaucugggcgccccaccucggcgcgguggugugcuuuuaggaccagucugcuuuaugggguag

SEQ ID NO: 5383 - RNA, 5070 nt, Artificial Sequence
  Description of Artificial Sequence: Synthetic coding sequence
auggaaagaugcuccagaugucaucgccuguuacugcuacugccacuuguacucggacucagcgccgcucccgggugggcaggcgcucccccaguggauguucuuagagcccuaagguuucccucacugccagacggaguccgcagagcuaaggggaucugccccgccgauguggccuaucggguggcgaggcccgcacaguugagcgcuccaacacgucaauuguuuccagguggauucccaaaagauuuuucccuucuaacggugguccgcacgcgacccggacuccaagccccccuucugacuuuguacucagcccaagggguacgucaacugggacucgagcuggguagaccggucagauuucuguaugaagaccagacaggcaggccccagccuccaagucagcccgucuuucgcggucuuucucuugcagaugggaaauggcaccgcguggcuguggcugugaagggccaaucugugacacuuaucguugacuguaaaaagcgugucacuagaccauuaccacgauccgcccgacccguuuuggauacacauggagucauuaucuuuggcgcccgcauuuuagaugaggagguguuugaaggugacguccaggagcuggcaauugugccaggcgugcaggccgcuuaugagucgugugaacagaaagaacuggagugcgagggaggacagcgagagaggccacagaaucaacaaccacaucgagcucaacgauccccgcaacaacagccuagcagauugcaccgaccccaaaaucaggagccucaaucacaggaacaaacugaccugcaggugccgccaaccgcagacagauuucaggcagaggaguauggugaaggcggaaccgauccacccgaaggcccuuacgauuauaccuauggcuacggggaugauuauagggaggagacagaacucgggccggcucuaagcgcugagacagcacauucgggggcugcagcucaugggccgagaggauugaaaggugagaaaggcgaaccagcgguguuagagccggguaugcugguggaaggaccccccggucccgaaggcccagccggucugaucggaccacccgggauucagggcaacccuggaccugugggagacccaggcgaacgcggaccuccagggagagcaggacugccagguagugauggagccccugguccuccaggaaccucacuuaugcucccauuucguuuuggaucaggcggcggggacaagggaccaguuguggcagcccaggaggcccaggcacaggcaauacugcagcaggcaaggcuggcucucagaggcccacccggacccaugggguacacagggcgaccggggccauugggucagccaggcucaccgggucucaaaggugagagcggagaucucggcccccagggcccuaggggaccccaaggucucaccggcccucccggaaaagcaggacggcgcggacgagccggagccgauggagcacgcggaaugccgggcgauccgggggugaaaggagaucggggauuugacggguuaccaggauuaccuggugaaaagggucauaggggugauaccggcgcucagggccucccagguccaccaggugaggacggagagagaggugaugacggcgaaauugggccaaggggauugccaggggagucgggaccuagaggucugcuaggaccuaaaggcccaccagggauuccugguccgccgggggugagagggauggauggaccacagggacccaagggaucucuaggcccucagggugagccgggcccgcccggacagcaagggacacccgggacacagggguugcccggcccacagggagcuauagggccgcacggcgaaaaagggccccagggaaagccagguuuaccuggaaugccugguuccgacggaccaccuggccauccgggaaaggaaggcccccccgggaccaaaggaaaucaggggccuucaggaccucagggcccucugggcuauccaggaccccguggagugaaaggaguggacggaauucgcggacugaagggacacaagggugaaaaaggagaggacggcuucccuggauucaaaggcgauauaggcguuaaaggcgacaggggugaagugggagugccugguaguaggggggaggauggaccggaagggccgaaaggacgcacaggcccaacuggcgacccuggaccuccuggacucaugggcgaaaagggcaagcuuggcgugccaggccuccccggauacccgggcaggcaaggaccgaaggguagccucggcuuuccaggauucccgggagcaagcggagaaaaaggggcacggggccugaguggaaaaagcggcccccguggagaacguggccccacgggcccaagaggccagcgcggaccuagaggcgccacuggaaagucaggcgcuaagggcaccucugguggugacggaccgcauggaccacccggugagcgggggcugcccgguccacaggggcccaaugguuuuccagguccaaagggaccucccgggccucccggaaaggauggacucccgggccauccaggucaaaggggcgaggugggcuuucaaggcaaaacggggccuccagggccaccaggaguagucggaccccaaggagcagcaggagaaaccgggccaaugggagaacgcggucaucccgggccaccagggccucccggugagcagggucugccggggaccgcuggaaaggaaggcaccaagggagacccaggccccccaggcgcuccuggcaaagacggccccgccgggcuucgcggguucccuggcgagcgaggccuccccggaacagccggugggccgggacuuaaaggcaaugagggcccgagcggaccaccuggcccugccggauccccuggggagaggggagcagcagggaguggagguccaauuggcccgcccggccguccuggaccucaaggaccaccuggagcagcgggcgaaaagggaguaccuggcgagaaagguccgauaggacccaccggccgcgauggcguccaaggacccguuggccuuccuggcccugcagguccgccaggcguagcaggagaggacggugauaaaggagaaguaggagaccccggacagaaaggaacuaaggggaacaaaggcgaacaugguccgcccgguccaccagggcccauuggaccagucggccagccuggagccgcuggggcugauggggaacccggagcuagaggaccccaaggccauuucggagccaaaggcgacgaggggacacgggguuuuaacggcccgcccggcccuaucggcuugcaaggucugccaggaccaucuggagagaaaggagaaacaggcgaugucggacccaugggacccccuggcccaccugggccuagaggcccagcuggucccaacggugccgauggcccccaagggcccccaggcgggguaggcaaucugggcccaccuggggaaaagggugaaccaggagagagugggucucccggaauccaaggagaaccugggguaaaagggccucguggcgaacggggagagaagggggagagcggccaacccggcgagccagggcccccuggccccaagggaccgacaggugaugacggaccuaagggcaauccaggaccuguuggguuuccuggcgaccccggacccccaggagaggguggaccucgggggcaagauggugcaaagggcgacagaggggaggauggagaaccaggucagccggguucuccaggaccaaccggagaaaacggcccacccggcccauuaggcaaaagagguccugcaggcaguccgggaucagagggacgacagggggggaagggagccaagggagauccgggagcuaucggagccccggggaaaacuggaccggugggccccgcgggccccgcaggcaaaccagggccagauggccugcgcgggcugccugggucagugggccagcagggcagaccaggcgcuacagggcaagcgggaccuccaggaccagucgguccgccaggucugccaggacuaaggggcgaugccggagccaagggcgaaaaggggcaccccggacugauuggacugaucgggccaccaggggagcagggagagaagggagaucggggacuucccgguccacaggggucaccagggcaaaaaggugagaugggcauucccggugcaaguggaccuauaggaccugggggaccuccuggauugcccggcccugcgggacccaagggagccaagggugcaacaggaccugguggcccuaaaggugagaagggcguccagggcccacccggucacccaggaccgccaggcgaagucauccagccgcugccaauccagaugccgaaaaagacaaggagaaguguagauggcuccagguugaugcaggaagaugaagcaauaccuacaggaggagcuccugguucaccagggggacuggaggaaauuuucgggagucucgauucccuccgugaagagaucgagcagaugcgccggcccaccggcacacaagauagcccugcaaggaccugccaggaccuuaagcugugucaccccgagcuuccggauggcgaguacuggguugacccaaaucaaggaugugcacgugaugcuuuccggguuuucugcaauuuuaccgcuggcggagaaacguguguuacuccacgagaugacguuacgcaauucuccuacguugauucugaaggaaguccuguggggguggugcagcugacuuuuuugagacuauuguccguuagcgcccaucaggaugucagcuacccuuguuccggcgcugcacgggaugggccacuucggcuaagaggggcaaaugaggacgagcuaucuccugagaccucaccguacguuaaggaauuccgugauggaugucagacucaacaggggagaacaguucuugaggugaggacccccguuuuggagcaauuaccuguccuggacgccuccuucuccgaucuaggagcacccccacgccgaggcggaguucugcugggacccgucugcuuuaugggcuag

SEQ ID NO: 5384 - RNA, 5133 nt, Artificial Sequence
  Description of Artificial Sequence: Synthetic coding sequence
auggagcgguguagcaggugucaccgguugcuccuccuguugccguugguccucggcuugucugcugcacccggaugggccggugccccuccaguggacgugcuccgcgcccugcgguuucccagccuuccugauggcgucagaagagccaaggggauuugccccgcagacguggcuuaccgugucgcuagacccgcucaauuaucugcacccacccgacagcuguucccaggcggauucccaaaagauuuuucccuacucaccgucguuagaacccgaccaggacugcaggcaccucuccugacucuuuacuccgcucagggagugaggcaacucggucuggaacuggggcggcccguccgcuuucuguacgaggaucaaacaggcagaccgcagccccccucccagccggucuucagagggcuuucccuagcggacggcaaauggcaucguguugcugucgcgguuaaaggucaaagcguuacccucauuguggauugcaagaagcgcguuacacgcccuuuaccccggagcgcucgccccgugcucgauacucauggcguuauuauauucggcgcgcggauacuggacgaagaaguguuugaaggagaugugcaagaguuggcaauaguaccuggcgugcaggcugccuaugaaucaugugagcagaaagagcuugagugugaagguggccagcgugaaagaccucagaaucaacagccacaccgagcgcaaaggucaccacagcaacaaccuucacggcuucacagaccccagaaccaggaaccucagagucaagauccaacucccggagaggaagaagagauccucgagaguucgcuauuaccuccgcucgaggaggaacagacugacuugcaagugccccccaccgcagauagguuccaggcagaagaauacggugagggcggcacugacccccccgaagguccuuaugacuauacauacggcuacggagacgauuacagagaagagacagaguuaggcccggcgcuuagcgcagaaacagcucacucaggugcagcugcccaugggccccguggguugaaaggcgaaaaaggugaaccagcaguguuagaaccagguaugcugguggaagggccaccagguccagagggaccggccgggcugauuggaccuccuggcauucaaggcaacccaggacccgugggagacccuggagaaaggggcccuccggguagggcugggcuccccggcucugauggggcaccuggccccccagguacuucacucaugcugccauuucgguucggcucgggggggggugauaaaggacccguagucgcagcccaggaagcacaggcucaggcuauccugcagcaggcgcgcuuggcucuacguggaccacccggcccaauggguuauacaggccgcccagggccacuuggccagccaggcagcccuggacugaagggggagagcggcgaucugggcccccagggaccgcguggcccucaaggacuaaccgggccuccugggaaagcuggcaggagggggagagcaggugcagacggugcaagagguaugccuggggaccccggcguaaagggggacaggggauuugacggacucccaggacugccaggugagaaaggacauaggggugauacgggggcacaagguuugccuggaccaccaggugaagauggagagcggggggaugauggcgaaaucgguccuagaggacucccaggugagagcgguccgagaggcuuacucggaccuaagggcccaccuggcaucccuggcccucccggggugcgggguauggauggaccccaagguccaaaagggagucucgggccccaaggagaacccgguccgccgggccaacaggggacaccagggacccagggcuuaccaggcccucagggugccauaggaccucauggcgagaaaggaccgcagggaaagccuggcuuacccgguaugccgggcuccgacggaccucccggccaccccggaaaggagggcccaccagguaccaaaggcaaucagggacccuccggaccacaaggaccucuggguuaucccggaccacgcggaguuaaaggcgucgacggcauuaggggauugaaagggcauaaaggagagaaaggagaagacggguucccuggguucaagggcgauauaggugucaagggcgaucguggcgagguggggguucccggcucuagaggagaggacggaccagaaggcccuaaggggcggaccggaccaacuggagaccccggaccaccagggcugaugggagagaagggaaagcugggggugccuggccugccuggguacccuggcagacaggggccuaaggggagucucggcuucccaggcuuuccaggagcuagcggggagaaaggcgcacggggcuuauccggaaaaucugguccaaggggagaacguggcccuaccggacccaggggccagcgggggccccguggcgcaacaggcaaaucaggagccaaaggaacgagcggcggagacgggccacauggucccccaggagagcguggacuucccggaccacagggaccaaacggguucccugggccuaaagggcccccuggcccacccggaaaggaugguuugccaggccaucccggucaacggggugagguuggauuucagggaaaaacagggccucccggacccccgggaguggugggaccccagggggcagcaggagagacagguccaaugggcgaaagggggcacccugggccaccaggaccacccggggagcagggacugccaggaaccgccggcaaggaggggaccaagggggaccccggaccucccggugccccugguaaggacggacccgccggccugagaggcuucccuggugaacgugguuugccuggaaccgccggaggaccagggcucaaaggaaaugaaggcccaaguggaccaccuggaccggcagggucaccuggugagaggggggcagccggcaguggggggccuauuggaccccccggccguccaggaccucaggggccaccaggugccgccggcgagaagggcgugccuggcgagaagggaccaaucggaccaacgggaagggacggcguacagggaccagugggacuaccaggcccggccgguccgcccgggguggcaggcgaggauggagacaagggagagguaggggaccccggccagaaaggaaccaaagggaauaaaggugaacaugggccuccagguccuccugggcccauuggacccguuggccagccaggagccgccggagcugacggcgaaccaggagcacgcggaccacaaggacauuuuggcgcaaagggugacgaaggaacucggggauuuaauggccccccuggcccaauaggguugcagggccuuccaggcccuucaggagaaaaaggagaaaccggagacgugggaccgaugggccccccuggcccacccgggccacggggacccgccgggccaaauggugccgauggaccacaggggccacccgggggagucggcaauuuaggccccccuggagagaagggugagcccggagaaagcgggucccccgguauccagggggaaccaggcgugaaggguccuagaggugaaagaggcgagaagggcgaaaguggucagccaggagaaccagguccuccagggccaaagggcccaacaggcgacgacggucccaagggaaaccccggcccuguaggcuucccaggagaucccggaccgccuggagagggcggaccacguggacaggauggagcuaaaggcgaccgcggagaagauggcgaacccggccagcccggcucaccggggcccacuggcgaaaaugguccaccagguccuuugggcaagcgcggcccugccgggucuccaggcagcgaggggagacagggaggcaaaggagccaagggagacccgggcgcaauaggggcucccggaaagacaggcccaguggggcccgcaggaccggcaggcaaaccgggccccgacggacuccgcggacugccgggcagcgugggccaacaggguaggccuggcgcuacgggucaagccggaccuccuggcccuguggguccuccgggacugccaggacugagaggggacgccggagcaaagggggaaaaaggccaucccggauuaauuggucugaucggcccaccgggagagcagggagagaaaggagacagagggcuccccggcccacaggggucuccgggacagaagggugaaaugggcauccccggcgccucagguccaauagguccuggagggccuccaggguuaccaggaccagcaggcccaaaaggagcuaaaggcgcuacaggccccggagguccuaaaggugagaaggggguacaagguccaccgggucauccugggcccccaggugaggugauucagccgcugccgauucagaugccaaagaagacaagacguuccgucgacggaucaagacuaaugcaggaggacgaagcaauccccacgggcggggcaccagggagcccggguggccuggaggagauuuuuggaucacuggauuccuuacgagaggagauugagcagaugagacggcccacugggacacaggauagccccgcaaggaccugccaggaccugaaacugugucaucccgagcugccagacggggaauacuggguugauccaaaucaagggugugcucgagaugcguucagaguguuuugcaacuuuaccgcuggcggcgaaacuuguguaaccccuagagaugacguuacgcaguucagcuacguugacucugagggcaguccugucggaguuguccagcuaacuuuccugcgacuuuuaucagugucagcccaucaagacgugucauaucccuguaguggcgccgccagagacggaccacuucggcugcggggagccaaugaggacgaacugagccccgaaaccucgccuuacguuaaggaauuuagagauggcugucagacccagcagggcagaacaguacucgaagugcggacccccguacuggaacaguuacccguccuugaugcuucuuuuucugaucucggcgcuccaccaaggaggggagggguguugcuuggaccaguuuguuuuaugggcuag

SEQ ID NO: 5385 - RNA, 873 nt, Artificial Sequence
  Description of Artificial Sequence: Synthetic coding sequence
auggagagaugcuccaggugccaccgucucuuauugcuuuuaccuuugguguugggucugucugcggcacccgggugggccggcgccccuccaguugacguccuccgagcccugcguuuuccguccuugccagauggugugagacgugccaaaggcaucugucccgcugacguggcauaucgcguagcuagacccgcccaguuguccgcuccuacucgucaguuguuccccggcggcuuuccuaaggauuuuucccuacuuacagugguacgaacucgcccgggguuacaggcuccgcugcugacacucuacuccgcccagggagucaggcagcuaggacuagaacugggcagaccggugagauuucuuuacgaagaucagacuggacgcccacagccgccaucccaaccaguauucagggggcuaucacuggcagaugggaaauggcaucgcguugcuguagcggucaagggucagagcguaacacuaaucgucgauugcaagaagagagugacucggccucugcccaggucagccagaccagugcuggacacucacggcgucaucauuuucggggcacguauauuagacgaggaagucuucgaaggcgacguccaggaacuggccauugugccuggagugcaggcagccuaugaaucaugugaacagaaggagcuggaaugcgagggugggcagagagagaggccucagaaccagcagccccauagagcucaacgaagcccccaacagcaacccuccaggcuccacagaccacaaaaccaggagccucagucacaagugcgcgaacucggcgaacccccuagcgccgcacacccgagggaagggcgccaccccggaauuuccccaccauag

SEQ ID NO: 5386 - RNA, 921 nt, Artificial Sequence
  Description of Artificial Sequence: Synthetic coding sequence
auggauuggagagcaucugaagccuggauggucccgcgcgccccuaaaggagccugggauccccgcgagagucaagaucuccucgacaaucgggcaccgcugggaccacguguauuuccagggccaagagucccguccgcacugauggagaggagggugcuuaaaggaucucagggguccccugcauguccaggaccccccggcgaagucauccaaccacuaccuauccagaugccaaaaaaaacccgaagaucaguugacgggagccggcugaugcaagaagaugaagcuaucccaacagggggcgcccccggcaguccuggaggccuugaagaaauauuuggcuccuuagauagccugcgcgaagaaauugagcaaaugcgccgcccuacuggaacucaggauucacccgccagaacgugccaggaccucaaguuaugucaccccgagcuccccgacggagaguauuggguagaccccaaccaaggaugugccagggaugcauuccggguauuuugcaacuuuaccgcagguggugaaacaugcgugacaccacgugaugaugucacucaauucucauacguggauuccgagggaucgccuguaggugugguacagcuaaccuuccucagacuucuaucuguguccgcgcaucaagacguaagcuacccuugcuccggcgccgcgagagaugguccccugagacugcguggagcuaacgaggaugagcucucacccgagacaagucccuauguuaaggaauuucgcgauggcugucagacgcagcaaggacgcacagugcuggagguccgaacgccugugcuugaacaacugcccgugcuggaugccucuuucuccgaccucggagccccuccuaggagaggcgggguccucuuggggccgguuuguuucaugggguag

SEQ ID NO: 5387 - RNA, 5031 nt, Artificial Sequence
  Description of Artificial Sequence: Synthetic coding sequence
auggagagguguagcaggugucauaggcuguuauuacucuuaccuuuaguccucggccugucagcugccccaggcugggcgggagcccccccugucgauguguugcgugcucugagguucccaagcuugccugacggugugcggcgggccaaaggaauaugcccagccgacguugccuacagaguagccaggccugcccaacuguccgccccuacccgccagcuauuuccuggagguuuucccaaagauuuuagucuuuuaacuguggucagaacccgccccggacuccaggccccacuucugacucucuacuccgcacagggagugagacaacuugggcuagagcucggcaggcccgucagguuccuguaugaagaccaaaccggacgaccacagccaccuucccagcccgucuuuagaggauugucuuuggcagaugggaaauggcaucgugucgcagucgcaguuaagggccagucugucacccugauaguugauuguaaaaagagaguaacacguccccugccacggagcgccaggccgguucuagauacccauggugugauuauuuucggagcaagaauccuggacgaggagguuuucgaaggggaugugcaggagcuagcaauugugccuggagugcaggccgcuuacgagagcugcgaacaaaaagaguuggaaugcgaaggaggacaacgcgagagaccacagaaucaacaaccacacagagcccagagaucuccucaacagcagcccucccgcuugcauaggccucagaaccaggagccccagagucaaccaacggagucccuauacuacgacuacgagccacccuacuacgaugugaugaccacaggaaccacacccgacuaccaggauccaaccccaggggaagaggaggaaauucuggaaucaagucugcuccccccucucgaggaagccgcccacggcccccguggauugaagggugaaaaaggggaaccagccgugcucgaaccugguaugcuuguagaaggaccaccuggaccugaaggaccugcuggacuaauuggucccccgggaauccaagguaaccccggccccgugggggacccuggcgaacguggccccccaggucgggccgggcuuccuggcuccgacggcgcaccugguccucccggaacuucccugaugcucccguuucgcuucggauccggugggggggauaaaggaccagucgucgcugcucaggaggcacaggcacaggcuauccugcaacaggcucggcuggcacuucgcggcccaccuggaccuaugggauacaccggacgaccuggaccucuuggucagccugguaguccgggacucaaaggcgaaagcggggaucuggguccucaggggccucgggguccgcagggacuaaccgguccaccugguaaagccggcagacgugggagagccggcgccgacggcgcaaggggaaugccgggggaccccggugugaagggugaucguggauuugaugggcuaccuggacugcccggggaaaaggggcaccguggagauacaggcgcgcagggccugccggggcccccuggggaggauggggaacggggcgacgauggagagauaggaccuaggggucucccaggggagagcgggccucggggacugcuuggaccaaagggaccaccgggcauucccggaccacccggcguucgaggaauggacggcccgcagggaccaaagggaagcuuaggcccucagggggagccaggaccaccgggacagcaaggcaccccaggcacccaaggcuugccaggcccgcagggagccauuggcccucacggagaaaagggaccacagggcaagccuggacugccagggaugcccggaucugacggaccucccggacauccagggaaggagggaccaccaggcacuaaagggaaucagggccccaguggaccccagggcccccuaggguaccccggucccagaggggugaagggcguugaugggaucagaggguugaaagggcacaagggagaaaaaggggaggaugguuucccaggauuuaagggcgacaucggcgucaaaggcgacagaggggaggucggaguuccuggcagccgcggagaagacgggccagaggggccaaaaggaagaacagguccuacaggcgauccaggaccaccaggccugaugggagaaaagggaaagcucggcgugcccggauugccgggcuaccccggcaggcagggaccgaagggaagcuugggguucccuggauuuccaggggcguccggagagaaaggggcucgcggccugagcggcaagaguggaccucguggggaacggggaccgacuggaccucgggggcagcgcgguccuagaggcgcaaccgggaagagcggcgccaaaggcacuuccgguggcgauggaccccauggcccgccaggagagagaggauugccugguccacagggcccaaauggauucccuggcccuaaggguccaccugggccacccggcaaagauggacugccuggucaucccggccagcgaggggaaguaggauuucaggguaaaacuggaccuccaggcccacccggcgucguugggccucagggugccgccggggaaacuggcccgaugggugagagaggacacccgggcccgcccggaccccccggagaacaaggacuacccgguaccgccggcaaagaggguacuaaaggagacccgggaccuccuggagcuccuggaaaggacggaccagccggcuugagagguuuuccaggugaacgcggccugccuggaacugcuggugguccgggacucaaaggaaaugaaggaccguccgggccacccggaccugcgggauccccuggcgagagaggcgcugcagggucaggcgggccgauugggcccccuggcagacccgguccucagggcccucccggugccgcaggagagaagggggugccaggugagaaaggucccauuggaccuacugggcgcgaugguguccaaggacccgugggacucccgggacccgcaggaccccccggcguggcaggugaagauggugacaagggcgagguaggcgacccuggucagaaagggacaaaggggaacaaaggggagcacgggccccccggucccccugggccuaucgggccggucggucagccgggugcagcuggagcagacggcgagccaggugccagagggccucaaggacacuuuggugcaaaaggagaugaggggacacgagguuucaauggaccacccggcccaaucggacuccagggccucccugggccaagcggagagaagggagagacaggcgauguuggaccuaugggucccccugguccgccaggaccccgcgguccugccggaccuaacggagcggauggaccucaggguccuccagggggagucgguaaccucgguccccccggcgagaaaggcgagcccggugaaucugggaguccaggcauccagggcgaaccaggcgugaaggguccucguggugaaagaggggaaaagggugagucuggucaaccaggagaaccggguccaccugguccaaaaggucccacuggggaugaugggccaaagggcaauccuggcccuguugguuuucccggugaucccgguccgccuggagaaggagggcccagaggccaggauggggccaaaggagacagaggcgaagauggagagccagggcagcccgggaguccaggcccaacaggugaaaacggaccgccaggaccacuaggaaagcgcgguccugcgggcagcccggguucagaggguagacaggggggcaagggagcaaaaggcgauccaggggcuauuggggcaccugggaaaacaggucccgucgguccggccggcccugccgggaagcccgguccagauggacuuaggggccugccuggcucaguaggacagcagggucguccaggcgcuaccggccaagccggucccccaggaccaguggggcccccuggacucccaggcuugaggggugaugcaggcgcaaagggggaaaaaggccaucccggacugauuggauuaauuggucccccaggggaacagggggaaaagggugaucgcggccugcccggcccacaagguucucccggucagaaaggagagaugggaaucccuggcgcuucuggcccaaucggucccggaggcccuccaggucuuccgggccccgcagguccaaagggcgccaagggcgcaaccggaccaggaggaccuaaaggagagaaaggagugcaagggccacccggccacccuggcccccccggcgaagucauccagccacugccuauacagaugcccaagaaaacccgccgcuccguggacggcucgcgccucaugcaggaagaugaggccaucccaacuggaggggcccccgguagcccagguggcuuagaagaaauuuuuggaaguuuggauucacucagagaagagaucgagcagaugcgccgcccuacaggcacacaggacagccccgcucguacuugucaggacuugaaacucugucacccugaguugccagauggggaguauuggguugacccuaaucaaggcugugcccgggacgcuuuccgaguuuuuuguaauuuuaccgcuggaggcgagacuugcgugacuccaagagacgaugugacccaguuuuccuaugucgacagugaagggucaccaguaggaguaguccagcuuacauuccuacgccuccugucaguaagcgcucaccaagaugucuccuauccuugcuccggugccgcuagggacgguccccugcgguugagaggagccaaugaagaugagcugucccccgaaacgucuccauaugucaaagaguuccgagacggaugucagacccagcagggucguacgguacuggagguuagaacgccaguucuggagcaauugccuguguuagaugccagcuuuagugauuugggggccccuccacgccgugguggggugcuccuggguccuguguguuuuauggguuag

SEQ ID NO: 5388 - RNA, 4953 nt, Artificial Sequence
  Description of Artificial Sequence: Synthetic coding sequence
auggaacguugcucccgaugucaucgacugcuucuacuguugccucugguauuaggccucucugccgccccagguugggccggcgcaccccccguggacguucugcgagcucucagauuuccuucccucccugacggagugagacgggcuaaagggauuugucccgcagacguggccuaucgagucgcacggccagcucaguuguccgccccuacucgacagcuuuuuccggggggcuuuccuaaagacuuuagccugcugacagugguuagaacucgaccuggccuccaggcuccucugcugacacuguauagcgcacagggcguccgucaacuuggccuggaacugggccggccugugagguuucuuuacgaagaucagaccgguaggccacaaccuccaucacagcccguauuccgcgguuuaucacuggcugauggcaaauggcaucgcguugcaguggcagugaagggacagagcguuacacugauuguagauuguaagaaacgagugacgagaccccucccacgcagugcuaggccaguacucgauacgcacggcguuaucaucuuuggcgcccgaauucuggacgaggaaguguuugagggggauguucaagaguuagccaucguuccuggcgugcaggccgccuaugagucgugcgaacagaaggagcuggaaugugaaggcggacagagagaacggccacagaaccagcagccucauagggcacagaggaguccacaacaacaacccuccagauugcaccgaccucaaaaucaagagccgcaaagucaggauccaaccccgggugaggaagaagaaauccuggagucaaguuugcugcccccccuggaggaggcugcgcaugguccacgaggccugaagggugaaaagggggaaccggccguucucgaaccuggcaugcuuguagaggggccaccuggccccgaggggcccgcaggacugaucggaccacccgguauccaaggaaauccugguccagugggggauccuggugaaagaggcccucccggcagagcaggguuaccgggcuccgauggcgcucccggcccuccugguacaucacuuaugcugccuuuccgguucgguucggguggaggggacaaggggcccguagucgccgcccaggaggcucaagcccaggcuauacuccagcaggcaagacuggcccuuaggggaccacccggcccaaugggguacaccggacgccccggcccuuugggccagccugggagcccuggacugaagggggaaaguggcgauuuggguccacaggggccaagggguccccagggauuaacaggcccaccagguaaggccggaaggcgcggacgagccggagcugacggggcucgggggaugcccggcgaucccgguguaaagggagaucgcggauuugacggguugccaggccuucccggggaaaagggucacagaggggauaccggugcgcaaggucucccaggcccuccaggagaagacggagaacgcggagacgauggagagauaggaccucguggguuaccuggugaauccggcccaagaggauugcucggacccaagggcccaccaggcauuccaggaccuccuggggucagaggaauggacggaccucaaggcccuaaaggaagccugggcccccagggcgagccaggccccccaggacagcagggcaccccaggcacucaaggucugcccgguccucagggcgcaauaggaccucacggcgagaagggaccacaggggaaacccggccuaccugguaugcccggcucugauggccccccaggacaccccggaaaggagggcccaccugguacuaaaggaaaucagggaccaagcggcccacaggggccacuggguuaccccgggccacgaggaguuaaaggcguugauggaauccgagggcuaaaagggcacaagggcgaaaagggcgaagauggauuucccgguuucaaaggcgauauuggggugaaaggcgaucggggcgaagugggcgugccagggaguagaggcgaggacggcccagaggggcccaaaggucgcacaggcccaacuggcgauccugguccucccggucugaugggggagaaaggcaaacucggcgugccaggauugcccggguacccuggacgucaggguccaaaaggaagucugggauuucccggcuucccaggugccaguggcgaaaaaggagcgagaggcuuaucggggaaaucaggcccccgaggcgaaaggggaccaacuggcccaaggggccaaagaggcccgcggggcgcaacagggaagaguggagccaaggguacaucuggaggugaugggccacacggacccccuggugaacgaggacucccagggccacagggaccuaacggauuuccuggcccuaaaggaccccccggacccccagggaaggacggguuacccggacaccccgggcaacguggugaggucggcuuucagggcaagaccgguccgccuggcccacccggcguugucgggccucaaggcgcagcuggugagacagggccaaugggugagaggggucaccccgggccuccagggccuccaggugagcaaggccugccaggaacugccgguaaagaaggaaccaaaggcgauccagggcccccaggggcucccgggaaagacggaccugcaggacuccggggcuucccaggagagcgagguuuacccgguaccgccgggggaccaggacugaagggaaaugagggaccaaguggacccccugggccggccgguucucccggagaaagaggggcugcgggcuccgguggaccaauuggccccccaggccggccaggaccgcagggaccccccggagccgcaggggagaagggugugccuggagaaaagggaccgauagggccgacuggacgggaugguguucagggcccagugggacugcccggcccugccgggccaccaggugucgcaggagaagauggggacaagggcgaagucggcgacccaggacagaaaggaaccaaagguaacaaaggggaacauggcccgcccggcccacccggacccauuggaccugugggccagcccggggccgccggugccgacggcgaaccgggagcacgcggaccucagggucauuucggggcuaaaggcgaugaggguacaagaggauuuaacggcccccccgggccuauuggucugcagggauuaccaggacccuccggagagaaaggagaaacuggagacguugggccaauggggcccccaggcccaccagguccccgcgggccagcuggaccuaacggggcagacggcccacaggggccuccaggaggcgugggaaacuuggggccaccaggugaaaagggagaaccaggggaaagcgggagcccuggcauccaaggugagccaggcguaaaggggccgcguggcgagcgaggagagaagggugaaucaggacagcccggggaaccgggucccccuggaccuaaaggaccgacuggggacgaugggccgaaaggaaauccuggcccggugggauuccccggagauccaggaccuccaggugagggcgggccuagggggcaggauggcgcgaagggggauaggggagaagacggcgaaccuggacagccgggaucccccggaccaacaggagaaaaugggccccccggaccacucggaaagcgcggccccgccggcucuccagguagugaaggacgucaaggaggcaaaggagcuaaaggcgacccuggagcgauuggggccccuggaaaaacuggaccggugggccccgccgguccagccggcaagccagggccagaugggcugcggggacuuccugguagcguggggcaacagggcaggccuggagccacugggcaggcggggccccccggcccggucgguccucccggccuccccgggcugaggggugaugcuggagcaaaaggagaaaaaggacauccaggacugaucggccuuaucggcccacccggggaacaaggcgagaaaggcgacagaggacugcccggaccacaaggaagccccggucagaaaggagagauggguaucccgggcgcgagcggacccauaggcccuggaggcccuccuggccugccaggucccgcuggcccuaaaggugcuaaaggcgcaaccgggcccgguggaccaaagggcgagaaagggguacagggcccgccagggcacccuggcccuccuggagaagucauccagcccuugccgauucagaugccaaaaaagacccgcagaagcguugauggcucacggcucaugcaggaagaugaggcaauaccuacuggcggcgcccccggaagcccaggaggccuggaagaaauauuuggaucacuggauaguuugcgagaagagaucgagcagaugcgaagacccacagguacacaggacagccccgcccguacaugucaggaucuuaaacucugccacccugaacugccugauggagaauauugggucgauccaaaucaaggcugcgcucgggaugcauuuagaguauucuguaauuuuacugccggcggcgaaacuugugugacaccaagggacgacgugacucaguucagcuauguggauucagaggggucucccgucggcgugguucaauugacuuuccugcgccuguugucgguaagcgcccaucaagauguguccuauccaugcagcggggccgcaagagauggcccauugaggcugaggggggcuaacgaggaugagcuaaguccugaaaccucaccguaugucaaagaguuccgcgauggcugucagacccaacaaggaaggacaguacuagaaguuaggacccccgugcuggaacaguuaccagugcuggacgcuagcuuuuccgaccucggugcuccuccuagacguggcggcgugcugcuaggccccguuugcuuuaugggcuag

SEQ ID NO: 5389 - RNA, 873 nt, Artificial Sequence
  Description of Artificial Sequence: Synthetic coding sequence
auggaacgcugcaguaggugucacagacuguuacuccugcucccccucgugcuggguuugucagccgcuccuggcugggcuggcgcaccccccguggauguuuuacgagcccugagauuuccgucccugcccgauggcgugcguagggcaaaaggaauauguccagcugacgucgccuauagaguugcacgccccgcucagcugagugcuccaacccgccaauuguuccccggaggcuucccaaaggauuucagccugcuuacagucguucgcacaaggccaggcuuacaggcuccccuccucacucuuuauagcgcccaggguguacggcaauugggucuggagcugggcagaccaguacgcuuccuauacgaggaccagacuggcagaccccaaccucccucacagccgguguuuagaggccugagucuggccgacggaaaauggcaccgcgucgccguagcagucaagggccaguccgucacgcucauaguggacugcaagaagcgcgugacucgcccccucccccgcagcgcaagaccaguguuagacacgcauggggugauuauuuucggagcucgaauacucgacgaagagguauuugaaggcgauguacaggagcucgccauugugccaggcguccaggcugcguaugaaucuugugaacagaaggagcuggagugugaaggagggcagagagagcgaccccaaaaccagcaaccgcacagagcacaaaggucuccacagcagcagcccagucggcuucacaggccacagaaucaggaaccccagucccagguccgcgagcugggugagccccccucugcugcacacccuagagagggacgacaccccggaauuucccccccguag

SEQ ID NO: 5390 - RNA, 1875 nt, Artificial Sequence
  Description of Artificial Sequence: Synthetic coding sequence
auggagcgguguucucguugccauagauugcuucuccugcuaccucugguacuuggucuaucugccgcaccuggcugggcuggcgcaccacccguagaugugcugcgggcccuccgauucccaucccugccagauggugucaggcgcgcaaaaggcauaugcccugccgauguugcuuaccgagucgccaggcccgcccagcuuagcgcaccaacccgucagcuauuucccggaggcuuucccaaggauuuuagucugcucacaguaguuaggaccagacccggacugcaagccccacugcugacacucuauuccgcacaggggguuaggcaacugggccuagagcucgggcgcccagucagguucuuguaugaagaucagaccggcaggccucagccaccaucccaaccaguuuuccgcggguuaucccuggccgacggcaaguggcaccgcguugcagucgcugugaaaggccaguccgucacacucauuguagauuguaaaaaaagagugacccggccguuaccuagauccgcccgccccguacuugacacucacggaguuauuauuuucggugccaggauccucgacgaggaggucuucgagggggauguccaggagcuugcaauuguacccggaguccaggccgcuuaugagagcugugagcaaaaggaacuggagugcgaaggaggccagagggaaaggccacagaaucaacagccacaucgcgcccaacggaguccccagcagcagccaucccgacuucauaggccgcagaaccaagagccacagagccaaccaacagagucccuuuauuaugauuacaaaccgcccuacuaugaugugaugaccaccggcacuacccccgauuaccaggaccccaccccaggagaagaggaggagauucuugagaguucccugcugccgccgcuggaagaagagcagaccgacuuacagguuccaccaaccgcagaccgauuccaggcggaagaguauggcgagggcggcacagauccaccagagggccccuaugacuacaccuauggauauggggacgauuauagggaagagacagaacugggaccagcauuaucagcagaaaccgcacacuccggagcugcagcccauggaccccgcggccugaagggagagaagggcgaaccagcugugcuagaaccaggaaugcucgucgagggaccuccuggucccgaggggccugcgggcuugauaggacccccaggcauccaagguaauccagguccugugggugacccaggcgagcgcggaccaccaggcagggcaggccucccagggagcgacggcgcacccggaccccccggaaccucccugaugcugccauuucguuucggcucaggcggaggugauaaaggaccagugguggcugcucaggaagcucaggcucaggccauucuacagcaagcuaggcuggcacugcgaggacccccuggcccgaugggauacacaggcaggccaggcccacugggacaaccuggaagcccuggcuuaaaaggcgagagcggagaucuuggcccccaggggccacgcgguccacagggccuaacgggaccaccgggcaaggcaggaagacgggguagagcaggagcagauggggcccgggguaugccaggagacccuggggugaagggcgauaggggauuugauggguugccuggccugcccggcgagaaggggcaucgaggcgacacuggugcacaaggacugccaggacccccgggugaagacggggagagaggggacgacggagagaucgguccgagaggacucccuggcgaaagcggccccagaggucuguuaggcccaaaaggaccucccggaaucccaggaccccccuag

SEQ ID NO: 5391 - RNA, 1875 nt, Artificial Sequence
  Description of Artificial Sequence: Synthetic coding sequence
auggagcgguguucccgcugucaccgauugcugcucuuacucccccugguccuaggauuguccgcugcuccagggugggccggcgcuccuccuguugacguucuuagagcacugcguuucccuucacuuccggauggcgugagacgugcaaaagguaucugcccggcugacguugccuacaggguugcacgccccgcccagcugucugccccuacuaggcaacuguuucccggaggcuuuccgaaagauuucucacuccugaccguggugcgcacccgccccggcuugcaggcaccacugcucacucuguauagcgcccaaggagucagacagcuggguuuggagcugggacgacccguuagauuccucuacgaggaccaaacuggccgcccccagccaccuucucagccuguuuuccggggauugucucuggcugauggaaaguggcaucgugucgcuguggccgugaaaggacagagugucacacugauugucgauugcaagaaacgcguuacuaggccuuuaccuagaucagcacgaccuguacuggauacccauggcgugauaaucuuuggggcccggauccuggaugaggagguuuuugaaggugaugugcaggaauuagcaaucgucccuggugugcaggcugcauacgaguccugcgagcagaaagaauuagaaugugaggggggacaaagggagcgaccucagaaucagcaaccacaccgugcucagaggaguccacagcagcaaccgucccggcuccacaggccucagaaccaagagccccaaagccagccaaccgaaucuuuauauuacgacuacgaaccuccguacuacgacgucaugaccacaggcacuacuccugauuaccaggauccuacccccggagaggaagaggagauucucgagagcuccuuauuacccccguuagaggaagaacagacggaccuucaggugcccccuacugcugacagauuucaagcggaggaguacggugaaggugggacagacccgccagaagggccauacgauuauaccuacggcuacggagaugacuauagagaggagacagaacugggcccugcccuuagugcggagacagcccauaguggagccgcagcucacggcccucgcggacugaaaggcgaaaagggggagcccgcuguccuggaaccugguaugcugguagaaggacccccaggaccagaagguccagccgggcuuaucgggccacccggcauucagggcaauccaggaccugucggcgaccccggcgaacgcggccccccugguagagcuggccugccuggcagcgauggcgcucccggaccuccugguacaucacugaugcugcccuucagauuugguaguggcggcggcgauaaagguccuguugucgcagcccaagaggcucaggcccaggccauucugcagcaagcaagguuggccuugcgaggacccccuggaccaaugggcuauacuggacgcccagggccacucggacagcccgggaguccaggacugaaaggggaaucaggugacuugggaccacaggggcccagggguccucaaggacuaaccggaccccccggaaaagcaggcagacggggacgcgcgggggccgauggugcaaggggaaugcccggagaucccggcguuaagggggaucggggguucgacggguugccuggacugccaggggaaaagggucauaggggagauacaggugcccagggccuccccggcccgccaggcgaggauggcgagaggggagaugacggggagauuggaccaaggggucucccuggcgaaucuggaccucgaggacuacucggcccaaagggaccacccggaauuccuggccccccguag

SEQ ID NO: 5392 - RNA, 5031 nt, Artificial Sequence
  Description of Artificial Sequence: Synthetic coding sequence
auggagcgcuguagccgcugccaccgccucuuacuucugcugccccugguucugggccugucggcggcaccugggugggcaggugcucccccaguggaugugcugcgagccuugcgcuucccaagcuugccugacggaguucgaagagcaaagggaaucugucccgcugauguggcuuacagaguggcccgaccugcccaguuaagcgcuccuacucgccaauuauuccccggagguuuucccaaggacuuuucuuuacugacggucguacgcacuaggccuggucuccaagcccccuuauuaacccucuauagcgcccaaggcguuagacagcugggccuugaacuugggaggccuguucguuuccucuacgaagaucagacgggacguccacagccaccuagccagccaguguuuaggggcuuaagucucgcugacggcaaguggcacagagucgcuguagcuguaaagggccaguccgucacacucaucguggauuguaaaaagcggguaacgagaccauugccacggagugccaggcccguacuggauacacauggagucaucauuuuuggcgcccggauccuggacgaagaagucuuugagggagauguucaagagcuugccauuguaccaggaguacaggccgcauaugagucuugcgagcagaaggaauuagaaugcgagggcgggcaaagagaaaggccacagaaccagcagccacauagggcucagagguccccccagcagcagcccagucgacuucaccgcccacagaaucaagaaccccagagccagccuacagaaucucuuuacuacgauuauaagccccccuauuaugaugugaugacaacaggaaccacaccagauuaccaggaucccacacccggugaagaagaagaaauccuggaaaguucacuucugccaccacuugaggaagcugcucacggacccagaggccuuaagggugaaaaaggcgagccagccguuuuggagccugguaugcuuguggaggggccuccugggcccgaaggacccgcaggacucaucggaccaccagggauccaaggcaaucccggaccugucggagauccaggagaacgaggaccccccgggcgggcgggcuuaccugguuccgacggagcgccaggucccccgggaacuagccugaugcugcccuucagauucgggaguggugggggugauaagggcccgguaguggcugcccaggaggcacaagcccaggcaauuuugcaacaggcgcgacuugcgcucaggggucccccaggccccauggguuacaccgggcgacccggaccucugggacaacccggcagccccggccucaagggggagagcggcgaccuaggaccgcaggggccaaggggaccacaggggcucacugguccuccagggaaagccggacgacguggacgagcuggugccgacggggcucggggaaugccuggggacccugguguaaaaggcgauagagguuuugauggauuaccaggacugccaggagaaaaaggccaucggggggauacaggagcucaaggacucccugguccgccaggcgaggacggggaacggggagacgacggagaaaucggcccgaggggccuaccuggggaaagcgguccaagaggccuguugggcccaaaggguccacccgggaucccugggccccccggcguaagagggauggacgguccgcagggacccaaaggcucauuaggaccacagggcgaaccgggcccaccaggacagcagggcacucccggaacacagggacucccaggaccgcagggagcaauugggccccauggggaaaagggaccgcagggaaaaccaggauuacccgggaugccaggcagcgacggaccgccaggacauccagguaaagagggucccccaggaaccaaaggaaaucagggucccucaggaccacaggggccucugggguauccaggcccacggggcgucaaaggaguagacgggauccgaggacugaaaggccacaaaggugagaaaggcgaggauggcuucccaggguuuaaaggcgacaucggcguuaaaggagacagaggcgaagugggagugccggggagcaggggcgaagauggaccggagggacccaaaggucgcacuggcccgacgggggacccagggcccccagguuuaaugggagaaaagggcaagcucggugugcccggacuuccaggcuacccuggcagacaaggcccuaaaggaucacucgguuuuccuggcuuuccaggggcuagcggcgaaaagggagccaggggucugucaggcaaguccggcccucguggugaacgcggacccacaggcccacgcggacaacggggaccacgcggcgccaccggcaaaucgggggcuaagggcacuagcggcggagauggaccucacggacccccuggugagaggggccucccaggcccacagggaccuaauggcuuucccggcccaaaaggcccgccuggcccuccaggcaaagauggccuucccggacaucccggacagcgcggggaagugggguuucaaggaaaaacaggcccuccuggaccgcccgggguuguagggccucaaggcgccgcgggagagaccggccccaugggcgaacguggccauccaggcccuccuggcccacccggagagcagggacucccaggaacagcggggaaagagggcacaaagggcgaccccggaccuccaggcgcaccaggcaaagauggcccugccgggcuucguggguuucccggagagcgcggguuaccaggaaccgccggcggucccggguugaagggcaaugaaggaccgagcggcccaccugguccagccggauccccuggcgagcguggcgcagccggaagcgggggaccgauaggaccuccggggcgaccagguccccaggggccacccggagccgcaggagaaaaaggagugccuggcgaaaaggggccaaucggcccgacugggcgggaugguguucagggaccggugggucucccaggaccagcaggcccaccaggcguggccggagaggauggagacaagggcgaagucggagauccaggccagaaaggcaccaaagguaacaagggagaacauggaccaccagggccaccuggucccauaggccccgucgggcagccuggugccgcgggggccgacggcgaacccggagcgagaggaccgcaggggcauuuuggcgccaagggugaugagggaacacgaggcuucaauggaccuccaggacccauaggacuccaagggcugccaggaccuagcggcgaaaagggugagacaggggacgugggcccaaugggaccuccagggcccccuggaccucgaggcccugcaggccccaauggcgcggauggaccucaggguccuccgggaggcguuggcaaccuugggccacccggagagaagggcgaaccuggggagagcgggagcccaggcauccaaggagagcccggagugaaaggcccgcgcggggaacgcggagagaaaggcgaaucaggacagccaggagaacccggaccuccaggccccaaaggacccaccggugaugacggccccaaggggaauccuggaccagugggcuuuccaggcgacccuggcccacccggugaggggggaccucgggggcaggauggagcgaaaggggauagaggcgaagacggcgagccugggcagcccgguucuccuggaccuacuggcgagaacggcccgcccggaccucuggggaagaggggcccugcuggcucuccaggaucggaaggaaggcagggcgguaaaggagcaaagggggacccuggagcgaucggagcaccaggaaagacgggucccgugggucccgcaggaccagcaggcaaaccugguccagauggcuuaaggggucuuccagggagcgucgggcagcaaggccggccaggagcaacuggccaggcagguccucccggucccguuggacccccaggccugccaggguugcgcggcgaugcaggagcaaaaggcgagaagggacauccagguuuaauagggcugaucggccccccaggggaacagggugagaaaggagaucgaggccuaccgggaccccaaggaagcccagggcaaaagggcgaaauggggauccccggagccaguggaccuauuggaccuggcggcccaccagggcugccagguccugccggccccaaaggagcgaagggggccacgggacccggaggacccaagggcgaaaaagggguucaaggaccuccaggacaucccggccccccgggcgaagugauccagccucuaccaauccaaaugcccaaaaaaacaagaagauccguggaugggagucgucuuaugcaggaggaugaagcaauccccaccgguggugcuccugguucuccaggcggccuggaagaaauuuuuggcucacuugauagcuuacgcgaagaaauugagcaaaugagacgucccaccggaacucaggauucacccgcccggacuugccaagacuugaagcucugccauccugaacugccggauggggaauacuggguggaccccaaccaaggcugcgcucgcgaugcuuuccgagucuuuuguaauuuuacugccggaggugaaacuugcguuacuccaagggaugaugucacgcaguucagcuauguagauagugaaggcucuccaguuggcguugugcaacugaccuucuugaggcuuuuaagcgucucugcucaucaggacgugagcuauccuuguucgggugccgcacgugacgguccucuucgucuuagaggagcaaaugaagaugaacucucuccugagaccuccccauauguuaaggaguuucgugauggcugccagacccagcaaggaaggacuguucuggaagugcggaccccagugcucgagcaguugccggugcucgaugcuucauuuucugauuugggcgcaccaccuagacgaggcggagugcuauuagguccagugugcuuuaugggguag

SEQ ID NO: 5393 - RNA, 5133 nt, Artificial Sequence
  Description of Artificial Sequence: Synthetic coding sequence
auggaaagauguaguagaugucaccgacuucugcuguugcugccccuuguacuuggucugucagccgcucccggaugggcaggggccccgcccgucgacgugcuuagagcacugcgguuucccucccucccagauggcgugcgucgagccaaaggaauuuguccagcugauguggcauacaggguagcccgaccggcccagcuuucugccccaacucgucagcuguucccaggaggcuuuccaaaagauuucucucugcugacugucguaaggacuagaccuggucugcaagcuccccuccugacccuauacucugcucaaggcgugaggcagcuaggccuugaacucggcaggccugugagauuccuauacgaggaccaaaccggucggccucaaccucccagccaaccaguuuuuagagggcugagccuggccgacggcaaauggcauaggguggcaguugcgguuaaagggcaauccgucaccuugaucguugacugcaaaaaacgagucacuagacccuugccucggagugcgcgcccuguguuggacacccacggaguuauaaucuucggagcccgaauccuagacgaagagguauuugagggcgaugugcaagagcuagcaauugugccaggggugcaggcugccuaugagucaugcgaacagaaagaauuagagugcgagggaggccagagggagaggccucaaaaccaacagccucauagggcacagagaucaccgcagcaacaaccaucacgccugcaucggccacagaaccaggagccacagagccaagauccgacccccggcgaagaagaagagauccuggagucaagccuuuugccaccguuggaagaagaacagacagaccuucaagugccuccuacugccgaccgcuuucaggcugaggaguacggggaaggaggcacugaccccccagaaggaccauaugauuacacauacggauauggcgaugauuaucgcgaagaaacugaauuaggaccagcccuuagugccgaaacagcccacuccggcgcugcggcacauggaccucgaggauugaaaggagaaaagggcgagccagccgucuuggagccagguaugcuaguggaaggcccgcccgggccagaaggccccgccggauugaucggcccaccgggcauccaggggaaccccgggccugucggggacccaggugagaggggcccccccggcagagcaggacuucccggcagugacggcgccccagggccaccaggcaccucucucaugcucccuuuccgguucgguagcggaggcggcgacaaaggaccagugguggcagcacaggaagcacaggcucaagcgauccuacagcaggccagacuggcccugcgcggacccccagggcccaugggguacacuggacgccccggcccccugggccagccugguuccccaggccucaaaggagagucaggagaucugggaccacagggcccccggggcccucaaggacugacagggccaccaggcaaagccggccgucgaggacgcgcaggggcagacggcgccaggggcaugcccggcgaucccggaguaaagggcgacaggggguuugacggccugccaggccuuccuggggagaagggucacagaggcgauacaggcgcgcaagggcucccagguccccccggagaagacggugaaaggggcgacgacggagaaauugggccacggggacucccaggcgagucagggccacguggguugcuggggccaaaaggaccaccgggcauucccggucccccgggagugcgagggauggacgggccucaagggcccaaagguucucugggaccacaaggcgaaccaggaccccccggacagcaagguacacccgggacccagggucugcccggcccccagggcgcaauagguccgcacggggagaagggaccacagggaaagcccggcuuaccagguaugccagguuccgauggcccaccaggccacccagggaaggaaggccccccuggaacgaagggaaaucaagggccaucaggcccucaagguccacuaggcuauccuggcccaagaggugugaaaggcguagacgggaucagaggacugaaaggacauaagggcgagaagggcgaagauggguucccaggcuuuaagggcgacauuggugugaaaggugauaggggcgaggucgguguucccggcucucgaggcgaggacggacccgagggcccaaaaggccggacugguccaacaggugauccagggccccccgggcugaugggagagaaaggaaaauuaggugugccaggucuaccaggguaccccggccgucagggccccaagggaagccucggcuuccccggcuucccaggagcaucaggggaaaagggcgcuaggggucugagcggcaaaucuggaccaagaggugaacgagguccaacuggcccgaggggccagaggggucccaggggagcuaccggcaagagcggugcaaagggaacgagcggcggggauggaccucacgggccacccggcgaaagaggacugccuggaccccaggggccaaauggauuucccggcccuaaaggaccucccgguccucccggcaaggauggucugccagggcacccuggacaaagaggugagguuggcuuucaagggaaaaccggacccccuggcccuccaggaguggugggaccccagggcgccgcuggcgaaacaggccccaugggagaacgaggacaccccggaccacccggaccuccaggggaacagggucugcccggcacagcagguaaggaagguacuaaaggcgacccugggcccccuggggcaccaggaaaagauggaccagcagguuugcggggcuuuccuggugaaagaggcuugcccggaaccgccgggggcccagggcuuaaaggaaaugaagggccuucagguccuccugguccagccgguucuccaggggaaagaggagcagcugguuccggcggacccaucggcccgccaggaaggcccggcccacaaggaccucccggcgcugccggugaaaaagggguaccgggggaaaaaggaccuauagggccuacagggcgagacgggguacagggaccgguagggcucccaggaccugcaggcccuccuggcguggccggggaggauggugacaagggugaaguuggcgaccccggacagaaaggaacuaagggaaauaagggcgagcacgggcccccgggaccgccgggaccuauaggaccggugggucaaccuggagcggccggagcugauggagaaccuggagcacgcggaccucaaggucauuucggcgccaagggagaugagggaacacggggcuuuaacgggcccccaggacccauagggcuucaaggguuaccugggccaagcggagagaagggagagacaggcgacguuggucccauggggccacccggcccaccuggcccccgcgggcccgccggacccaauggugcagacggcccacagggaccacccggcggaguggguaaucucggaccucccggcgaaaaaggcgaaccgggugagucggggucgcccgguauacagggugaacccgggguaaaagguccacggggugagaggggggagaagggagagucaggucagccgggagaaccuggaccacccggaccuaaaggcccuaccggggacgauggaccaaaaggaaaucccggcccuguaggcuucccaggggaccccggcccucccggugaagggggaccgcgcggacaagauggcgcaaagggagacaggggggaagauggcgaaccuggacaaccaggcucuccagggccuacgggagagaacggcccuccagggcccuuggguaaacgcgguccugcagguaguccaggcagcgagggaaggcagggaggaaaaggagcaaaaggcgauccgggcgcgauuggcgcaccaggcaaaaccggaccagugggccccgcaggacccgcuggcaaaccuggaccagaugggcuuagaggguugcccggcagcgugggacaacaaggucgcccuggugcuacaggacaggcagggcccccuggcccaguuggcccuccuggucuccccgggcugaggggcgaugcaggggccaagggcgagaaggggcaccccggacugauaggcuugauuggaccuccaggugaacagggcgagaaaggggauagaggccugccugguccacagggcaguccuggucagaaaggugaaaugggcauacccggcgccagcgggcccaucggaccuggcggcccacccggccuccccggcccagccggaccuaagggagcuaagggcgcuacuggcccgggaggaccgaagggcgaaaagggcgugcagggaccacccggucauccuggaccaccaggggaagucauucagccccugccgauccagaugccaaagaagacucgacguagcguggaugggagucgauugaugcaggaggaugaagccauccccacaggcggcgccccuggaucuccuggcggacuagaagaaauuuucggcagccuggacucgcuacgagaagaaaucgaacagaugcggagaccaacagguacacaagacuccccagccaggacaugucaggauuugaaacucugucacccugaacucccagauggcgaauacuggguggacccuaaccagggcugugcuagagacgccuuucguguauuuuguaauuuuaccgcuggcggagagaccugcguuacuccucgggacgauguuacacaguuuagcuaugucgacuccgaaggaaguccagugggagucgugcaacugaccuuucuccgucuacucaguguauccgcacaucaagauguguccuauccaugcucaggcgcugcucgggacggaccauuaagacugcgaggugcgaacgaggaugaacugucgcccgaaaccucuccauacgugaaggaguuucgagauggaugucagacccagcagggcagaacaguccucgagguuagaacaccagucuuagaacaguugcccguacucgaugccuccuuuucugaccugggcgcgccuccgaggagggguggcgugcugcuugggccuguuuguuucaugggauag

SEQ ID NO: 5394 - RNA, 5211 nt, Artificial Sequence
  Description of Artificial Sequence: Synthetic coding sequence
auggaaagauguucuagaugccaccgacugcuguugcugcugccccucguccucgggcugucagccgcuccuggcugggccggggcgccucccguggauguccucagagcauuaagguucccuagucugcccgaugggguccgaagggccaagggcauuuguccagccgacguggccuauagaguggcacgaccagcacaguuguccgcaccaacacgacaguuauuccccggcggauucccuaaggauuucucauuacugaccgugguuaggacacgacccggauugcaggcuccucuauuaacucuguacagugcucaagguguucggcagcuuggccuagaacuggggcgacccguccguuuccucuaugaagaucaaaccggacgaccacagccuccuagccagccaguguuucgcggucuuucccuggccgauggaaaauggcaucgaguugcuguagcggucaaaggacagaguguaacuuugauagucgauuguaaaaagcgagugacacgaccccucccccguuccgccagaccuguauuagauacccacggggugaucauauucggagcaaggauacucgaugaggagguguucgaaggagauguacaagaauuggcaauaguccccggagugcaagcagcauaugaaagcugcgaacagaaggaauuagagugugagggcgggcagagagaaagaccccagaaccagcaaccucaccgugcucagagaagcccgcagcaacaaccuucccgccugcaccguccccaaaaccaggaaccccagucucaaccaaccgagucucuguacuacgacuauaagcccccuuauuacgacgucaugaccaccggaacaacucccgacuaucaggacccuacucccggugaggaggaagaaauccuugagaguucuuugcugccaccucuggaggaggaacagaccgaucuucaggucccccccaccgccgaucgguuucaggcagaggaguauggugagggaggcaccgaccccccugagggcccuuacgauuacaccuacggguauggagacgauuacagagaagaaacggaauuaggcccagcauugagugcagaaacagcccauucuggcgccgcggcacauggaccacgcgggcuaaagggagagaaaggcgaacccgccguucuugaacccggaaugcugguugaaggacccccuggcccugaggggccugcagggcuaaucgggccccccggaauucagggaaauccgggaccggugggcgauccgggagaaagaggaccaccuggcagagccggacugccgggauccgauggagccccuggcccucccgguacaucuuugaugcugccauuucgguucggaagcggcgggggagacaaggguccaguuguggcggcacaggaggcucaggcgcaggcaauauuacagcaggcacgcuuggcucuccgcggccccccaggcccuauggguuacacaggacggccuggcccacuaggacaaccuggaucccccggccugaaaggugagaguggugacuugggaccccaaggaccucguggcccacagggacuuaccgggccacccggcaaagcagguaggagggggagagcuggagcugauggagcacgcgggaugcccggcgaccccggcgugaaaggugacagaggauucgauggccuuccuggguugcccggcgagaaagggcacaggggagacacaggagcgcaaggauugccuggcccuccuggggaagacggagaaagaggggacgacggcgagauuggcccaagaggucugcccggggaaagcggaccaaggggacugcuuggucccaaagggcccccagggaucccggggccaccuggaguacgcggaauggauggcccucagggccccaaaggcuccuuaggaccucaaggcgaaccuggaccaccuggacaacaggguacccccggaacccagggacucccaggcccccaaggagcgauuggcccccacggagagaaagguccucagggcaaaccagggcugccuggcaugccaggaucagacggaccuccgggacacccuggcaaggaagguccacccgggacuaaagguaaucagggacccagcgguccacagggaccucugggguacccaggaccucgaggcguaaaaggcgucgacgguauuagaggcuugaaggggcacaagggcgaaaagggcgaggaugguuucccuggauuuaaaggugauauuggcguaaagggcgacagaggagagguaggagugccaggcucgcgcggggaggacggaccagaagguccaaagggaagaaccgggcccacaggagacccaggaccucccgggcuuaugggcgaaaagggcaaacuuggagucccaggauuaccagguuaccccggucggcagggaccaaaaggaucacucgguuuuccagguuuccccggcgcuucaggugagaaaggugcucgcggacugucugguaaaucaggcccacggggugaaaggggccccaccgggccacggggacagagagguccacgcggagcgacaggcaagagcggggcuaaggggacuagcggcggugacgggccucacggcccccccggcgagagaggccuccccggcccccaagggcccaauggguuuccagggccaaaaggucccccaggcccccccgguaaggacggccugccuggacauccuggccagcgaggugaagucggcuuccaaggcaagacggggccucccggaccacccggaguaguuggcccacagggggccgcuggugagacagggccaaugggagagagaggucacccuggacccccgggacccccaggagaacagggacugccgggcacugcgggaaaggagggcacuaaaggggacccggggccuccuggcgcaccuggaaaggauggaccugcgggucugcgggguuuucccggagagagaggacuaccaggaaccgccggcggcccugggcucaaggggaacgaaggaccgaguggccccccuggcccagcggguagucccggggagcguggcgcugcaggcucaggcggacccaucgggccucccggacgccccggaccgcagggaccacccggagcagccggggagaagggaguucccggcgagaaaggaccuauuggcccaacggguagagauggcgugcagggcccuguagggcugccaggaccggccggucccccuggcguggcuggcgaggacggcgacaaaggggagguaggcgaccccggucagaaagguacuaagggaaacaaaggagaacauggaccucccggacccccuggaccaauuggaccggucggucagccuggggcagcuggggccgacggcgagccaggcgcacgaggcccucaagggcauuuuggggcuaaaggugacgaaggaacuagaggauuuaauggccccccaggaccaaucggacuccagggccugccaggccccagcggagagaaaggugaaaccggcgaugugggaccuauggggccaccuggaccuccugggccgcggggccccgcgggaccgaauggcgcagauggaccacagggaccgccgggcggcguuggcaaucugggaccacccggugaaaaaggcgaaccuggagagagcggaucaccugguauccaaggcgagccaggagugaagggcccaagaggcgaacgcggagaaaaaggagaaagcggacagcccggggaaccaggaccuccaggaccaaagggccccaccggagacgaugguccaaagggcaauccagguccgguaggcuucccaggggauccugggccgccgggugaggguggaccgcgggggcaagacggcgcaaagggugauaggggagaggacggggagcccggccagccagggagcccuggaccgacaggcgaaaacggcccuccaggaccauuggggaagcgcggaccggccggaucgcccggaagcgaaggccgacaaggcggaaaaggagcaaaaggggaccccggagcuaucggagccccaggaaaaacuggccccguugggcccgccgggccggcuggaaagccgggaccugacggccuacgaggccugccagggagcguuggacagcaaggaagaccaggagcuaccgggcaagcaggaccaccagguccuguugggccaccuggccugcccggauuaagaggcgaugcuggugccaaaggggaaaaagggcauccaggacuaauuggacuuauuggacccccgggagagcagggggagaagggggacagagggcucccgggcccccaggguucaccugggcagaaaggagaaauggguauuccuggggcgagugggccuaucggucccggcggaccuccuggacugcccggaccugcggggccuaaaggagcaaaaggcgccaccggaccuggcggcccuaaaggcgaaaagggagugcagggcccaccugggcauccaggcccuccuggggagguuauccaaccuuuaccaauucaaaugccaaagaagaccagaagaucuguggaugggagcagauuaaugcaggaggaugaagcgauacccaccggcggcgccccuggaagccccggcggccucgaggaaauuuuugguucucucgacucacuuagggaagaaauugagcaaaugcggcgcccaacgggaacccaggacucucccgcgcgcaccugccaggaucugaaacugugccacccagagcugccagacggagaauauuggguagauccaaaccagggaugugcaagggaugccuucagagucuuuugcaacuucacugcagguggcgaaaccugugucaccccccgcgaugacgucacccaauuuucauacguagacucagaaggaagcccugugggugucguccagcuuacauuucuucgccugcucagugucucagcccaccaggauguuagcuaucccuguagcggagcugcucgcgacggcccauuaagacuccggggcgccaacgaggaugagcuuucaccagagacuagcccuuacgugaaagaauuuagagacggcugccaaacccaacaaggccgaaccguauuagagguuagaacacccguguuggaacaguuaccgguucuugacgcuucuuuuuccgaccuuggcgccccucccagacgcggagguguguuacuugguccagucugcuucaugggauag

SEQ ID NO: 5395 - RNA, 5070 nt, Artificial Sequence
  Description of Artificial Sequence: Synthetic coding sequence
auggagcggugcagucguugucaccgucugcuucugcuguuaccucugguacuuggacuuucugccgcucccgggugggcgggggcucccccgguggacguccugcgcgcauuaagauucccuucgcuaccagauggcguccguagagcuaaaggcauaugcccugcugauguugcauaucguguugcacgcccugcgcagcuuuccgcacccaccagacaacuuuucccaggagguuuccccaaggauuucagucugcucacagucguacgaacacggccuggacugcaagccccacugcucacuuuguacuccgcccagggcgugcgacaacugggauuagaguuaggccgcccagugcguuucuuguacgaagaccagacaggaagaccucaaccuccuucucagccagucuuccgcggccucaguuuagcagaugggaaauggcaccgggucgcugucgcggugaagggacaaucaguuacccugaucguugauuguaagaaaagagucacaagaccccuucccagaucugccaggccagugcuggacacgcauggcgugaucaucuucggagccaggauuuuggaugaggaagucuucgaaggagacguucaggaguuggcaaucgugccgggugugcaggcagccuaugaaucuugcgagcagaaggaacuggaaugugagggcggacagagagaacguccacagaaucagcagccucauagggcgcagagauccccacagcagcaaccgucacgucuacaccgcccccaaaaucaggagccccagucccaagaacagacagaucugcagguuccaccaaccgcugauagguuucaagcagaagaauauggagagggagggacagaccccccugaggggccuuaugacuauacauacggauacggugaugauuauagggaagagacggaguugggaccggcacucucugcagaaacugcucacaguggugcugcggcccauggaccucgcggacugaaaggggaaaaaggcgagcccgcugugcuagaaccugggaugcugguggagggcccacccggacccgagggaccugcuggccucaucggcccaccuggcauccaaggaaauccuggcccagucggcgauccgggagaacgcggaccuccaggaagagcuggccuaccaggcuccgacggugcaccuggaccaccuggaacgaguuuaauguuaccauucagauucgguucaggaggaggagauaaggggccagugguggcagcacaggaggcacaggcccaggcaauccuucagcaggccaggcuggcccuaaggggaccgccuggacccaugggcuauacaggcagaccugguccgcuggggcagcccggauccccagggcucaaaggugagaguggcgaccuagggccucaaggucccaggggcccccaaggauuaacugguccaccaggcaaggcugggcgacgaggaagggccggggcugacggugcaagagggaugccuggcgacccaggagugaaaggcgauagaggcuuugacggacugcccggccugccaggugagaaaggccaccgaggcgauacuggagcacagggacuuccugguccuccaggugaggauggagagagaggagaugacggugagaucggaccccgcggacucccaggagaauccggaccccgggggcuucugggcccuaagggacccccugggaucccggggccaccaggugugcgcgguauggacggaccccaggggccaaagggaagcuuaggaccucagggcgaaccagggccgcccggacagcaaggcacaccuggaacacagggauugcccggaccacagggcgcaaucggcccacauggagaaaaagggccgcaaggcaagcccgguuugcccggcaugccaggaucagacgguccucccgggcacccagguaaagaaggcccaccagguaccaagggaaaucagggucccucgggcccucaggguccccugggcuaccccggaccuagaggagugaagggaguggacgguauccgcggccucaaggggcacaaaggugagaaaggcgaggacggcuucccaggcuucaaaggugauaucgguguuaaaggggacagaggcgaaguugguguaccuggcagccggggugaggauggccccgaagguccuaaaggucggaccggcccgaccggugauccagguccgccuggacugaugggugaaaaaggaaagcuuggcguuccaggucucccuggguacccuggacggcagggcccuaagggaucauuaggcuuuccuggcuuuccuggggcuucaggggagaaaggggcuagaggacuaucuggaaagagcgggccucggggugagcgaggcccaaccggaccccgugggcagcguggcccacguggagcuacaggcaagucaggggcaaaaggaacuagcgggggcgauggcccacacggaccacccggugagcgcggucuuccaggcccccaaggucccaacggcuuuccagggccaaaggguccuccggguccuccagggaaagauggucuaccagggcacccaggccagcggggcgaaguugguuuucaaggcaaaaccggcccuccaggcccuccaggagugguuggaccacagggggcugcuggugaaacuggcccaaugggagagcgcggccacccaggccccccggggccccccggcgagcagggccugccaggaacugcagguaaggaaggcacaaaaggagaucccgggcccccaggcgcacccgggaaggacggccccgccggauuaagaggguuuccaggagagcgcggucucccugggaccgcuggcgggccaggccuuaaaggaaaugaaggaccaaguggacccccuggucccgcaggcagcccuggggagcguggugcggcgggcagcggaggaccaauugggccaccaggcagacccggaccacaaggaccuccgggggcggcgggcgaaaaggggguaccaggagagaagggaccaauugguccaacugguagagacggcguucaaggaccgguuggacugccuggcccagcaggaccacccgguguggcaggagaggacggcgauaagggugaagugggugauccaggacagaagggaacgaagggaaacaaaggcgagcacggcccaccuggcccgccgggcccaaucggaccugugggacagccuggggcugccggcgcugacggugaaccuggcgcuagaggaccccaagggcauuucggcgcuaagggggaugagggaacacggggauucaauggaccaccuggaccuaucggccuacagggccuucccggucccucaggagaaaagggagagacaggagauguuggcccaaugggaccacccgggccccccggaccuagaggucccgccggcccaaauggugccgauggaccccaggggccuccagggggagucgguaaucuuggcccuccgggugaaaagggagaaccuggcgagagcgguaguccggggauacagggugaaccaggcgugaagggcccuaggggcgaaaggggcgaaaagggcgaaaguggccagccaggagagccugggccuccuggcccaaaaggcccaacuggggacgacggacccaaaggaaaccccggaccagucggcuuccccggugacccaggaccaccaggugaaggaggaccucgcgggcaggauggugccaaaggggauaggggcgaagacggcgaaccuggccaacccggcucuccugggcccaccggcgaaaauggccccccaggaccucucggcaaaaggggaccugcuggaucgcccggcagcgagggacggcagggaggcaagggagcuaagggggacccuggagccauuggcgcgccuggaaaaacuggucccguaggcccugccggacccgccggaaagccaggccccgauggacugagaggauugcccgggucugucggacagcaaggaagacccggugcaacaggccaagccggucccccaggaccagugggcccaccaggacucccuggacugcgcggagacgcuggugcuaagggcgagaagggucacccaggguuaaucgggcucaucgggccaccuggagaacaaggggaaaaaggagaucgagggcugccaggaccacagggauccccaggccaaaagggugagauggguauuccaggcgcaucgggaccaaucggaccgggaggcccuccaggauuaccuggaccagccggcccuaaaggagcuaaaggcgccacggggccgggcgggcccaaaggcgagaaaggugugcagggcccacccggucauccaggacccccaggagaggugauacagccacucccaauccagaugcccaaaaagacucggcgauccguggauggcagucggcugaugcaggaggaugaggcuaucccuacaggcggcgccccuggaagcccgggcggacuagaggaaauauuuggaucccucgacucucuucgugaagaaauugaacagaugcgcaggcccacuggaacacaggacagcccagcccguacuugucaggaccucaaguugugucauccugagcugccugacggggaauauugggucgaccccaaccaagggugcgcccgugacgcguucagaguguucuguaacuucacugcaggaggggagaccugcgucacgcccagggacgacguuacccaauucuccuauguagacucagaaggguccccagucggaguuguucaacuaaccuuucuccggcuucuaucagugucagcucaucaggauguguccuacccuuguucaggagcagcaagagauggacccuuacgccugagaggcgcuaaugaggacgagcuauccccagaaacuagucccuaugugaaggaauuccgcgacggaugccagacacagcagggccgcaccgugcucgagguccgcacucccguccuagaacaguugccagugcucgaugccagcuucagcgaccucggggccccgccgcgcagagggggugugcuucuggguccuguguguuuuaugggguag

SEQ ID NO: 5396 - RNA, 921 nt, Artificial Sequence
  Description of Artificial Sequence: Synthetic coding sequence
auggauuggagagcguccgaagcuuggauggugcccagagccccuaagggagcuugggauccuagggaaagccaagacuuacuugacaauagagcaccccuggggccuagggucuuuccgggcccacgugugccuagcgcuuugauggaaaggcgaguacucaaaggcucccagggaucccccgcuuguccugggccacccggggaagugauacagccuuuacccauacagaugcccaagaagacccggagaucaguggacggcucacgccugaugcaggaagacgaggccaucccaacuggcggagcacccgguucucccggaggccuugaggagauuuucggaucucuggauucacugagagaagagaucgaacagaugaggcgcccuacuggcacacaggacucacccgcuagaaccugccaagacuuaaaacucugucaucccgaacuaccugacggcgaguacuggguggacccaaaucaggguugugcucgcgaugccuuucgaguguuuugcaacuucaccgcagguggugagacuugcgucacaccgcgcgaugacguuacccaguuuaguuauguggauagcgaaggaaguccugucggcguggugcagcuuacuuuucuuagacuccuuucuguaagugcccaucaagacguuucguacccuuguuccggugcggcccgagacggaccccuucggcugagaggugcuaaugaagaugaauugucuccagagaccucuccuuaugugaaagaguuccgugacggcugucaaacccaacagggccguaccgucuuagaaguuagaacaccaguucucgaacagcuaccugugcuugacgccuccuuuagugaccucggggcuccuccccgcagaggcgguguguuguuggguccggucuguuuuauggguuag

SEQ ID NO: 5397 - RNA, 4890 nt, Artificial Sequence
  Description of Artificial Sequence: Synthetic coding sequence
auggagagauguucccgaugccacaggcuccuccugcuucuuccacucguucuuggacucagugcugcaccgggaugggccggugcgccccccguggacguucucagagcucugagauucccaucucugcccgacggaguuagacgggcuaaaggcauuuguccugcugacgucgcuuaucgcguggcuaggcccgcccagcuuuccgcaccaacucgccagcuauuuccuggcggauuuccaaaagauuuuagucugcucacugucguccgaacacgaccuggccugcaagccccacugcugacacuguauucugcacaaggagucagacaacugggccuggagcugggucggcccgugagauuucuguacgaagaccaaaccgggcgcccccaaccaccuucccaaccuguguuccggggucuguccuuggcggauggaaaauggcacaggguggcaguggcuguuaaagggcaaucuguuacacucauugucgacugcaaaaaacggguuacucggccucucccaagaucagcccggccaguacuggacacucacgggguaauuaucuucggagcucgcauccuggaugaagaaguuuuugagggcgaugugcaagaauuggccaucguaccaggcguccaagcagccuaugagaguugugaacaaaaggaacuggagugugaaggugggcagcgggagagaccgcagaaucaacagccucacagggcacagagguccccucaacagcagccaucacgccugcaucggccacagaaucaagagccgcagucacaagcagcacacggaccaaggggccugaagggggagaagggugagccagccguacuagaaccaggcauguuaguggaaggaccaccaggcccggagggacccgcgggccugaucgggccaccuggcauucaagggaauccugggccugugggggaucccggugagagaggaccaccugggcgagcaggccugccagguuccgauggugcccccgguccuccugguacuagucugaugcugccguucagauucggauccggagggggugauaaaggacccguugucgcagcccaggaagcacaggcucaagcaauucuccagcaggcccgacuagcacuuagaggucccccgggaccaauggguuauacuggucguccuggcccucucggacagcccgguucccccggcuuaaaaggggaauccggcgaucuaggaccccagggccccaggggaccgcagggguugaccgguccccccggaaaggcugggcguagaggcagagccggagcugauggagcaagagguaugcccggcgacccgggaguaaaaggcgauagggguuucgauggucugccuggccuuccuggcgaaaagggacacaggggggauacuggagcucaggggcuacccggcccaccuggcgaggauggagaaagaggagacgauggagagaucggcccaagaggguugccaggagagucgggcccccgaggauuauuaggaccaaagggaccaccagggauuccaggacccccaggagugagaggaauggacgggccacagggaccuaaagggagucuggggccucagggcgaaccgggcccucccggccaacagggaacacccgggacacaaggucugccuggaccccagggagcaauuggcccacauggugagaaaggcccacaaggcaagccuggccugccagggaugccaggaucagauggcccgccaggccauccugguaaagagggcccuccaggaaccaaagggaaucaagggcccucagggccucaaggcccccuuggcuacccggggccacgcggcgugaaagggguggacggaauuagggguuuaaaggggcacaaaggggagaagggagaagauggguuuccuggauuuaagggggauauuggugucaaaggcgacaggggggaaguuggcgugcccgggaguaggggagaggacggccccgaaggaccuaagggaagaaccggucccacuggggacccugggcccccagggcugaugggggagaaagggaaacugggaguuccugggcuucccggguauccaggacgacagggccccaaagguucguuaggauuucccgguuuuccuggugccagcggugagaagggugcgcguggccugucagggaaaagcggaccaagaggagagagagguccaacaggaccuagggggcaacgcggaccgcggggcgccacagggaagucuggugcgaagggaacaaguggcggagacggcccccacggaccaccaggugaaagaggccucccaggcccucagggccccaauggcuuccccgggccgaagggaccacccgggccaccaggcaaagaugggcugccuggacaccccggccaaagaggcgaggucggcuuccaaggcaagacaggcccucccggcccgcccggggugguaggcccccagggggcugcaggugagacgggaccuaugggcgagcgagggcaccccggacccccgggaccaccaggcgaacagggacugccagggacugccggaaaagagggcacaaaaggagauccugggcccccuggcgccccaggcaaggaugggccggcaggacugagaggauuccccggugaaagaggacucccgggaacagccgggggaccuggacuaaaagggaacgaaggacccuccggcccucccggacccgcuggcucacccggggaacgaggggcugcaggguccggcggacccauuggaccuccuggcagacccgggccucagggaccacccggcgcagcgggagagaagggagugccuggggagaaaggaccaauaggaccaacgggacgggaugguguccagggacccgugggacugccggggccugccggcccccccggcgucgcaggagaggacggcgauaaaggcgaggugggugaucccggccaaaaggguacaaaagguaacaaaggcgaacaugggccuccaggcccuccuggaccuauaggaccagugggacaaccaggagcugcuggggcagauggagagcccggcgcucgggguccacaaggacauuuuggcgccaagggugaugaagggacacgaggcuucaacgggccuccuggaccuaucggguuacagggacuucccggcccaucaggcgagaaaggugaaacaggcgacgugggccccaugggucccccuggcccucccgggccccgcgggccugccggaccaaauggagcugauggcccccaaggcccuccaggugggguggggaaccuuggaccuccuggcgaaaagggggaaccuggugagucaggcagcccaggcauucaaggggagcccgggguuaaaggcccuagaggcgaacguggggagaaaggugagagcggacagccuggagaacccgggccucccgguccgaagggcccaacaggcgaugauggacccaaaggcaauccuggcccggugggcuuuccuggcgaucccggcccaccuggagaaggcggacccagaggccaagacggcgcuaagggugaucgcggcgaggauggggaaccaggacagccggguaguccugggccaacuggugagaacgggccaccuggaccuuuagguaagcgggggccagcugguagccccgggagcgaaggcagacagggggggaaaggcgcuaagggagaccccggggccaucggggccccggguaagaccgguccaguuggaccugcaggaccugcgggaaagccagggccugaugggcugcggggccuuccagguagcguggggcaacagggacgaccaggagcaacugggcaggcaggaccaccugggccagucgggccaccuggcuugcccggucugaggggggaugcaggugcuaagggagagaaggggcauccaggcuugaucgggcugauagggccgccuggcgaacagggagaaaaaggcgacagaggcuugcccggcccgcaggggucgcccgggcaaaagggcgagaugggcauaccaggagcaucgggaccuaucggaccgggcggaccaccagggcuccccggacccgccggcccuaaaggagcuaagggcgcaacaggccccgguggcccaaagggggagaagggcgugcaaggaccaccuggacacccaggaccacccggagaggugauccagccccucccgauucaaaugccuaaaaagacaagaagaucugucgaugguucucggcugaugcaagaagacgaggcuauccccacaggcggcgcacccggaagucccggcggcuuggaagaaaucuuuggaucucucgacagccucagagaggaaaucgaacaaaugcguagacccaccggcacacaggauucucccgcccgaaccugccaggauuuaaaauugugccaccccgagcucccagauggggaauacuggguugauccaaaccagggcugcgcaagagaugcauucagaguuuucuguaauuucacagcagggggagagacaugugugaccccccgcgacgaugucacccaauuuaguuacguggauuccgagggcucaccugugggcgucgugcaacuuacauuucucaggcuucucagugugagcgcucaccaagacgugucauacccaugcaguggcgccgcaagagacgggccucuucguuuaagaggggcuaacgaagaugaacugucaccugaaaccuccccuuacgugaaagaauuuagagauggaugucaaacacaacagggccgaaccguacucgaaguuaggaccccgguccuggaacagcugccugugcucgaugcaagcuucucagaccugggugcuccuccaagaagaggcgguguuuuacugggaccagucuguuuuauggguuag

SEQ ID NO: 5398 - RNA, 5148 nt, Artificial Sequence
  Description of Artificial Sequence: Synthetic coding sequence
auggaacgauguucccgcugucaucgucuacuucugcuuuuaccucuuguauuagggcucuccgcugccccugggugggccggcgccccccccguggauguauugcgcgcccuucgcuucccgagcuuaccggauggagugcggagagcgaaagggaucugcccagcugauguggcuuauaggguugcuagaccugcacaacucagcgcaccaacccggcagcucuucccuggcggcuuuccuaaagacuucucccugcucacuguggucaggacucgucccgggcuccaggcuccccugcucacuuuauauucagcccagggugugagacaguuaggauuggagcucggcagacccguucgguuuuuguaugaggaucagaccggcaggccacaacccccaucccagccagucuuucgggguuugucccuggccgaugguaaauggcaccgcguugcuguggcagugaaaggacagaguguaacucuuaucgucgacuguaagaagcgugugacucggccgcuuccccgaucugcaaggccaguacuggacacgcauggcgugauaauuuuuggagcacggauucuggacgaagaagucuucgaaggcgacguccaagagcucgccaucgucccuggcguccaagccgccuaugaauccugcgagcagaaagaacuagaaugugagggcgggcaaagagagaggccgcaaaaucagcaaccacaucgcgcccagaggucaccucagcaacagccaucucgccugcaucggccccagaaccaggagccucaaagccaaccaacugagucccuuuauuacgacuauaagccucccuauuaugacgugaugacaaccgguaccacacccgauuaccaggagcaaaccgaucuccaaguuccgccuaccgcagauagauuucaagccgaagaguauggugagggagguacugacccuccugaaggaccuuacgauuacacuuacgguuacggugaugacuaucgcgaagagacagaguugggcccugcacucucugcagaaacggcacauucuggggccgccgcucauggacccagggggcugaagggggagaagggagaaccugcugugcuagagccuggcaugcuaguugaaggaccuccugguccugaggggccggcaggauugauuggcccucccggcauccaaggaaacccuggcccgguuggagauccaggcgaacggggaccuccaggucgagcagguuuaccagguuccgauggcgccccagguccccccggcaccagucuaauguuaccguucagauucggcagcggcgguggagacaagggccccgucguggcggcacaggaagcucaggcacaggcaauccuccagcaggcaagacuugcucugagggggccgcccggaccaaugggauauacaggacggccaggaccccugggccagccgggcagccccggccugaaaggggaaucaggagaucugggcccccagggaccaaggggaccccaagggcugacaggaccaccuggaaaggcuggacggagagguagggccggagcugauggagcaagaggcaugccgggagaccccgguguuaaaggggaucgcggauucgacggacugccuggcuuaccaggagagaaaggacaucgcggagauacaggugcccagggacugcccggcccuccgggcgaggacggagagaggggggacgacggugagauaggaccacgugguuugccaggcgaaucaggcccacgcggcuugcuugguccuaaggggcccccugguauacccggcccgcccggcguuagaggaauggauggaccucaaggcccuaaggggucucugggaccacagggcgagccuggcccaccuggucagcaaggcacuccuggaacacaaggcuuaccuggcccccaaggagcuauuggaccucacggcgaaaaagggccacaaggaaagccgggucugcccggaaugccuggcagcgauggaccaccuggccauccugggaaggagggcccgccuggaacaaaggggaaucaaggaccauccggcccccagggaccucugggauauccuggcccccggggcguaaaagguguggacgguaucagaggacugaaggggcacaaaggagaaaagggagaagacggcuucccuggauuuaagggcgacauuggcguaaaaggcgaucgcggcgaagugggagugccuggcagucgcggcgaagacggccccgagggucccaaaggccgcacaggacccaccggagaccccggaccaccaggcuugaugggagagaagggaaagcucggaguuccgggccuuccuggauaccccggccggcagggucccaaggguucgcuuggcuuuccaggguucccaggcgcaaguggcgagaagggcgcaaggggucugagcggaaagagugguccacggggcgaaagaggcccuacaggcccuaggggacagagaggcccacgcggggccacugggaagaguggggcaaaaggcacgucuggcggcgauggaccacacggcccacccggggaacgggggcuuccggguccucaaggucccaauggcuuccccgguccaaaagguccuccaggcccgcccggcaaagacggccugccgggccacccaggacagagaggugaggugggauuucagggaaagaccggcccuccagggccaccuggugucguaggaccucaaggggcagcaggcgagaccggccccaugggugagcggggccacccaggcccccccgggcccccgggcgaacagggccuaccaggcaccgcugguaaagaggggaccaaaggggaccccggaccuccaggagcgccagguaaagacggacccgccggacugaggggcuucccaggggagaggggccuaccaggaacagcaggagggccugggcuuaaggguaacgagggccccuccggaccuccaggaccggccggcaguccuggugaacgaggggccgcagggucuggaggaccuaucggacccccaggcaggccaggaccacaagguccccccggggccgcuggagagaaaggaguccccggcgagaagggacccauugggcccacggggagggacggcgugcagggacccgugggccugcccgggccugccggaccaccuggaguagcaggagaggacggagacaagggggaaguaggcgaccccggacagaaaggaaccaaaggcaacaaaggagaacacggccccccaggaccaccuggccccauaggaccagucggacaaccuggcgccgccggggccgauggggaaccaggagccagaggaccucagggacacuuuggagcuaaaggcgaugaaggaacaagaggauuuaacgggccucccggcccaauuggccugcaaggucugccaggaccuaguggcgaaaaaggcgagacgggagacguuggcccgaugggaccuccgggccccccuggcccacgaggaccugccggcccuaauggagcugacggcccccagggccccccuggcggcgugggaaaccucggcccacccggagaaaaaggggaaccuggggaguccggauccccuggaauacagggcgaaccggguguaaaaggccccagaggagagcgcggcgaaaagggagaaucuggccagccaggugagccuggaccacccgggccuaaggggccaacuggcgacgauggaccaaaaggcaauccuggaccggucggguucccaggagacccuggaccucccggggaagguggcccacgaggucaggacggagcaaagggcgauagaggcgaagacggggaaccagggcaacccggcucaccuggcccuacuggcgaaaaugguccaccaggcccacuggggaagcgcggcccugcaggcucccccggcucggaaggccgacaaggagggaaaggggcaaaaggcgaccccggcgccaucggggccccuggaaaaacuggccccguaggucccgccggcccugccgggaagcccggaccagauggacugcggggucucccggggagcgugggccaacagggucgacccggcgccaccggacaagccggaccaccaggcccagucgguccuccaggacuccccggacuacguggagaugccggcgcaaagggagaaaagggucacccggggcugauuggacuaaucggaccucccggcgagcagggcgaaaaaggagauagaggguuaccagggccccaggguucacccggccagaagggagaaauggggauaccuggagcuucaggucccaucgggccugggggaccuccaggacugcccggcccggccggaccuaaaggcgcaaagggggcaacagggccaggcggcccaaagggagagaaaggugugcagggccccccaggacauccuggcccacccggagagguuauccagccacugccaauucagaugccuaagaaaacuagacgguccguggauggaucucggcuuaugcaggaagaugaagcuauucccaccggcggcgcccccggaucaccgggcggccuggaggagauuuuuggaagucuggauagccuaagggaggagaucgaacaaaugagaaggccaacaggaacacaggacagcccagcccgaaccugccaagauuugaaacugugccaccccgaguugcccgauggagaguacuggguggacccaaaucagggcugcgcccgcgaugccuuuagaguguucugcaauuucacugccggcggcgagacuugugugacucccagagacgaugugacccaguucucuuauguagauagcgagggauccccugugggcguggugcaacucaccuucuuacgccugcugucuguaagugcccaccaggacgugucguacccuugcucaggcgcagcacgcgaugguccccuuagacuccgaggagcuaacgaagacgaguuauccccagagacauccccauaugugaaggaguuucgugauggaugccagacccaacaagggcgaacuguguuggagguuaggacaccuguacuagaacaacuaccgguacuggacgcuaguuuuagugauuuaggagccccuccucgaagggguggcguacugcuggguccgguuugcuucaugggcuag

SEQ ID NO: 5399 - RNA, 4968 nt, Artificial Sequence
  Description of Artificial Sequence: Synthetic coding sequence
auggagcgcuguucucggugucaucgucugcuucuacuucuaccucugguuuuaggccuaagugccgcaccgggcugggccggcgcgccacccguggacguguugagagcacuccguuuuccuucacugccagaugggguccgacgggccaaggggauuugcccagcugacguggcauaucgaguugcaagacccgcccagcuauccgcgccuacucgccagcuauuccccggcgguuuuccgaaagauuuuagucuccuuacagugguucgaacgagaccugggcuucaagccccacuacugacccuuuacucagcucagggcguacgacagcugggguuggaauugggaagacccguccguuuucuguaugaggaucagaccggaaggccccagccucccagccagccagucuuuaggggacuaagccuugcggacggcaaauggcaucgaguggcuguggcagucaaaggccaguccguaacgcuuauuguugauuguaaaaagagagugacuagaccacugccacgcuccgccagaccaguccuugacacacacggcgugauuaucuuuggagcucggauccuagaugaagagguuuuugagggugauguucaagaauuagccauuguucccggaguccaagcagcuuacgagaguugugagcaaaaagagcuggagugugaaggcgggcagagagaacgcccucaaaaccaacagccucacagagcccaacgauccccccagcagcaacccucucgccugcaccguccucagaaucaagagccccagucgcagccaacagagucacuauacuacgauuacaagcccccuuauuaugaugugaugacaacuggcacuacuccugauuaucaggcugcccacggacccagaggucucaagggagagaaaggcgagccugccguguuggagccgggcaugcucguggagggcccuccggguccagaggguccagcagguuuaauuggaccuccuggaauacaagggaacccuggcccuguuggcgaccccggcgaaaggggaccaccaggccgugcaggauuaccaggcagcgauggagcaccuggaccacccggaaccucccugauguugcccuuccgcuuugguuccggcgguggcgacaaaggaccugugguggcugcccaggaagcacaggcacaggcuauucugcagcaagcucgcuuagcuuugaggggaccaccaggaccuaugggguauaccggaagaccuggaccucugggacaacccggcuccccuggccucaagggagaaucaggagaucuugggccgcaggggccacggggaccacaaggucuaaccgggccaccuggcaaagccgguagacggggcagagcuggcgcugacggggccagggggaugcccggcgauccaggcgugaaaggcgacagaggguucgacggguugccuggacuaccuggggagaagggccaucgcggagacaccggugcacagggacucccagguccgcccggugaggacggagaaagaggcgacgacggggaaauuggacccagaggccuccccggugaguccggacccaggggguuacuaggcccaaaaggcccacccggcaucccagggccuccuggcguucgaggaauggacggcccccaaggaccaaaaggaagcuugggaccacagggagaaccgggcccaccgggacagcagggcacccccgggacacagggacugccuggcccccagggagcgauuggcccccacggcgaaaaggguccccagggaaagccaggcuugccaggcaugccugggucagacgggccuccaggccauccugggaaagagggaccucccggaacuaaggggaaccaggggccuucgggcccacaggggccguugggauaccccgggccaagaggagugaaaggaguagacggcaucagaggauuaaagggccacaaaggggagaagggcgaggacggguuuccgggcuucaaaggcgauaucggggugaagggggauagaggcgaaguaggaguccccgggucgaggggggaagacggcccugagggaccaaaaggccgaacgggcccaaccggugaucccggaccucccggucugaugggagaaaagggcaaauuaggggugccaggacugcccgguuauccugggagacagggacccaaaggaucacugggcuucccgggguuccccggcgcauccggagaaaaaggggcccgcggccuuucugguaaauccgggccuaggggugaacgaggaccuaccgggcccagagggcagagagggccaagaggggcaacuggaaagaguggcgcgaagggcacaaguggaggugaugggccacacggaccaccgggcgaaagggguuuaccagguccacaggggcccaaugguuucccagggccaaaaggaccuccugggccaccuggaaaggacggacugccaggccacccaggacaaagaggugaaguaggauuucagggcaaaaccggcccaccugguccaccgggggugguggggccccaaggugccgccggcgaaacaggaccaaugggcgaaaggggucauccuggcccacccgggccacccggugaacagggacuaccaggaaccgcaggaaaggaaggaacuaagggggaucccgggccacccggggcucccggcaaagauggaccagccggcuugagaggguucccgggugagcgcggccugcccggaaccgcuggaggcccaggacucaaaggcaacgaagggcccagcggaccgcccggaccagcaggaagcccuggagaaagaggcgcagccgggucuggcggccccauaggaccuccugguagacccggaccucaaggcccaccgggugcugcaggggagaaaggaguaccaggagaaaaagggccaaucggaccuaccggcagagauggagugcaagggcccgugggacucccaggcccagcuggaccgccuggcguggccggagaagacggugauaagggcgaagucggcgaucccggccagaaaggaacuaaggguaacaagggugagcaugguccucccggcccgcccggcccuauuggaccaguagggcagccaggcgcagcaggugccgacggcgaacccggugcucgaggaccccagggacauuucggcgcaaagggagaugaaggcacuaggggcuucaaugguccaccaggaccaauugggcuacagggccucccugguccuagcggagaaaagggugagacuggcgaugucggaccuaugggcccccccggcccaccaggcccuagaggcccagcuggaccuaacggugccgacggcccucaaggcccacccggaggcguggggaaccucggcccuccgggcgaaaagggggagcccggggagaguggaagucccgggauucagggcgagcccggugucaaaggacccaggggggagcgaggagaaaaaggcgagucaggacagccaggagagcccggaccucccggaccuaaaggcccuaccggagaugauggacccaaggggaauccuggacccguaggcuucccaggcgaccccggaccacccggagaaggcggacccaggggucaagauggugccaaaggcgaucgcggcgaggauggugaacccggucagccuggaagcccagggcccaccggcgagaacgguccccccgguccccuugggaaacggggcccugcagguuccccuggaagugagggccgccagggcgguaaaggggcaaagggcgauccuggagcaauuggagcacccggaaagacagggcccgugggaccugccggacccgccggcaaaccaggcccagauggacugagaggucuucccggaucugugggacaacaaggacggcccggagcgacugggcaagccgggcccccagggccugucggaccucccgggcucccagggcuuagaggagacgcuggugcaaaaggcgaaaaaggccaucccggucugaucgggcugauagggcccccaggcgagcagggggagaaaggagaucgcggccucccagggccucagggaagcccagggcagaaaggagaaaugggaauuccaggagcauccgguccaaucgggccaggcggcccccccggucucccagguccagcugguccuaaaggcgcuaagggagccacaggcccagggggaccuaagggcgaaaaaggcguucagggacccccuggccauccuggccccccuggggaggucauacaacccuugccgauacagaugcccaagaagacacgccgcucgguggauggcaguaggcuaaugcaggaagaugaagcuauuccuacagggggagccccaggcucaccaggagggcuugaagaaauauuuggcucacuagacagucugagagaagaaauugagcaaaugagaagaccuaccgggacccaggauuccccagccaggacuugucaagaccuaaagcugugccaccccgaacuccccgauggagaguacuggguagacccaaaccaaggaugcgcccgggacgcauucagaguuuuuuguaauuucaccgccggcggcgagacuuguguaacaccuagggacgacguuacccaauuuagcuauguggacagcgaaggauccccugugggagucgugcaguugacauuuuugcgcuugcucuccguuucagcccaccaagacgucagcuaccccuguucaggagcagccagggacgguccauuacgccugagaggugcaaacgaggacgagcuauccccugagaccucucccuacgugaaagaguuucgugauggaugucaaacacagcaagggagaacaguucucgagguccgcacaccugugcuagaacaacugccaguccuagaugcaagcuuuucugacuugggggcccccccacgaaggggcggcgugcuacucggccccgucugcuuuauggguuag

SEQ ID NO: 5400 - RNA, 9192 nt, Artificial Sequence
  Description of Artificial Sequence: Synthetic coding sequence
augagaucuagacucccccccgcccuggcagcccucggagcagcguuguuacucaguuccauugaggcggaggucgacccgccgagcgaucugaauuuuaaaauuauugacgaaaacacuguacauauguccugggcuaagccgguggacccaauugugggauacagaaucaccguugaccccacuacagacggaccaacaaaagaauucacacuuucagccuccacaaccgaaacccuguugucugaacucgucccugagacugaauaugucgugacaaucaccuccuaugaugagguugaagaaagcgugcccgugaucggccagcuuaccauccagaccggauccucuacuaagcccguugaaaaaaaaccugguaaaacagagauucaaaaguguucaguaucugcauggacggaccuaguauuucucguggacggcagcuggagugugggucggaacaacuuuaaauacauccuagacuucauugcagcgcucgugucagcauuugauaucggagaggagaagacacgcguuggcguagugcaguauagcucugauacccgaacagaguucaaucuaaaccaguacuaucaacgagacgaguuacuggcagcaauuaaaaaaaucccuuauaaaggcgguaacacgaugacaggcgacgcgauugauuauuugguuaagaacacuuucacugaaucagccggugcccgcguuggauuuccaaaaguggcuauaauuaucaccgauggcaaaagucaggaugagguggagauuccagcccgcgagcugcguaacguugggguggagguauuuucacuaggcaucaaagcugccgacgcgaaagaauugaaacagaucgcaaguaccccguccuuaaaccauguguucaauguggccaacuucgaugcaaucguggauauccagaacgaaaucauuucacaaguguguagcggcguagacgaacaacucggcgagcugguguccggagaagaaguaguggaacccccuucuaaucugaucgcaauggaagucagcucuaaauaugugaaguugaauuggaacccuaguccaucaccgguuacgggauauaaaguaauauugacccccaugacugccgguucgcgccaacacgcucugucuguaggcccucagacuacaacccugagugugcgugaccugucagccgauaccgaguaucaaauuagcguauccgccaugaagggaaugaccucgagugagcccaucucaauuauggaaaaaacacagccaaugaaagugcaaguggagugcucaaggggaguggacaucaaggcagacaucgucuuccuugucgauggcuccuauucaauugguauugcuaauuuuguuaaggugcgugccuuuuuggaggugcuggugaaaagcuucgagaucaguccaaaccgcgugcaaauuagccucguucaauauucuagggauccacacacagaguucacauuaaaaaaguuuaccaaaguggaggauaucauugaggcaaucaacacauuuccuuauagaggcgggucuacgaauacaggaaaggccaugacauacguucgugagaaaaucuucguaccaucuaaaggcaguagauccaacgucccaaaagucaugauccugauaacagacgguaaguccagugaugcauuuagagacccugccauaaaauuaagaaauagcgacguggagauuuuugccguggguguuaaagacgcagugaggucugaacucgaggcuauugccucccccccagcugaaacacauguguucacgguggaagauuucgacgccuuucagcgcauuagcuucgagcugacacagucaauuugucugaggaucgaacaggaguuagcugcuaucaagaaaaaggcauacgugccgccaaaggaccucucauuuuccgaagugacauccuacgguuucaaaaccaacuggucgcccgcuggggaaaacguguucagcuaccauaucacuuacaaagaagcagcuggagacgaugaggugacugugguugaaccagccucuucaacauccgucgugcugucauccuuaaagccagagacucucuauuuaguuaacguuacagcugaauaugaagacggcuucagcauuccacuggcaggagaagaaaccacagaggaagugaagggcgccccaagaaaccuuaaggugacagacgagacaaccgauuccuucaagauuacguggacccaggcccccggcagagugcugagauauagaauaaucuaccgucccgucgcaggcggagaaagccgagaagucaccacccccccaaaucaacgcaggcguacacuggagaacuugaucccugauacaaaguaugaagugagcgucaucccugaguacuucagcggccccggcacaccacugacggggaacgcugcuacugaagaaguccggggaaauccgagagaccuuagaguguccgauccgacaacaagcaccaugaagcuuaguugguccggagccccugggaaagugaaacaguaucuggugacauacacgccuguagcaggaggcgagacacaagaggugacugucaggggcgacacuacgaacacuguuuugcagggacuuaaagaaggcacccaguacgcccuauccgucacugcacuauacgccuccggcgcaggagaugcuuuguucggcgagggaacgacucuggaggagagaggaagcccgcaggaccuggugaccaaggacauuacagauacauccaucggagcauacuggaccucugcccccggcaugguaaggggcuaucgggugucuuggaaaagucuguaugaugauguagacacaggugaaaagaaucugcccgaggacgcuauacauacuaugauugaaaaccuccagccugaaacaaaguaucgcauaucgguuuucgccacauauaguaguggagaaggggaaccguuaacgggggacgcaacaacagaacugucccaggacagcaagacucugaaaguagacgaggaaacagagaacacaaugcgggugacauggaagccagccccuggaaagguggugaauuaucgugugguuuacagaccccacgggagggguaagcagauggucgccaaggugccuccuacuguuacuucgacaguucugaagcgacugcagccccagaccacauaugauauuacaguucuaccaauuuauaagaugggagagggaaagcuuagacaagggucaggcacaaccgcguccagauucaagagcccucgcaaccugaagacaucugacccuacuaugucuagcuuucguguaaccugggaaccagcacccggcgaggugaagggguauaaggugacauuucaccccacuggagaugauagacguuuaggcgaacugguggucgggcccuacgacaauacuguuguccuugaagagcuccgcgccggaaccacauacaaggucaacguguuugggauguucgaugguggugagagcaguccacuugugggucaagagaugacaaccuugagugauacuacagucaugccaauucuauccucugggauggagugucuuacaagagccgaggccgauauuguguugcucguugacggaaguuggucaauuggcagagcaaacuuuaggacugugcggaguuuuaucucgagaauaguggagguguuugacauaggccccaagaggguucagaucgcuuuggcccaguauaguggagauccuagaacagaauggcagcuaaaugcucauagggauaagaaaagccugcuacaggcugucgcaaauuuaccauauaagggaggcaauacucugacuggaauggcacugaauuucauucggcagcagaauuuucggacacaggcugggaugcgaccuagggcuaggaaaaucggagugcuuauuacugacgggaaaagccaagacgacgucgaagcgccaagcaaaaaguuaaaggaugaaggaguagaacuguucgcaaucgguauuaagaacgcugaugagguggagcugaagaugauagcuaccgaucccgacgacacccaugcuuacaauguggcagacuuugaaagccugucaagaauuguagaugaucuuacaaucaaucuuugcaacagcgugaaaggaccuggagaucuugaagccccaagcaaucuagugaucucugagcgcacccaccggaguuuucguguuaguuggacgccaccuucagauagcgucgauagauacaagguagaauacuacccggugagcgguggaaaacgucaggaguuuuaugucucacguauggaaaccucaacagugcuuaaggaucugaagcccgaaacagaguauguggugaacguauacagugugguagaggaugaguacuccgagcccuugaaagguaccgagaaaacccugccugugcccguggugagucuuaacaucuacgauguuggaccuacaacuaugcauguucaguggcaaccggugggaggagcuaccggauacauccugaguuacaaaccugugaaagauacugagccaacucgucccaaagaaguuagacuuggacccacugugaacgacaugcagcugaccgaucugguacccaauaccgaauaugccgucacggugcaagcuguucugcaugaucugaccuccgaacccguaacugugcgcgaggucacccuaccccuaccccgcccgcaagaccugaaacugcgagacgugacucacucgacuaugaacguguucugggaacccgugccggguaaggugcgcaaguacauuguucgcuauaagacaccagaggaagacguuaaggaaguugaagucgaucgcagcgagacaaguacuucccugaaagaccuguuuagccaaacauuguauacaguguccgugucagccguucaugaugaaggugaauccccuccugugaccgcacaggaaacgacccgucccguaccagcaccgacaaaucugaagauuacagaaguuacuagugaaggcuuuagagguacaugggaucacggcgcaagugauguuagucuguacagaaucaccugggcucccuuuggcuccagcgacaagauggaaacaauauugaacggugaugaaaacacccuuguguucgagaaucuuaacccuaacacuauuuacgaagucucgauuacagcaauuuaucccgacgaaagcgagucugaugaccugaucggaucggaacgaacccugcccauucuuacaacacaagccccuaaaagcggcccaagaaaccuccagguguacaacgccacaucaaauucccuuaccgugaagugggacccagcaucagggcggguacagaaauaucggaucacauaccagcccucuacaggagaaggaaacgagcagacuaccacuauagguggccgucaaaauuccguggugcugcaaaaauugaagccagacacaccauacacgauuacugugaguucucuauacccggauggcgaaggaggcaggaugacaggucgaggaaaaacgaaaccacugaauaccgugcgcaauuuaaggguguaugauccuucuacuuccacucugaacgugcgcugggaucacgcugaagggaacccgcgacaguacaaacuguuuuacgcccccgcugcaggaggccccgaagaacuuguaccaaucccuggcaacacuaauuacgcuauacuccgaaaucuucagccugacacgucauacacuguaaccgucgugccugucuauacugaaggggacgggggcaggacauccgauaccgguaggacacugaugagaggccuggcccggaauguccagguguacaauccgacacccaauucccuugacguccggugggauccggcaccuggcccaguauugcaguacagaguuguauacucacccguugauggaacaaggcccucggaaaguaucguuguucccgggaauacuagaauggugcauuuggagcgacucauccccgauacacucuacucaguuaaccuggucgcguuguauagcgauggggaggggaacccaucuccagcucaaggucgaacacucccuagaucaggucccaggaauuugcgggucuucggcgagacaacaaacagcuuaagcguugccugggaucacgccgaugggccagugcagcaguaucggauaauauacucacccacuguaggagaucccauagacgaauacacaacaguccccggaagacgaaauaacgugauccuccagccucugcagcccgauacccccuauaaaauuacuguuaucgcaguguaugaagauggugauggagggcaucugacuggaaaugggagaacuguaggccuguuacccccccagaauauccauaucucugaugaaugguacacuagguuuagaguuucaugggauccgagucccucgcccgugcuuggcuacaagauaguauacaagccagugggcagcaacgaaccaauggaagccuuugucggcgaaaugacuuccuauacuuugcauaaccucaauccaucuaccacauaugacgugaauguuuaugcccaguacgauagcggacuaagcgugccucuaaccgaucagggaacuacccucuacuuaaaugugacugaccugaaaaccuaucagaucggaugggacaccuucugcguuaaaugguccccacaucgggcggccaccucauacaggcucaagcugucuccugcagacggaacgagaggccaagagaucaccguucgcggcucggaaacaucccacuguuuuacuggauugagucccgauaccgacuacggagugacagucuucgugcaaacuccaaaccucgaaggaccgggggugagcgugaaggaacacacaacuguuaaaccuaccgaagcuccaacugaaccucccacaccucccccgccaccaaccaucccuccagcaagagacguguguaaaggugccaaagcugacauuguuuuccuuacagaugcuucuuggucuauuggagacgauaacuucaacaaagucgucaaguuuaucuuuaacacagugggcgguuuugacgaaaucucuccagcuggcauccaaguuucauucgugcaauauagcgaugaagugaaaagcgaauuuaaguuaaauacauacaacgacaaagcgcucgcccuuggcgcgcugcagaacauuagauaccgaggcgguaauacuagaacuggaaaagcauugacuuucaucaaggagaaagugcucacgugggagaguggaaugagaaagaacgugccaaagguccucguugucgugacagacgguagaucacaggaugaaguaaaaaaggcugcuuuggugauucagcagucaggcuucagugucuuugugguagggguggccgacgucgacuacaaugagcuagcuaacaucgcgucaaaaccgagugaacgucacguguuuaucguggacgauuuugaauccuucgagaagauagaggacaaucuaaucaccuucgugugugagaccgcgacauccuccugcccacugauauaccucgacggcuacacuucuccagguuuuaaaaugcuugaagcauacaaucugacagaaaagaacuucgcuuccguccagggugugagccuagaaagcggauccuuuccauccuacucagcauaucgcauucaaaaaaaugcauucguuaaccagccuacagcagaccugcaccccaacggccugccacccucauauacaaucauccuuuuguuccgauuacuccccgagacacccagugacccauuugccaucuggcaaaucacugauagagacuacaagccgcaaguugguguuauugccgaccccaguuccaagaccuuaucuuucuuuaacaaagacacccgaggcgaggugcaaacagugacuuucgauaccgaggaggucaagacucuauuuuacggcucauuucacaaaguccacauaguggucacuucaaaaagugucaagaucuauauugacuguuaugaaaucaucgagaaggacaucaaagaagcagggaauauuacaacggacggcuacgagauacucggcaaauugcugaagggggagagaaaaucagcagcguuucagauacagucauuugacaucgugugcucacccguguggacaucccgcgauagaugcugcgacauacccucgaggcgggacgaaggaaaguguccagcuuucccaaauucaugcacuuguacccaggacagcgucgggccgcccggucccccagggccagcaggggggccaggagcaaaggguccaaggggggagagagggauuucuggagcaauuggaccaccgggcccccgaggcgacauugggccaccugggccucaaggcccucccgguccucaaggcccuaacggacucuccauacccggggagcagggaagacaaggaaugaagggagaugcgggcgagccagggcugccaggaagaacagggacccccggacuccccggaccgcccggcccgaugggucccccaggagacagaggguucaccggcaaagauggagcuaugggcccgagagguccgcccgggcccccuggaucuccggguucuccuggaguaacaggcccaucuggcaaaccuggcaaacccggcgaucacggaagaccuggcccuucuggccucaagggggaaaagggugacaggggugauauugcuucccagaacaugaugcgagccguggcccgccaggugugugaacaguugaucagcgggcagaugaauagauuuaaccaaaugcugaaucagaucccaaaugacuaucagagcucuagaaaccagcccggaccuccagguccuccaggaccucccggaagcgcaggagcacgcggggagcccggaccgggaggcagacccggauuucccgggacuccaggcaugcaaggcccccccggcgagagaggucugccaggagagaaaggugagaggggaacagggucuuccgguccuaggggccugccgggcccaccaggaccccagggcgaaagcaggacaggccccccgggcagcaccggaucuagaggucccccaggccccccaggcagaccgggcaauucugguauuaggggcccaccuggccccccaggcuauugcgacucuucccagugcgcaaguaucccuuauaauggacaggguuacccaggcagcggcuag

SEQ ID NO: 5401 - RNA, 5700 nt, Artificial Sequence
  Description of Artificial Sequence: Synthetic coding sequence
augagaucccgccugccucccgcacuugccgcucugggugcugcauugcugcucuccuccaucgaagcagaaggaauggaaugucugacccgcgccgaagccgacauuguacuacugguugacggaagcuggucuaucggccgcgcuaacuuccguacgguccggucauucaucagccgcauuguagaaguuuucgacaucgguccaaagcguguccagauugcgcucgcccaauacucaggugauccgaggaccgaguggcagcucaaugcucaccgcgacaagaagagccucuuacaagcuguggcuaauuugcccuacaagggcgggaauacucuaacugguauggccuuaaauuuuauccgccagcagaauuucagaacccaggcgggaaugcgcccacgcgcacgaaaaaucgggguguugaucacagacgguaaaucacaggaugacguggaagcuccuaguaagaaacugaaggaugagggcguugaacuguucgcuauugggauuaaaaacgccgacgaggucgagcugaagaugaucgcaacagacccagacgacacacacgcauauaacguagcagauuucgagucccugagcagaauaguggaugaccucacgaucaaccuguguaacucugugaaggggcccggagaucucgaggcuccuaguaaucuggugaucucugaacggacucauagguccuuccgggugucuuggacaccuccuucugacagcguggaucgauacaaaguugaauauuauccugugagcggugguaaaagacaagaguuuuacguuagccgcauggagaccagcaccgugcucaaagaccuuaaaccugaaaccgaauaugucguaaauguuuauuccgugguggaagacgaauauagcgaaccuuugaaaggaacugagaaaacacugccagugcccgugguuagucugaauauuuaugacguuggcccuaccacuaugcacguccaauggcaaccuguagggggcgccaccggcuacauccucucauauaagcccgugaaggauacagagcccacccgaccuaaagaaguacgacuaggccccacaguuaaugauaugcagcugacagaccucgugcccaauaccgaguacgccgucacugugcaggcugugcugcaugaucuaacaagcgagccaguuaccgugagagaagucacacugccauugcccagaccccaggaucugaaacuacgcgacgugacgcauucuaccaugaaugucuuuugggaacccgucccugguaaaguucgcaaguacaucgugagauacaagaccccggaggaagaugugaaggaaguggaggucgacagauccgagacuagcacuagccuaaaagaccucuucucgcagacauuguauacugugucaguguccgcugugcacgaugaaggugagaguccccccgugacagcccaagaaaccaccagacccgugcccgcgccuaccaauuuaaagaucacggaggugaccuccgagggcuuucgggggacgugggaucacggcgcuucugacgugucguuauaccgaaucaccugggcccccuuuggaucuucggauaaaauggaaacaauucugaacggcgacgagaauacccuggucuuugaaaaucugaaccccaauacaaucuacgaaguuucaauuacugcuauuuacccugaugagucugaguccgacgaucucauaggcucagagaggacgcuccccauccugaccacccaggcccccaaaucuggaccacguaauuuacaaguguauaaugcgacaagcaacagccucacggugaaaugggaccccgccagcgggcgcguucaaaaauacagaaucacauaccagccgagcacaggggaaggcaaugaacagacaacgaccauuggcggccggcaaaacucuguuguuuuacagaaacugaagcccgauaccccguauaccauaacagucucuaguuuauaucccgacggagagggcggaagaaugacaggaagggguaagacuaaaccacugaauaccgucagaaaucucagggucuacgacccuucuacauccaccuugaaugucagaugggaccaugcugaaggaaacccucgacaguauaaacuguucuaugcaccagcagcugguggcccagaggagcuugugccaauaccaggcaacacuaauuacgccauucugaggaaucuccagcccgacaccucuuacacaguuacaguugucccuguuuacaccgaaggugauggcggccgaacaagugauaccggaaggaccuuaaugagaggacuugcuagaaacguccaaguguauaaccccaccccuaacucucuggauguucguugggaccccgcaccagguccugugcugcaguaucgaguaguguacaguccuguugauggaacccgaccuucugagucuauugugguuccugggaauaccagaaugguucaccuggagcggcucauuccggauacauuguauaguguaaauuuagucgcccuguauuccgacggcgaaggaaauccaucuccagcucagggacgaacauugcccaggucuggcccccggaacuugagagucuucggcgaaacaacuaauagccuguccguggcuugggaccacgcagaugguccagugcagcaauaucgcauaauuuacucucccacagugggcgacccgaucgacgaguacacuaccgugcccggcaggaggaauaaugucauacugcaacccuuacaaccggacacaccauacaaaaucacaguaauugccguguaugaagacggagaugggggacaccugacaggaaauggcaggacugugggccuucugcccccacagaacauccauaucucagaugaaugguacaccagguuccgagugaguugggaucccucuccaagucccguccuuggcuauaagauagucuauaaacccgucggaagcaacgaaccuauggaggccuuugucggcgaaaugacuucauacacucuacauaaucuaaacccauccaccaccuaugacgucaacguguaugcccaguacgauuccggccuuuccgugccuuugacagaccaggggaccacauuguaccucaaugucaccgaucuaaaaaccuaucagauagggugggauaccuuuugcgugaagugguccccucaccgcgcugccacaucuuaucgacugaagcuaucgccugccgacgguaccagaggacaagagauaaccguuaggggauccgaaacuucacauugcuucacaggccuaucucccgauaccgauuauggugugacuguuuuuguacagaccccaaaucuugaaggcccuggcguaagcgugaaagaacacacaaccguuaaaccaaccgaagcaccaacugaaccucccacuccaccgccaccuccuaccauaccuccagcucgcgacgugugcaagggcgccaaagcugauauaguuuuucugaccgaugcguccuggucuaucggcgacgacaacuucaauaaggucguaaaauuuaucuuuaauaccgugggcggcuuugacgagaucagccccgccgggauccaggucagcuucguacaguauucggacgaagugaaaagugaguuuaaguuaaacacauacaacgauaaggcccuggcuuuaggagcucuucagaauauccgauacagagggggaaacacacguacuggaaaggccuugacuuuuaucaaggaaaaggugcugacgugggagagugggaugagaaaaaaugucccuaagguuuuggugguugugacugacgguaggagucaagaugaaguaaaaaaagcagcucuggucauacagcaaucuggguucucaguguucgugguuggggucgcugacguggacuacaaugagcuugcaaacaucgccucuaaacccuccgaaagacacgucuucaucguugacgauuucgaauccuucgaaaagauugaagauaaucugauuacauucguuugcgaaacugcaacaagcucauguccucugaucuauuuggauggguacaccucucccgguuucaaaauguuagaagcauacaaucugaccgaaaaaaacuucgccucagugcagggcgucucuuuagagucaggcucauucccaucuuacuccgcauaucgcauucagaagaaugcguucguaaaccagccuacggcugauuugcauccaaacggacuaccgccuaguuauaccauaauucuacuguuuaggcuacuacccgagaccccgucugacccuuuugccaucuggcagauaacagaucgagauuauaagccucaggucggagugauugcugauccaucuaguaaaacauuaagcuuuuuuaacaaggacacccgcggagaagugcagacuguaacauucgacaccgaagaggugaagacauuguucuacggguccuuucauaaagugcacauuguaguaacaucaaaauccgucaaaaucuacauagauugcuacgagauuauugaaaaagacaucaaagaagccgggaauauaacgacagauggauacgagauccugggaaaguuacugaagggcgagagaaagagcgcagccuuccagauucagucauucgauaucguguguucuccaguguggaccaguagagaccgauguugcgauauucccuccagacgcgacgaagggaagugucccgcauucccgaacucuugcaccuguacacaagauucggucggcccuccgggacccccaggaccugcaggcggaccgggagccaagggccccagaggggagagaggcaucuccggagcuauagguccuccaggacccaggggugauaucggccccccaggaccacaaggcccacccggaccacaaggccccaacggacuaaguauaccaggugaacagggcaggcagggaaugaaaggagaugcgggcgaaccuggacugccuggacguaccgggaccccaggccugccgggaccaccaggcccuauggggccccccggagaccgcggcuuuaccgguaaggacggcgcaaugggaccucguggcccccccgguccuccaggauccccaggcagcccaggcguaacgggaccuucugggaagcccggcaagcccggugaccacggcagaccuggaccauccggacucaaaggugagaaaggcgauaggggagacaucgcgucucagaauaugaugcgagcaguugccagacagguaugcgaacaauuaaucuccggccagaugaacagguucaaccaaauguuaaaucagauucccaaugacuaucaguccagcagaaaccagccgggaccacccggcccacccggaccacccggcagugcaggggcuaggggcgaacccggccccggaggucguccuggguucccagguacgccaggcaugcagggaccgcccggcgaacguggacuuccuggcgagaagggugaaagaggaacaggauccagcgggcccagaggucucccaggaccaccuggaccccaaggcgagucgcguaccggacccccgggaucuaccggaucuaggggcccaccagguccacccggcagaccgggaaacucuggcauuagaggccccccaggcccgcccgguuauugugacagcagucaaugcgcuucuauccccuacaacggucagggguauccuggaucaggauag

SEQ ID NO: 5402 - RNA, 8964 nt, Artificial Sequence
  Description of Artificial Sequence: Synthetic coding sequence
augagaucaagacuccccccugcccuagccgccuugggugcagcccuacuguugaguaguaucgaagcugaaguagauccaccgagcgaccuaaacuuuaaaauuauugacgagaauacagugcacaugucaugggcuaaaccaguugauccuaucguggguuacagaaucacuguagacccaacuacugacggaccaacuaaggaauucacacuaucagccucuacaacagagacacuccucagcgaacugguccccgaaacugaauacguagugacuaucacuuccuacgacgaaguggaagaaucugugccuguuauaggacaacucacaauucagaccgggucaucaacaaaacccguggaaaaaaaaccuggaaaaaccgagauccaaaaguguuccgucucagccuggacagaccugguuuucuugguagauggcagcuggucagucggacgcaacaauuuuaaauauauucucgacuuuauugcagcccuugugagcgccuucgacaucggagaagagaagacacguguuggagucguucaguauuccucugacacacgcacugaauucaaccuaaaucaguacuaucagagggacgagcuucucgcggcaauuaagaagauaccuuacaagggugggaauacgaugacuggcgacgccauagauuaccuagucaaaaauacauucacagagucugccggagcacgggucggcuuucccaaaguggcuauuauuauuacggauggcaaaucgcaggacgaaguugaaauuccugcacgcgagcucagaaacgucggcguggaaguguuuucucucgguaucaaagcggcugacgccaaggaacuaaagcagaucgccucaacaccuucacuaaaucauguauucaauguggcuaauuucgaugccauaguagauauacaaaaugagauuaucucucagguaugcucggggguagaugagcagcugggcgagcuugugucaggcgaagaaguaguggaaccacccucuaaccugaucgcuauggaaguaagcagcaaguaugugaaacucaacuggaacccaucucccucaccagugacaggauacaaaguuauacugacaccaaugacugccggaucccgucagcacgcacuuuccguggggccccagacaacaacacuuucggugcgggaucugucagccgauacagaauaucagauaucugucagcgcuaugaagggaaugaccaguuccgaacccauuagcaucauggagaagacccagcccaugaaaguccagguagaguguucgcgagggguugacaucaaagcugauauagucuuucugguugacggcuccuauagcaucggcauugcuaacuucgucaaggugagggcauuucuugaaguucuggugaaauccuuugaaaucucaccuaaccgcgugcaaauuucuuuaguccaguacucuagggacccacauaccgaauucacacuaaaaaaguuuaccaaaguagaggauaucaucgaggcuaucaacaccuuccccuauagaggcggaucuacuaacaccgguaaggcaaugacguacgugcgagaaaagauuuuuguuccuagcaagggaucccguagcaaugugccuaaagugaugauccugauuacagacggcaaaucauccgaugcauuccgcgauccugccauuaaacugaggaauucagaugucgaaauauuugcaguaggggucaaagacgcagugagguccgaauuggaggccaucgcuucaccgcccgcugagacccauguauuuacaguggaagauuucgaugccuuccaaagaauuuccuuugagcuuacucaguccaucugcuuacggaucgaacaggagcucgccgccaucaaaaaaaaagcuuaugugccacccaaagaucuuuccuucuccgaagucacgucauauggguuuaagacuaacugguccccugcgggugagaauguuuuuaguuaccauaucacauauaaggaagcagccggagacgaugaagugaccgugguugagccggccucaucgacguccgucguacuguccagucugaagcccgaaacacuguaucucgugaacgucaccgcagaguacgaggacggauucucaauaccccucgccggagaagaaacuacugaggaggugaagggcgcgccuaggaauuugaaaguuaccgacgagacgaccgacucauuuaagauuacguggacccaggcacccgggagaguacuuagauacagaaucauauauaggccuguagcuggaggcgaaagucgcgagguaaccacacccccaaaucagcgacgccgcacucucgaaaaccuuauccccgauacaaaguacgaaguaaguguaaucccagaauauuuuucuggaccggguacaccguuaacuggaaaugcagccacugaggaagucagggguaacccacgcgaccuacgggugucugauccuacuacuucaacuaugaagcuguccuggagcggcgcuccuggcaaagugaaacaauaccucguuacauacacccccguugcaggcggcgagacccaagaggugacggucagaggagauacuacuaacaccgugcugcagggccucaaggaaggcacacaauacgcucugucgguuacugcucuguacgccucgggugcaggugacgcccuguucggcgaaggcaccacacuggaagaacgcggcuccccucaggacuuagugaccaaggacauaacugacacaagcauaggagccuacuggacuagcgcucccggaaugguaaggggcuaccguguaaguuggaaaagucuguacgaugauguggacaccggugaaaagaaccuccccgaggaugcgauucauaccaugaucgagaaccugcagcccgaaaccaaauaucgaaucagcguguuugccacguacucuucaggagaaggugagccacuaacaggcgacgccacuacugagcugucucaggacucuaaaacucuaaaggucgaugaagaaacugagaauaccaugcgggucacuuggaaaccagccccaggaaagguugugaacuauagggugguauaucguccccacggccgcgggaagcaaauggucgcaaagguuccuccgacgguaacaagcacuguguuaaaacgccuacagccucaaaccacauaugacauuaccguacucccaauuuacaaaaugggugaaggcaaguugagacaagggucuggcacuaccgccucuagauucaaguccccucgaaaucugaaaaccuccgacccaaccaugucuucauuucgcguaacaugggagccggcgcccggcgaggucaagggcuauaaaguuaccuuucaucccacaggagacgaccgacggcucggagaacucguggugggacccuaugacaacacaguggugcuggaagaacugcgcgcaggaaccacauacaaggugaacgucuucgguauguuugacgggggagaauccagcccgcuagugggccaagagaugacgacuuuaagcgauaccacgguuaugccaauucuuucuucaggcauggaaugccuuacgagggccgaagcggacaucguccuccucguugacggaucaugguccaucgggagagccaacuuuagaacugugcgcuccuucaucucucgaaucguggaagucuucgauauuggaccaaaacgugugcagaucgcccucgcacaguauucaggugacccuagaacugaauggcaacugaacgcccaccgugauaaaaaaucucuacugcaggccguugcuaaucugccuuacaaaggcggaaacacauugacagguauggcacucaacuucauccgccaacagaacuuccggacacaagcuggcaugcggccuagggcucguaagauuggaguucugauuacugacggcaaaagccaggacgacguagaagcccccuccaaaaaacuuaaagaugaaggagucgaacucuucgcgaucgggaucaagaaugcugaugagguugaacucaaaaugaucgcuacugacccugacgauacucaugcuuauaacguugccgauuuugaaagcuugucucgcauugucgacgaucuaacuauaaaucuaugcaacucagugaaagggccuggggaucuggaagccccuuccaaucucguuaucucugaaagaacccaccgcucguucagagugagcuggacacccccaagugacagcguagacagauauaaggucgaauauuauccagugucaggaggaaagcggcaggaguucuaugugagcaggauggagacuagcaccguguugaaggaucuaaagccagaaaccgaauacguggugaacguauacucugugguggaagaugaauauucugaaccucugaaaggaacugaaaaaacguugcccguuccugucgugucccugaacaucuaugacgugggcccaacuacaaugcacguccaguggcagccuguggggggggcgaccggauauauucugucauacaagccuguuaaagauaccgagccaacacgccccaaagaggugcggcucgguccaaccguaaaugauaugcagcugaccgaccuaguacccaauaccgaauacgcaguuaccguccaggccguuuugcaugacuugaccagugagccagugaccguccgugaaguuacucuuccucugcccagaccacaggaccuuaagcugcgagacgugacacacaguaccaugaauguguucugggaaccugugccagguaaaguucgaaaauauauuguccgauacaagacuccugaagaagaugugaaggaaguugagguugacagaagcgagacaaguaccuccuugaaagacuuauuuucccagacguuauacacaguuagugucuccgcuguucacgacgaaggagaaucacccccagugacugcacaggaaacaacuaggccaguaccagcaccaacuaaccucaaaaucaccgaagucacuagcgagggguuccgggguacgugggaccauggggcuucugaugucagcuuauauaggaucacaugggccccauucggaagcagcgauaagauggagaccauauuaaacggcgacgagaacaccuugguguucgaaaaucugaauccaaacaccauuuaugagguguccauuacagccauauacccagaugagucugagagugaugacuuaauugggucagagagaacuuuaccaauucucaccacccaagccccaaagagcggcccacgcaauuuacaggucuauaacgcaacaucuaacucccucacagugaaaugggauccagccagcggaagaguccagaaguaucgaauuacauaccagccuaguaccggagaaggcaacgagcagaccacaacuaucgggggcagacagaacuccgucguccuacagaaauuaaagccagacacaccuuacacuaucacuguuucuucccuauauccagacggcgagggcggcagaaugacagggcgagguaaaaccaagccacucaacaccguccgaaaucugagaguuuacgacccaaguaccaguacccugaacgucagaugggaucaugcugaagggaacccgaggcaauacaaguuguuuuaugcgccugccgccggaggucccgaggaguuagugccaaucccggguaacacuaauuacgcuauccugcgaaaccuccagccugacacuuccuacaccgucacuguggugccaguguacacugagggcgacgggggcagaacuagugauaccggccgcacgcuuaugaggggcuuggccagaaacguacaagucuacaauccuacaccaaauucccuagacgugaggugggaccccgccccuggaccuguucugcaguauagagugguuuauagcccgguggauggcaccagacccucagaaaguaucguuguccccgguaacacccgcaugguccaucuggagagacucauucccgacacgcuguacagcgugaaucugguagcgcuguauuccgacggagaagggaaccccaguccagcccaggggagaacauuaccccgguccgggccccgcaaccugagagucuuuggggaaaccacuaauucguugucagucgccugggaccaugccgaugggccaguucagcaguacagaaucauuuauucaccaaccgugggcgauccuauugaugaguacacuacaguccccggacgcaggaauaauguuaucuuacagccccuacagccugauacccccuacaaaaucaccguaauugccguauacgaagacggugacgggggccaucucaccggcaauggcagaaccgugggcuuacuuccuccccagaacauucacaucucagacgagugguacacacgcuuucgagucucuugggaccccaguccuucccccguguuaggauauaagauuguguacaagccagugggcagcaaugagccaauggaggccuucguaggggaaaugaccucauacacccuccacaaucugaauccaucuaccacauacgacgucaacguguacgcccaguacgauucuggguugucagucccuuugaccgaccagggcacuacucuuuaucuuaaugugaccgacuugaagacauaucaaauuggcugggauacauuuugcguaaaguggaguccacacagagcagcgaccucuuacagauuaaagcugucuccugcagauggaacacgcggacaggagauuacagugagaggaucagaaacuagccauugcuucacuggccucagcccugauacugacuacggugugacgguauuuguccaaaccccaaaccucgaggguccuggaguaucagucaaagagcauaccaccguuaaaccgacagaagcgccuacagagcccccuacaccucccccgccacccaccaucccucccgcccgcgacguguguaaaggcgccaaggccgauauaguuuuuuugaccgaugcuagcuggagcauuggggaugacaauuuuaauaaggugguuaaguuuauuuucaauaccgugggugguuuugacgaaauuucucccgcuggcauucagguuucauuuguccaguacagugacgaggucaaguccgaguuuaagcucaacaccuacaaugauaaagcccucgcauugggcgcucuccagaacaucagauauagaggaggaaacacaagaacagguaaagcacugaccuuuauuaaggaaaaaguacuuacaugggagagugggaugaggaaaaauguacccaaagugcuagugguggucacggacgguagaucacaggacgaaguuaagaaagccgcacucguuauucaacaaucaggguuuagugucuuuguagugggcguggccgauguggauuacaacgaacuggccaauaucgccaguaagcccucagaacgucacgucuuuaucguggaugauuuugaaucauucgagaagaucgaggauaauuuaauuacguucgugugugagaccgccacaaguaguugcccacucauuuaccucgacggcuauacgucaccaggcuuuaaaauguuagaggcuuacaaucugacagaaaaaaauuuugcuucugugcagggagucucacucgaaucaggcucguuuccaucuuauucugcuuaccgcauacaaaaaaaugcauuugugaaucaaccaaccgccgaucugcaccccaacggucuuccucccuccuacacgaucauccugcucuuccgccuguuacccgaaaccccuucggauccuuuugcuaucuggcaaaucacagaccgugacuauaagccgcagguaggcgugaucgccgacccaucuagcaaaacauuaaguuuuuucaacaaggauacucgaggagaaguucaaacaguaacuuucgauacagaggaggucaagacccuuuucuacggcagcuuccauaaacgcgaugaaggcaaguguccagccuuuccgaacaguugcacaugcacacaagacucuguugguccuccggguccuccugguccugccggcgggccgggugccaaggguccaagaggcgaacguggcauauccggugcuauuggcccgccaggaccgcggggagauaucggccccccaggaccucaaggaccuccaggaccccaagggccuaacggacuaucuaucccgggugagcagggcagacagggcaugaaaggugacgcuggagagccuggacuuccagggcgcacagguacaccgggccucccugguccaccagggccuauggguccuccuggcgaccgcggguucacagggaaggauggcgcuaugggaccccgcgggccucccgggccgcccggcucacccggcuccccaggcgugacuggcccaaguggcaaaccagguaagcccggagaucauggcagaccaggaccgucaggccucaagggggaaaaaggugaccggggagacauugccucucagaauaugaugagggcuguugccagacaagugugcgaacagcucauuaguggacaaaugaaucgguuuaaucagaugcugaaucagauccccaacgacuaucaauccaguagaaaucagccuggcccccccggcccacccggaccucccggcuccgcaggugcacgaggggaacccggcccuggcggacgcccagguuucccaggaacccccggcaugcagggcccccccggcgaacgcggccuuccaggggagaaaggggagcgcggcacuggaaguucaggaccaagaggccugccuggacccccagguccacaaggcgaaucacggacagguccacccggaaguacaggcucuagaggcccuccaggaccacccggucggccugggaacagcgggaucagaggcccccccggaccgccaggauacugcgacucuucucaaugugccaguaucccauauaauggccaaggguaccccggaucggguuag

SEQ ID NO: 5403 - RNA, 4494 nt, Artificial Sequence
  Description of Artificial Sequence: Synthetic coding sequence
auggaugucaccaaaaagaacaagagagauggcaccgagguaaccgagaggaucgucacagagaccguaaccacacgccugaccaguuuaccaccaaagggaggaacaaguaacggcuacgcuaagaccgcaagccugggaggggggucccgcuuagaaaaacaaucucuuacucacggcuccagcggguauaucaauagcaccgggucaacaagagggcacgccucuacauccucuuaccgcagagcucacuccccugcuuccacccugccuaauucuccuggcaguacuuucgagaggaagacacauguuacaagacacgcauacgaaggcagcagcuccggcaauuccagccccgaguacccccgcaaagaguucgcuaguagcagcacacggggccguucucagacucgggaaagugaaauacgcguaaggcuucaauccgccucuccaagcaccagauggaccgaacuugaugacguuaaaaggcugcugaaaggcucgagaagcgcauccgucuccccaacacgaaauagcucuaauacucugccuaucccaaaaaaaggcacuguagagacaaagauuguaacugccucaagccaauccgucucaggaacauacgacgcaacaauucuggacgccaauuugccaucccacgucugguccuccacgcuuccagccgguuccaguaugggaacuuaccacaauaauaugacaacccagucuucgagccuccucaacacuaacgccuacagcgccggaucuguauuuggggucccaaauaauauggcuucauguucuccaacccuucacccagguuuaagcacuagcagcagcguguuugguaugcagaacaaucuggcacccuccuuaaccacgcucucccacgguacuaccacgaccucuacugccuauggaguuaagaagaauaugccccaguccccagccgccgucaacacaggggugagcacuucugcugcgugcaccacaagcguccaauccgacgauuuauugcauaaagacugcaaauuccuuauucuagagaaggacaauaccccugcaaagaaagaaauggaauugcuaauuaugaccaaagacucgggcaaaguauucacugcuucaccugcuucaaucgccgcuaccucauucuccgaagacacacugaagaaggagaaacaggcugccuacaaugccgauucaggauugaaggcggaggccaauggcgacuuaaagaccguguccacuaaaggaaaaacaaccacugcugauauacacucauauggaucauccggcggaggagguuccgggggggguggcggaguugguggcgcuggcggcggucccuggggucccgcaccagcauggugcccaugcgggucaugcuguucgugguggaaguggcuuuuggggcuccuccuaacuugguuacuccucuugggauugcuguuuggacuuaucgcccuggccgaggagguuagaaaacuaaaagcucgcguggacgagcucgaaaggauccgccguucuauuuugccguacggugacucuauggacaggaucgaaaaggacagacuucagggaauggcuccugccgcuggcgcugaccuagacaaaauuggacuccauucugauagccaggaagaacuuuggauguucguaaggaaaaagcuaaugauggaacaggaaaacggcaaccugcgcggcucccccggccccaaaggcgacauggggucucccggaccuaagggugaccgcggcuuucccggaaccccaggaauuccuggaccauuagggcaccccggaccacaggguccuaaaggccagaaagguagcguuggggacccaggcauggaagggcccaugggacaacgggggagggaagggccaaugggucccagaggcgaagccgguccaccaggcagcggggaaaaaggcgagcggggcgcugcaggcgaaccaggaccacauggacccccuggagugccuggaucagucggacccaagggcucgagcggcucuccaggaccccaaggcccuccuggacccgucggacuccagggccugaggggcgaggucggacugccuggugugaaaggugauaagggccccauggguccacccggcccaaaaggggaucagggggaaaaggguccucgcggguuaacaggugaaccagguaugaggggguugccuggugccgucggagaacccggugcgaagggugcaaugggcccagcuggaccugauggccaccagggcccacguggcgaacagggcuugacaggaaugccugggauaagaggaccaccuggaccaucuggggaucccggcaagccaggccucacgggcccucaggguccccagggcuugcccggcacccccgggagaccaggaaucaagggagagcccggcgcaccaggaaaaaucgugacauccgagggaucuaguaugcugaccgugccaggcccgccuggaccccccggcgcgauggguccucccggccccccaggcgcucccggcccggccggaccagccggacuaccuggacaccaagaggugcugaaccugcaggguccacccggcccuccgggacccagaggcccuccaggaccaucuaucccaggacccccagguccaaggggccccccgggagaaggauuacccggaccgccugguccaccaggcucauuucugagcaauuccgagacauuucucuccggcccacccgguccaccugguccaccaggccccaaaggcgaccaaggcccuccgggaccacgcgggcaucaaggcgaacaaggccucccaggguuuaguacguccggcuccucauccuuuggucuaaaccugcaagguccucccgguccuccaggcccucaaggaccuaagggcgauaagggggauccuggggucccaggagcacuggggauucccagcggcccuagugagggcgggucuuccaguaccauguaugugucaggacccccaggccccccaggccccccugguccccccgguuccauuagcucuucuggccaggagauccagcaguauaucuccgaguauaugcaaagugacuccauuagguccuacuuaucuggggugcaaggcccccccggcccgccaggaccuccagggccagucaccacaaucaccggcgaaaccuucgacuauucagaacuugccucccauguuguguccuacuugagaacuucuggcuauggaguaucacuguucucuuccucuaucuccucugaagauauccuugcuguucugcaaagagacgacgugcgccaguaccuucgacaauaucugaugggccccagagguccuccugguccacccggagcauccggcgaugggucauuacucucccucgauuacgcggaacuuagcaguagaauacugucauacaugaguaguucuggaaucaguaucggguuacccggaccucccggcccccccggauugcccggaacaucuuacgaggaacuccuaucuuugcugcggggaucagaauuuaggggcaucguggggccccccggccccccaggccccccagguaucccaggaaauguguggucuucuaucucggucgaagaccugucuuccuaucugcacacugccggacucuccuuuaucccaggacccccuggaccucccgguccacccggccccaggggccccccaggugucuccggagcuuuagcuaccuaugcagcugagaauagcgacucauuuagaucagaguugauaucauaucugacuucgccggacguuagaaguuucaucguugggccucccggcccuccagguccccagggccccccaggugacucgagacucuuauccacagaugcaucacacucgagaggaucauccucauccucacacucaaguuccgugaggagaggcucgagcuauucuagcuccaugaguaccgggggaggaggcgcaggcagucuuggcgcgggaggggccuuuggggaagcggcaggcgauagagggccauaugguacggauauugguccuggcgggggguacggagcagcagcagaaggugggauguaugcaggcaacgggggucugcucggcgccgacuucgcaggcgaccuggauuacaacgaacuugccgugcgggugucagaauccaugcaaagacagggguuacuacaggggauggcuuauaccguccaaggcccaccaggccaaccuggcccacagggacccccaggcaucagcaaaguguuuagcgccuauagcaacgucaccgccgaccuaauggacuuuuuucaaacguacggagccauucagggcccacccggucagaagggugagaugggaaccccgggcccaaaaggugauagaggaccagccgggccaccuggacaccccggacccccagguccucgcgggcauaagggcgagaagggcgauaagggagaccagguuuaugcuggacgcaggcgcaggagaucaaucgcagucaagcccuag

SEQ ID NO: 5404 - RNA, 1254 nt, Artificial Sequence
  Description of Artificial Sequence: Synthetic coding sequence
auggacgucacuaaaaaaaacaagagagacgggacugaagugacagaacgaauugugacugagacagugacaacccgccugacuagucugccuccuaaagggggaaccagcaacggcuacgccaagacagcuagucucggaggaggcucucgguuagagaagcaaucccucacucauggaaguuccggcuacaucaauucuacaggauccacgcgcggacacgccaguacaucuagcuacagaagagcacacucccccgccaguacacuaccaaacucaccuggaagcacuuucgagcguaaaacacacguaaccagacacgccuacgaaggcuccuccagcggcaauucgucuccagaguaucccagaaaggaguucgcaaguucuucaacgcguggucgcucccagacaagagaguccgagauucgcguccgucuucaaagcgccagccccucaacccgguggacagaacuagacgaugugaaaagacuguugaaaggcucacggagcgccucaguaagucccacaagaaauucaucgaauacccugccuaucccaaagaagggaacggucgagaccaagaucgucacagccaguucccagagcguuuccgggacauacgacgcaacaauuuuggaugcuaaccugccaagccaugucuggaguucaacucucccugccggaucaagcauggggacuuaucacaacaauaugaccacacaaagcaguagccuguuaaacacuaaugccuauagugcuggcucugucuucggcgugcccaacaauauggccuccuguuccccuacacuucacccaggucuaaguaccucaucaagcgucuucggcaugcaaaauaaccuagccccuucccuuacuaccuugagucacggcaccacaacaaccaguacugcuuacggcgucaaaaagaauaugccccagagucccgccgccgucaauacugggguaucuacauccgcagcuugcaccacaucuguccaauccgacgaccugcugcacaaggacuguaaauuuuuaauccucgaaaaggauaacacaccagcuaagaaggaaauggagcuccugauuaugaccaaggauagcggcaaaguguuuacagcuagucccgcuucaaucgcagccacauccuuuuccgaagacacccugaagaaggagaagcaggccgcuuacaaugcagauaguggauugaaagcagaagcgaauggaaaaaacaaauacgacuguugcccacccuag

SEQ ID NO: 5405 - RNA, 201 nt, Artificial Sequence; identical to SEQ ID NO: 5290
  Description of Artificial Sequence: Synthetic coding sequence

SEQ ID NO: 5406 - RNA, 1815 nt, Artificial Sequence
  Description of Artificial Sequence: Synthetic coding sequence
auggaugugacuaagaagaacaagagagauggcacagaggucacugagcguauagugacugagacagugacaacaagacuaacuucguugccuccaaaggguggaacaucaaacggauaugcaaagaccgcauccuuaggcggaggaaguaggcuggagaaacaaucccugacgcauggcagcagugguuauauaaacaguaccggaucuaccagaggacaugccucuaccucuuccuaccgacgcgcccacucccccgccucaacacuucccaacagccccggcaguacuuuugaaagaaagacccaugucacucgacacgcuuacgaggcuucaagcaguaccagaggccggucucagacccgugaauccgaaaucagaguucgacuccagucugcaucccccucuacacgauggacagaauuggacgacguuaagcgauugcugaaaggaucacguagugccucuguuucgccuaccagaaacucuucuaacacccuccccauaccaaaaaaaggaacuguggaaacuaaaaucgugacggcaucuucacagaguguaucugggaccuaugacgccacaauucucgacgcuaaccuaccgucucacguguggaguagcacccugccggccggaagcucuaugggcacauaucauaacaacaugacaacacaauccuccucccugcugaacacaaaugccuacucugcugggucagucuuuggcguuccaaauaacauggccucauguucucccacucuccacccaggcuugucaacauccucguccguauuugguaugcaaaacaaccuggccccaucccuuaccacucugucacacggcacuacaacuacauccacagccuauggcgucaagaagaacaugccccagucaccugccgccgugaacaccggcgucagcacauccgcggcaugcacaaccuccguucaaucugacgaucugcuucacaaggacugcaaguuccuaauacuagaaaaagauaacacgccagcaaagaaggaaauggaacugcucaucaugaccaaggacaguggaaaaguuuucaccgcaucccccgccucgaucgcagcgaccuccuucagugaagauacucuuaagaaagaaaagcaggcggcauauaacgcugacucuggccugaaggccgaagcuaacggcgaccucaagacggugaguaccaagggcaagacaacaaccgcugauauucauuccuacggcucgucaggagggggcggaucaggaggggggggcggaguugguggagcuggcgguggccccuggggccccgccccagcuugguguccuuguggaagcugcugcuccugguggaaaugguuacugggucuauuacuuacauggcuguuauuacugggacuucuuuucgggcucauugcccuggcugaggaaguaaggaaauuaaaggcacgcguggacgagcuggagcguauaaggcggucuauacucccauacggggacucaauggaccggauagagaaagaucgacuacagggaauggcccccgcagccggugcagauuuggacaagauaggacuacauuccgauucucaggaggagcucuggauguuugugagaaagaaacuuaugauggagcaagagaaugggaaucuucgagguuccccaggccccaagggugacaugggguccccaggcccaaaaggcgacagaggguuccccgguacacccgguauucccggccccuuaggccacccgggaccacaaggaccaaagggacagaagggcuccguaggcgacccagguauggagggcccgauguag

SEQ ID NO: 5407 - RNA, 3951 nt, Artificial Sequence
  Description of Artificial Sequence: Synthetic coding sequence
auguccucuggagaccccgcccaucucgguuuaugucuaugguuauggcucggcgcuacacugggucgcgagcagguccaggccagcgguuugcugagauuagccguccugccugaggauagacuucagaugaaauggcgggagucagaagggaguggccugggauaccugguccaaguuaaaccuauggccggagauucugagcaagaaguuauacuuacaacgaagaccccaaaagcuacaguggguggccucucaccaaguaagggauauacucugcagauuuucgaacuaaccgguuccggccguuuucuguuggcucgcagagaauuugugaucgaggaucuuaaauccuccagccuagaccgaagcagccaaaggccauuaggauccggcgcacccgagccuacuccaagucauacuggcuccccagaucccgaacaggccucagagccccagguugcuuucacuccgucacaggauccacgcacuccagccgguccacaauuuagaugccugcccccaguucccgccgacaugguuuuucuggucgacggcucuuggucaauuggacacagccacuuucagcaagucaaagauuuccuggccucugucauugcacccuucgaaaucggacccgacaaagugcaggucggcuugacccaauauucgggagaugcucaaaccgagugggaccugaauucccuuagcaccaaggagcagguucuagcagcugugcgaagacuccgauacaaaggcggcaauacguucacugggcuggcuuugacccauguacuaggucaaaauuuacaaccugccgcuggacuccgccccgaagccgcaaaaguggugauucugguuaccgacggcaagucucaggaugauguacacacugcagcucguguucugaaagaucuaggcguaaacguuuucgccguaggugugaaaaaugccgacgaggccgaacugcgccuucuugcuuccccccccagagauauaaccguacacuccgugcucgacuucuuacaauugggagcauuggccgggcugcuguccagacugaucugucaacgacugcagggaggaucuccacgucagggaccugcugccgcucccgcccuggauacccuuccagcgccuaccagccucguucugagccaggugaccagcuccuccauucgccuguccuggacucccgcuccaagacauccacugaaguaccugauugucuggcgagcuuccagagguggcacaccccgagaagugguggucgagggcccagccgcuaguacugagcuccauaaucuggcuucuaggacagaguaucuggucaguguguucccuaucuacgaaggcgggguaggagagggccuccggggacugguuaccacugcccccuugccgcccccccgagcucuaacauuggccgccgucacaccucgcaccgugcaucugacauggcagccaucagccggagcuacacacuaccugguuagguguuccccugccagcccuaaaggggaggaagaagaaagagagguccaggugggucgcccagaaguacucuuagacggguuggagccuggccgggacuacgaggugagugugcaaagccugaggggcccugagggaagugaagccagaggaauuagggcaagaacaccgacauuggcacccccccgucauuugggauuuuccgacguuucucacgacgccgcaagaguguuuugggagggcgcgccacgaccugugaggcucguucgagugacauacguaagcuccgaggguggacauucaggucaaacagaggcacccggaaaugcaaccagcgcuacguuagguccccucagcagcaguaccaccuauaccgucagaguaaccugucuguaucccggcggcggaagcucuacccugaccggaagagugacaacaaagaaggcucccagucccucucaacuguccaugacagagcuacccggcgaugcagugcagcuggccuggguggcagcggcuccuucuggcgugcuagucuaccagaucacauggaccccucuuggagaagguaaagcucacgaaauuuccguucccggcaaccucggaaccgccguacugccuggacuuggaagacauacggaauaugacgugacaauacuggccuacuaccgggacggcgcgaggagcgacccugugucucugagguauacaccauccacugucucgcguucacccccauccaaucuggcacucgccagcgaaacaccugauuccuugcaaguuagcuggacaccaccccuggggaggguccuccauuacuggcugacguaugcgccugcuagcggccuuggcccagagaaguccgucuccgucccaggggcgagaucccacgugacacugccugaccugcaggccgcuaccaaauauagaguucugguuagugcaaucuaugccgcugggagauccgaagcaguuucagcuacaggccagaccgcuugucccgcacugcggccugaugguagccugcccggguuugaccuuaugguggccuucucacugguggaaaaggcuuaugcuagcauuagaggcguggcuauggaaccuagcgcuuucggggguaccccuacguuuaccuuguucaaagacgcucagcugacucggagggugucugacguauauccagcucccuugcccccugaacauacaaucguguuucuggugaggcugcuuccagaaacucccagagaagccuuugcuuuguggcaaaugaccgcugaggauuuccaaccguugcugggcguccugcuggaugcaggaaaaaaaagucugaccuauuuucacagagauccaagagccgcucugcaggaggcuacauuugacccacaggaaguuaggaagauuuuuuuugguuccuuucauaaaguccacguggccguugguaggaguaaaguuagguuguacgucgacugccgcaaagucgcagagcguccacugggggagaugggcagcccgcccgcagccggauuugugacccugggccgucuugccaaggccagagguccccguagcucauccgcggcuuuccagcuucagaugcuccaaauuguguguagcgauacgugggccgacgaagauagguguugcgaauuacccgcaucccgagacggugaaacaugccccgcuuucgucagcgccugcagcuguagcucagagacuccuggcccacccgguccacagggaccacccggucugcccggaaggaaugggacgcccggcgaacaaggguuuccaggucccagaggggagccuggucccccuggccagaugggcccugaagggccaggaggacagcaaggaaguccuggcacacaaggaagggcaguccagggcccgguuggacccccaggaguuaaaggagaaaagggugaccacggcuuacccgggcuacaaggccaccccgggcaucaaggaauaccagggagagucggucugcaaggucccaaagguaugagaggccuugaggggacugcaggccugcccggcccaccaggaccacggggauuucagggaauggccggcgcacgugguacaucaggggagagaggaccccccgggacaguggguccgacaggacucccagggccaaaaggcgagaggggggaaaaaggugagccucaaucccuugccacacuuuaucaacucguaucacaagcaucacacgucucuaaauuugauaguuuccaugaaaacacccgcccacccaugccgauucuugaacaaaaguuggaaccaggaaccgaacccuuggggucucccggaacacgcagcaaagcccucguaccuggcgaaugggggaggggcggcagacaucuggaagggagaggagagccuggggcaguggggcagauggggaguccuggacagcagggagcuaguacgcaaggccuuugggaguag

SEQ ID NO: 5408 - RNA, 3855 nt, Artificial Sequence
  Description of Artificial Sequence: Synthetic coding sequence
augucauccggagauccggcacauuugggucuaugucuguggcuuugguuaggcgcuacauuaggacgggagcagguacaagcaucaggccuguuaagguuggccguuuuacccgaggaccgacugcagaugaaauggcgggaauccgagggauccggguuaggauaucugguccaggucaaacccauggcuggagacucugaacaggaggucauucucacgacaaagacuccuaaggcuacaguuggcggacugucccccuccaaaggcuauacucuucagauauuugagcugaccggaucuggacgauuuuuacuggcacgccgggaauuugugauagaagaccugaaauccucaucccuagauagaucuagccagcggccucucgguaguggagcuccugaacccacuccuagccacacgggcucuccagacccagagcaagccagcgagccacagguggccuuuacccccucacaggacccacguacucccgcugggccccaguucagaugccugccucccgugccugccgauauggucuuccucguagacggaucauggucuauugggcacucacauuuucaacaaguaaaagacuuccuugcuucagucaucgcaccauuugagauagggcccgauaaggugcaaguaggccuaacgcaguauaguggugaugcccagaccgaaugggaccugaacucucuuucuacuaaagaacagguucuugcugcaguuaggcgccuccgguauaaggguggaaauacauuuacgggguuagcucucacucaugugcucggucagaaucuucagccagcugccggacugcggcccgaggccgcgaaaguggucauuuuaguuacggacgggaaaucacaggaugaugugcauacagccgcccguguacucaaagaccuuggcgugaauguguuugcagucggagugaagaacgccgacgaagcugagcucaggcugcuggccucaccuccccgggacaucacuguucacucuguacuggauuuuuugcagcugggcgcccuggcaggacuccuaaguagguugauuugucaacggcuccaggggggaagcccaagacaggggcccgcagccgccccugcauuagauaccuugcccgccccaacuucccuuguuuuaucacagguuacaaguuccagcaucaggcuuucauggacaccagccccgagacacccccugaaauaccugauuguguggagagccaguaggggugggaccccuagggagguugucguugaaggacccgccgcuucuaccgagcuccacaacuuggccaguagaacugaauaucuuguaagcguguuccccauuuacgagggcggcguuggcgaaggucuucgcggcuuagucaccaccgccccccuuccacccccccgagcacugacauuggcagcugugacuccgagaaccguucaucuuaccuggcagccuagugccggcgccacucacuaucugguacgcugcuccccagccagucccaaaggagaagaagaggaacgugaaguccaggucggcagaccagagguguuguuggacggacuugagccagguagggauuacgaaguaagcguacagagucucagaggaccggaagguagugaggccaggggaauccgagcacgcacgcccacccuggcgccuccucgccaucucggcuuuucagacgugagccacgacgcggcccggguuuucugggaaggcgcaccccggccagugcggcucguucguguuacuuauguuucaucagagggugggcacaguggacagacugaagccccugggaacgccacaagcgccacucuaggaccccugagcucauccacaaccuacaccgugcgcgugacuugccuguacccugguggaggaucuucaacuuugaccggacgagucacuaccaagaaagcaccuucaccgucgcagcuuucaaugaccgaguugccaggcgacgccguccaguuagccuggguggcugccgcuccuuccgggguuuuaguauaccagauuacuuggacaccacugggagaaggcaaggcucacgaaaucucaguacccggcaacuuggggacggccguucugcccggccuggggcgccacacugaguacgacgugacuauccuugccuacuaucgggauggcgccaggucagaccccguuuccuuaagauacacaccuuccaccgucucccgcucuccuccaucuaaucuagccuuagcgagcgaaacgcccgacucccugcaggugucuuggacuccgcccuuaggacgagugcugcacuacuggcucacauaugcaccagcaucaggccugggcccugaaaaguccguguccguaccgggagcaagaagccaugugacguugcccgaucuccaggccgccacuaaguauagaguccucguuagcgccauuuaugccgcaggaaggucagaggcagugagcgccacuggucaaacggcaugccccgccuuacgacccgauggcucauuaccagguuucgauuuaauggucgcauucucccucguggagaaggcauaugccagcauuagggggguggcaauggaaccaucugcguucggaggaacccccacauucacccuguucaaggaugcacagcugacucgacgagugucugacguauauccugcgccucugccaccagaacauacgauagucuuccucguccgccuguuaccugaaacucccagggaggcauuugcacuguggcagaugacugcugaggacuuccagccauuauuggguguccuccucgaugcaggcaaaaaaagucugaccuauuuccaccgcgauccaagggcagcccuucaagaagcaaccuucgacccccaggaagugcggaaaauauuuuucggguccuuucacaaggugcacguagcagucggcaggucuaaagugagauuauacguggauugcagaaagguagcagagagaccgcugggcgaaauggguucaccacccgccgccgguuuugugacccuaggcagauuggcaaaagcccgaggcccuagauccaguuccgcugcuuuccagcugcagaugcuacagauugugugcucugauacuugggccgaugaggacagauguugugaacuuccugccagccgcgacggagaaacuugcccagcuuuuguaucugcuugcuccuguucaucugaaacccccggaccgccugggccccaggguccccccgguuuaccuggcagaaacgggacgccuggcgagcaagguuuucccggcccacgaggaccucccggggucaaaggagagaagggggaucacggacugccuggauugcaaggacacccaggccaccaagggauuccaggcagagucgguuugcaggguccaaagggaaugaggggacuggaaggcacagccgggcugccagggccacccgguccaagaggauuccagggcauggcuggagcucggggaacaucaggagagagggggccgcccggcaccguaggcccaacagggcuuccagguccuaagggcgagaggggggagaaaggagagccucaaagucuggccacucuuuaccaacuggugagccaagcuagccacgugagcaaguuugauuccuuucacgagaacacuagaccacccaugccaauauuggagcagaaacuugaaccgggcacagaaccuuuagguagcccagguacccgcagcaaagcccuggugccgggagaauggggaaggggaggcaggcaucuggagggucgcggggaaccuggcgcugucggucagauggguaguccuggucagcagggggcaucaacacagggacucugggaguag

SEQ ID NO: 5409 - RNA, 3894 nt, Artificial Sequence
  Description of Artificial Sequence: Synthetic coding sequence
auguccuccggcgaccccgcgcaccugggucucugccuguggcuuuggcugggcgccacucuuggcagggaacagguccaagcauccggccugcuccgacuggcuguccugcccgaagaucgcuuacagaugaaguggagagaaucagagggauccggacugggguaccugguacaagugaaacccauggccggagauagugagcaagaggugauccugacaaccaaaacuccuaaagccacagucggcgguuuaaguccaucaaaagguuauacucuacaaaucuuugaacugaccggcucgggcagguuuuugcuggcuagacgggaguucgugaucgaggaccuuaagagcucaagccuggauagaaguucacagaggccccucggcucuggcgcuccugagccuacaccaucgcacacagguuccccugauccggaacaagcuagcgaaccacagguugccuuuacacccucgcaagacccacgcaccccugguggcuccgaauggcgagagaccggcccccaguucaggugccucccuccuguuccugcggacaugguguuccuggucgacgguucuuggucuauuggucauucucacuuccaacaagucaaggacuuuuuggcgucuguuauagcgccuuuugaaauuggaccagauaagguacagguuggccuuacucaauauuccggugacgcucagaccgaaugggaccuuaauagccuaucaaccaaagaacagguuuuggcugcugucaggcgacuucgcuauaagggcggaaauaccuucacuggccucgcccucacgcaugugcucggccaaaaucugcaaccugcagcaggacucagaccagaggcugccaaggugguaauacuggugacugacggaaagagccaggaugauguucauacugcugccagaguucugaaagaucucggagucaacguguuugcugucggcgugaagaacgcagacgaagcugaacugcgacuccuugccagcccuccccgugauaucaccguccauuccguccucgauuuucuccagcugggcgcccuugcaggauuguugucacgauugauuugccagagacugcagggaggaagccccaggcaaggaccagccgccgcucccgcuuuggauacacugcccgcaccuaccagccuggugcuaagccaggugacuagcuccucgauucgcuugucauggacgccugcaccccgccauccuuugaaauaccugaucgucuggagagcuagcaggggaggcaccccuagagaaguugucguggaggguccagcugcaucuaccgagcugcacaaucuagccucaagaacugaauaccucguguccguguucccuauuuacgaaggcggcgugggagaaggacugcgcggccuggugacaaccgcaccauuacccccaccccgugcuuugacacucgcggcugugacgccucguaccgugcaccuuacuuggcaaccuagcgcuggcgccacacauuaccucgugcgauguucuccugcaucacccaaaggggaggaggaagaacgggaggugcagguuggccggcccgaaguguuacuggacggacuugaacccggccgcgacuacgaaguaagcguacagucacugaggggacccgaggguagugaggcgcgggggauuagggcaaggacaccuacacuugcgcccccuaggcaucugggcuuuuccgacguuagucacgaugcagccagaguguucugggagggugccccuaggcccgucagacuagucagaguuacuuaugucuccuccgagggaggacacagcggacagaccgaagcuccaggaaacgccacuagcgccacguugggcccgcuaucuuccaguacgacuuacacaguuagggugacaugucuuuauccaggaggcggcagcucgacucugacaggaagagucaccacaaagaaagccccuucccccagccaacugucuaugacugagcugccuggagacgcaguccagcucgcuugggucgcagcugcacccucuggcguauugguauaucagaucacuuggaccccucuuggagaggguaaggcucaugagaucuccguccccgguaaucuagggacugcaguguuaccgggucugggacgacauaccgaguacgauguaacuaucuuggcauacuaccgggauggagcccgaucugacccaguuucccucagguauacacccucaacugucucucgcagccccccuuccaaccuggcccuagccuccgaaaccccugacucucugcaggugucguggacaccuccucucgggcgagucuugcacuacugguuaacauacgcacccgccagcggucugggaccagaaaaaucugucagcgucccgggugccaggucccacgugacccugcccgaccugcaagcugcuacuaaauaccgcguguuggugucugcgauuuacgccgcgggacgcagcgaggcugugagugcuaccggccagacagcaugcccugcuuuaagaccugauggcagccugccuggauuugacuuaauggucgcauucucccuagucgaaaaagccuaugccaguauucgggguguggccauggaacccagcgcauuuggugggaccccgacauuuacucuguuuaaagaugcucaauugacacggcgugucuccgacguguaucccgccccccuucccccagaacauacaaucgucuuucuuguccgccucuugcccgagacaccuagagaagccuuugcacuuuggcaaaugaccgcagaagauuuucagccucuguuggggguccuccuugaugccggcaaaaagucccucacguauuuucacagagauccucgagccgcgcuccaggaagcaacauuugauccgcaagaggugagaaagauauuuuuugggucuuuccacaaggugcacguugccguuggacgcucaaaggugcggcuauauguggauugccgaaaagucgccgagaggccacugggggagauggguaguccccccgccgccggguucgugacucuaggucgccuggcuaaagcaagaggaccaagaaguucaagcgccgccuuccaacugcagaugcuacagauugugugcagcgacaccugggcugacgaggaccguuguugugaacuccccgcuucccgggauggagagaccugcccggcguuugugucagcauguucaugcucaucugagacuccaggacccccuggcccacaggguccaccaggccugccaggaagaaauggcacuccaggagaacaaggauucccuggaccccgcggccccccgggcgugaaaggcgagaagggugaucacgggcugcccggucuccagggccaucccggccaccagggaaucccaggaagggugggacugcaaggaccuaagggcaugaggggacuggaagggacugcgggcuugccagggccgccagggccaagaggauuucaaggaauggcaggagcaagaggaacuucuggcgagcgagggccucccggaacuguagggccuacgggauugccgggcccuaaaggagagcgaggcgagaaaggagaaccacagagcuuggcgacuuuauaccagcucguaucucaggcgugcgaaucagccauucagacucaugucaguaaguucgauuccuuucaugaaaacacgaggccaccaaugccaauuuuggaacagaagcuugagcccgggaccgagccucuugggagccccggcacacggucaaaggcucuggucccuggggaauggggacggggcgggaggcacuuggaggggcgaggagaaccaggugcagucggucagaugggcucacccggacaacaaggagcaucuacgcaaggcuuaugggaguag

SEQ ID NO: 5410 - RNA, 3894 nt, Artificial Sequence
  Description of Artificial Sequence: Synthetic coding sequence
augucuucuggcgacccagcucaucuuggccugugcuuauggcuguggcucggagccaccuuggggcgcgagcaaguucaagccuccggccuuuuacgcuuggccguccuccccgaagacagacugcagaugaaguggcgcgaauccgaagggaguggcuugggcuaccuggugcaagugaaaccuauggccggcgauagcgagcaggaaguaauucugacuacuaagacaccgaaagcaacaguugguggacucucuccuaguaaaggauauacucuucagauauuugaguugaccggauccgggcgauuccuacuagcacgucgagaguuuguuaucgaagaccucaaaucguccuccuuagacagauccagccaacggccccucggauccggagcaccugaaccaacgccaagucacaccggcucgccugaccccgagcaagcauccgagccucaaguugccuucacuccaagccaggacccccggacaccaggcggcuccgaguggcgagagacuggcccucaguucagaugucucccccccguccccgcagacaugguuuuccuuguggacggcucauggaguauuggacauucccacuuucagcaggugaaggauuuucuggccucaguuauagcaccauucgagauagguccggauaaaguccaggucgggcuuacacaguacucgggugaugcacagacagagugggacuugaacaguuugaguacgaaggaacaagugcuggcugcggugaggcgacugagauacaagggcgggaauacauucacgggacuggcucugacacacguguuaggacaaaauuugcagccagcagccggccugaggccugaggcugccaaaguagucauauuagugacagacggaaagucgcaggacgacgugcacaccgccgccagaguucuaaaggaccucggggucaacgucuuugccguuggagugaagaacgcagacgaagcugagcuaagacuccuggccucuccuccucgcgacauaaccguucacaguguguuggacuuucuucaguuaggagcccucgcaggcuuguuaagccgcuugauuugucagcgucuucagggcggaucuccacgacagggaccugcugccgccccagcccuugauaccuuaccggccccaacaucccugguccugucccaggugaccagcucuucuaucaggcugucguggaccccagcgccccgccacccacugaaauaucugauaguguggcgggcuucgagaggcggaaccccuagggaaguugugguggaaggaccugcagcuaguacagaacugcauaaccuagcuaguagaaccgaguaccugguaucuguauuuccuauuuacgagggaggaguuggcgagggucucagggggcucgucacaacugcaccuuugccucccccaagagcccugacacucgcggcugucacuccccgcaccgugcaucugacguggcaaccaucugcaggcgccacccauuaccuugugagauguagcccagcauccccaaagggcgaggaagaggagagagaagugcaagugggaagacccgaaguucugcuggacggacuggagccuggucgggacuaugaagugagcguacaaucuuuacguggcccagaagguagugaggcccgugggauucgagcccgcacaccaacucucgccccaccacgacaccugggcuucucugacgucucucacgacgccgcgcgcguguucugggaaggugccccucggcccgucaggcucguccgcguuaccuacguuucgucugaagggggccauagcgggcaaacagaagcgccugguaacgcaacaucugcaacacugggcccccugucaucuuccacuaccuacaccguacgugugacaugucucuauccgggagguggcucaaguacccuuacaggccguguaacaacaaaaaaggcaccauccccuagucagcugaguaugaccgaacugccaggagacgcagugcaacuggcuuggguugcagccgcuccuucuggugucuugguuuaccaaauuacguggacuccuuuaggcgagggcaaggcacacgaaaucagcgugccaggcaaccuuggcacugccgugcugcccggacugggccgacauacagaguacgacguuacaauucuagcauauuacagagauggagccagaagcgaccccguuucccucagauauacacccucaaccgugagucgcagcccaccuucgaaucucgcauuagccucugaaacgcccgacaguuugcaggucuccuggaccccaccccuggggcgaguauugcauuauuggcuuacguaugccccagccaguggccugggccccgagaaaucagucuccgugccaggggcucguucacauguuacccugccagaccugcaggcagcgaccaaguaccguguucuggugagcgcgauuuaugcagcaggaaggagcgaagcggucagugcaacaggacagacugcaugcccugcguuacguccagauggaagccucccgggguucgaccuuauggucgcuuucagccugguagaaaaagccuacgcaagcauuaggggcguugccauggagccaagcgcauuuggagggacgccaaccuuuacccuauuuaaggaugcccaguugaccagaagaguguccgacguuuaccccgccccgcuuccgccugaacauacuaucguguuccugguaaggcuccuucccgaaaccccccgagaggccuucgcccucuggcagaugaccgcagaagauuuccaaccuuuacuugggguuuuacuugaugccggcaagaaaucuuuaacuuacuuccacagagacccacgcgccgcccugcaggaagccaccuucgauccucaggaagugaggaaaauuuucuucggcucauuccacaaaguucaugucgcaguuggacgcaguaaaguccgccucuacgucgacugccgcaaggucgccgagcgcccucucggcgagaugggaucuccuccagccgccggcuuugugacacuggguagacuugcaaaagccagaggcccccggagcucaagcgcagccuuucagcuccaaaugcuccaaauuguguguagcgauacuugggcugaugaagaccgaugcugugaacuucccgcgagucgagacggagaaaccuguccggccuuugugagcgcaugcuccugcucauccgagacacccggcccacccggaccacagggccccccuggauugccuggcaggaacgggaccccuggugaacagggauuccccggaccacgggguccaccaggaguaaagggggaaaagggcgaucauggacugccaggacuacaaggccauccaggacaucaaggcauaccaggcagagucggcuuacagggaccuaagggcaugagagggcucgaagggacggcaggccuacccggcccuccgggaccccgcggguuucaagguauggccggggcacgcggaacaagcggcgaacguggcccacccggaacagugggcccuacuggccucccaggcccuaagggcgagcgcggcgagaaaggcgaaccgcagagcuuggcuacacucuaucaguugguaucucaggccugcgagagcgcaauccaaacacauguuucaaaauuugauagcuuucacgaaaauacccgaccacccaugccaauccuggaacaaaaacuugagcccggcaccgagccccuaggaagccccgggacacgauccaaggcuuuagugccaggagaaugggggaggggggguagacaccucgaagggaggggcgagcccggcgcaguggggcaaauggguucaccugggcagcaaggagccaguacacagggauugugggaguag

SEQ ID NO: 5411 - RNA, 2175 nt, Artificial Sequence
  Description of Artificial Sequence: Synthetic coding sequence
auggcagggcugaccgccgcggcaccccgaccaggcgucuuauuacugcuguuaucaauccugcaccccucucgaccaggcggagugcccggcgcgauucccggcggagucccaggcggcguuuucuacccaggggcuggauugggagcucugggagguggggcuuuggguccgggugggaagccauuaaaaccggugccagguggacuugccggcgcuggccugggagccggccuuggcgccuuuccagccguaacauuccccggugcguuagugccaggaggagucgcugacgcagccgcagcguacaaagcugccaaagccggcgccgggcuggguggggugccuggcguggggggucucggagugucagcaggcgcgguagugccucagccaggagcaggagugaagcccggaaaagugcccggcgugggguugccugggguuuacccagggggugugcuaccgggggcuagauuuccaggaguuggaguucuuccuggagugccuacaggugcgggugugaaaccuaaggcaccaggaguggggggagcuuucgcagggauuccuggggugggcccuuucggggggccccagcccggugucccgcucggcuacccuaucaaggcuccuaaacucccaggcgguuacggauuaccauauacuaccggcaagcuucccuauggauacggcccagggggaguagcaggcgccgcaggcaaggcugguuacccaacaggaacaggcgucgguccacaggcagcggcagccgcugcugcaaaggccgccgcgaaauuuggcgcaggagcugcugggguccuuccaggcguggguggggcgggagucccugguguccccggagcaaucccuggaaucgguggcauugccggugugggcacuccggccgccgccgccgcagccgccgcagccgccaaagcagcaaaguacggagcagcugccggccuugugccuggggguccuggguucgggcccggcguuguaggugucccaggggcgggcgugcccggcguaggugugccgggggccgguauucccgucgucccuggugcaggcauaccaggagccgcugugccuggcgugguuagcccugaggcugcugccaaggccgcagccaaggcugccaaguauggagcuagacccggcguuggcguuggcggaaucccaacauacggggugggugcagguggauuuccaggguuuggggucggggugggcggaaucccuggugucgcaggggucccagggguugggggagugccugggguaggaggagugccgggcgugggaaucucacccgaagcacaggcagccgcagccgccaaagcagccaaguacggaguggggacaccagccgccgcugcagcaaaggccgcggcuaaagccgcacaguucggacuggugccuggcgugggcgucgcacccggcguggggguugcuccaggagucggcguggcacccggggugggucuggcaccuggggucggcguggcaccuggcguuggcguggcccccggcgugggaguggcgcccgguauugguccgggugguguggccgcggccgcaaagucugccgcgaaaguugcagcuaaggcucaacuccgugcugccgccggccuuggugcagggaucccuggacucggugugggggugggaguuccuggauugggagucggagcuggugugccuggccugggaguuggcgccgguguuccaggauuuggcgcagugccuggagcucucgccgcagccaaggcugcaaaauauggcgccgccguaccugguguucuugggggacugggggccuugggcggcguggguauaccugggggggucgugggagcagggcccgcugccgcggcugcugccgcaaaagcagccgcuaaagccgcacaauuuggacuggugggugcugccggacugggagguuuaggagucggcggccucggggugccagggguaggaggauuaggaggaauucccccagccgcagcagcgaaggcugcaaaguauggagcagccgggcugggaggugugcucgggggggcuggacaauuuccgcuaggcgggguggcagcaaggccaggauuuggccuguccccgaucuuccccgguggugcaugucuggguaaagcaugcggacgcaaacgaaaauag

SEQ ID NO: 5412 - RNA, 2274 nt, Artificial Sequence
  Description of Artificial Sequence: Synthetic coding sequence
auggcuggcuuaaccgcugccgcucccaggccaggcguguugcugcuccucuuaagcauccugcaucccuccagaccagguggcguucccggcgccauacccgguggcguuccaggcggagucuucuaccccggggcggggcucggagcgcugggcggcggggcucucgguccagguggaaaaccccucaaaccagugccaggcggccuggcgggagccggucucggagcugggcuuggcgccuuuccagcagucacuuuucccggugcucuggugccuggggguguugccgacgcugcagcggcuuauaaggccgcgaaagcuggggcaggacucgguggcguuccaggcguuggcggauuagggguuagugccggagccgugguuccucagcccggcgccggagugaagccagguaaggugccuggagucggacucccugguguauauccaggaggcguccugccuggugccagguuuccgggagugggcguccugccaggugugccaacuggcgccggaguaaaaccuaaagcacccggagugggaggugcguuugcugggauuccaggagucggcccuuucggcggaccucagccaggcguaccucucggcuauccuauuaaggcccccaaacugccaggagguuauggucugcccuacacuaccgggaaauugcccuacggguauggcccagggggcguggcaggagcagccgggaaagcaggauacccaacggggacaggcguggguccccaagccgccgcagcagcagcagccaaggccgccgccaaauucggagccggugccgcuggaguucucccgggggugggaggagccggggugccaggggugcccggagcgaucccgggaaucgguggcauugccggagugggaacacccgcagcagccgcugccgcugcugccgccgcaaaagcagcuaaguauggcgccgcagcuggucucgucccuggcggcccugguuucggacccgguguugugggcgugccuggggccggagucccgggaguagggguaccgggagcaggcauucccguggucccaggagcaggaauucccggagcagcagugccuggcguggucuccccagaagcagcggcgaaggccgccgcuaaagcugcaaaauacggggcuagaccaggcguugggguggggggcaucccuacuuauggcguuggagcgggcgguuucccaggguucggcgugggcguaggcgguauuccuggcguggccggcguaccaggagucggcggagucccgggcgugggaggcguuccgggcgugggcaucucaccagaagcgcaggccgccgcugcagcuaaagccgcuaaguacggggucggaacuccagcggccgccgccgcuaaggccgccgcaaaagccgcucaguucggacugguuccuggcguuggaguggcaccaggaguaggcguugcaccaggagugggcguugcaccuggggugggccuggcccccggcguuggcguggcaccaggcgucggaguugcgcccggagugggaguugcgccuggcaucgguccuggaggaguggccgccgcugcgaaaucagcugccaaaguugcagcaaaagcucaguuacgugcugccgcaggccugggcgcggggauucccggauuaggcguuggcgugggcgucccagguuuaggagugggcgccgggguuccuggccugggaguuggagccggaguaccugguuuuggcgccggugcugaugagggagucaggcgaucccuaucucccgagcugcgagaaggcgacccuaguucuucucaacaccugccuaguacaccgagcucgccacgcgugcccggcgcucuggccgcagcaaaagccgcaaaauacggcgcagccgucccaggaguacucgguggucugggggcacucggggguguagggaucccaggcggagucgugggcgccgguccugccgcggcggccgccgcugcaaaagcugcugcgaaagcagcucaauucggccuaguuggugcagcagggcuuggcggucuugggguggguggauugggcgugccuggcguuggcggucuugguggcaucccaccagcagcugccgcgaaggcugccaaauacggagccgccgggcuuggaggagugcuggggggagcaggacaguuuccucugggaggagucgcagcacgccccggauucgggcucucuccaauuuucccgggcggcgcuugccucgguaaagcauguggacguaaaaggaaauag

SEQ ID NO: 5413 - RNA, 2136 nt, Artificial Sequence
  Description of Artificial Sequence: Synthetic coding sequence
auggcagggcugaccgcagcagccccuaggccaggcguuuuacuucugcugcucucuauucugcauccuucgcggcccggcggcgugccaggggcuauuccugguggcguaccaggcgguguguucuacccuggagccggccuaggugcuuugggcggaggcgcacuaggucccggcggaaaaccauugaagccagugccuggcggguuagcgggcgccggccucggugcgggccugggagcauuccccgccguuaccuucccuggggcuuugguucccggaggcgucgcagaugccgccgcugcuuauaaagcagccaaagcuggcgccgguuugggaggcguucccggagugggcggucugggagucagugcggcaccaagcgugccuggggccgucgucccucaaccuggcgcggggguuaaaccggggaaggugccuggaguaggauugccaggugucuauccaggagggguacuacccggagcccgguuucccggaguggggguucugccuggcgugccaaccggugcuggcgucaaaccaaaagcaccuggaguggggggggcuuucgcaggaauaccagggguuggcccguuugguggcccccagccuggaguaccgcuaggauacccgauuaaagccccgaagcugcccgggggauacggccucccuuacaccacuggcaaacucccauaugguuaugguccagguggcgucgccggagcugcugguaaagcaggcuaccccacuggaacgggcguagggccucaagccgcugccgcugcggcugcaaaagcagcagcaaaguuuggagcuggcgccgcuggugugcuccccggggugggcggagcuggagugccuggagucccuggggcaauccccgguaucggaggaauugcuggggucggcacaccugcugcagcagccgccgcugcagccgcagccaaggccgcaaaauacggugcagcugccgguuugguuccagggggcccaggauuuggaccuggagucgugggugugccaggagcgggcgugccaggagugggagucccuggcgcugguaucccuguggugccuggggccggaaucccgggagccgccguuccagguguuguuaguccagaggcugccgccaaagcugcagccaaagccgcuaaauacggggccaggccaggugugggagugggaggcaucccuacguacggcgugggugcugguggguucccaggauuuggcgucggagucggaggaauuccuggcguggccgguguucccggagugggggguguucccgggguagggggcgugccggguguagguaucaguccggaggcucaggccgccgcugcugcaaaagcugcgaaguacggugucggaaccccggccgccgcagcugcaaaggccgccgcgaaggcagcucaguucggucucgugcccggcguagggguagcaccugguguuggaguggccccaggcguaggaguggcuccaggggugggauuagcuccuggagucggcguggcgcccggagugggaguugcccccggugugggcguggcaccagggauuggcccaggagggguugccgcugccgccaaauccgccgccaaagucgcugccaaagcucagcucagggccgccgcuggccugggcgcugggauucccggucugggaguuggagucggggugccagggcucggaguuggugccggaguuccaggacugggcgugggagcaggcguccccggauucggugcagugccaggcgcuuuagccgcagcuaaggcagcaaaguauggagcagccguucccggagucuuaggugggcuaggcgcacugggaggcguaggcauuccuggcggagucguuggagcugggccugccgcagccgcugcggcugccaaggcagcugcaaaggcggcucaguuuggccuaguaggugcugccggauugggcgguuugggaguggguggccugggaguucccggaguugguggguuagguggcauucccccagccgcagcugcuaaagcagcaaaguacggaguggcugcuagaccuggguucggcuuaagcccuauuuuuccuggaggcgccuguuuagguaaggcuugcggcagaaaacggaaauag

SEQ ID NO: 5414 - RNA, 2379 nt, Artificial Sequence
  Description of Artificial Sequence: Synthetic coding sequence
auggcgggccucacugcagccgcucccaggcccgguguguugcuccugcuccuauccauuuuacauccgucaagacccgggggggucccgggcgcaauuccaggcgggguccccggaggcgucuucuaucccggagcaggccugggcgcauuggggggcggugcccuuggaccaggagggaagccccugaaacccguucccggcggacucgccggugccgggcucggagcaggucugggggcauucccagccgugacuuucccuggagccuuaguaccuggugggguggcggaugccgcagcugcauauaaagcagcuaaggccggugcaggacuuggaggaguaccgggcgugggaggucugggcgugucagccggagcuguagugccccaaccaggcgccggggucaagccaggcaaggugccaggagugggccugccagggguguauccggguggcguacucccaggagcccgcuuuccaggcgugggagugcugccgggggugccuacuggagcuggaguuaagcccaaagcccccgggguggguggugcauucgcagggauaccaggcgugggucccuucggggggccucaaccaggaguuccucuuggguauccuauuaaagcuccaaaacuuccggggggguauggccuucccuacacaacuggaaaauuaccuuacgguuacggcccaggaggcguggcaggcgcugccgggaaggcgggauaucccacagguacaggcguugguccucaggcagccgcugcagccgcagcuaaagcggcugccaaauuuggcgcuggagccgcaggcguacugccuggcguggguggugcaggagugccugguguaccuggggcaaucccgggcaucggaggcauugcagggguugguacuccugcugccgcagcagccgcugcugcagcagccaaagccgcuaaauauggagcugcagcggggcucguuccugggggcccuggcuuugggcccgguguugucggaguaccuggagcgggugugcccgggguugguguuccaggcgcugggauaccgguagugccaggagcgggaauucccggagcugccgucccggggguggugaguccugaagccgcugcuaaggccgcugcaaaagcagcaaaauacggcgccagacccggagugggggugggagguauaccuacauacgguguaggcgcaggcgguuuucccggauuuggcgugggugugggcggaauuccugggguggcuggcguaccugguguagggggggugccgggcguuggaggagugcccggaguuggaaucucuccugaagcacaggcugccgcugcagcaaaagccgccaaguacggagccgcuggcgcagguguccugggaggccuggugccuggagcgccuggcgcagugcccgggguccccggcaccggaggggugccagggguugggacgccggcagccgcagcugccaaagcugcagcuaaagcagcccaguucgcccugcuuaacuuagcuggccugguucccggcgucggagucgcaccaggagugggcgucgcgcccgggguaggaguggcaccagguguagggcuggcuccgggggugggaguugcaccgggagugggaguugcaccaggcguggguguagccccuggaaucgggcccgguggugucgcugccgcugccaaauccgcugccaaagucgcugccaaggcccagcuuagggcugcugcuggacuaggcgcugggauaccuggucuugggguaggugugggaguaccugggcucggagucggagcuggcguaccggggcugggugugggggcuggagucccaggauucggagcaggcgccgaugaagguguuaggaggucauuguccccagagcuuagagaaggugaccccuccagcucacaacaucucccaucuacucccaguucuccacgcguucccggagcauuggcugcagccaaggccgccaaguacggggcggcagugccugguguguuagggggccucggagcauuggguggagucggcaucccuggaggggucguaggagcugggccugcugccgccgcugccgcugcuaaagcagccgccaaggcugcccaauuuggauugguuggugcggcaggacugggaggcuugggugucggagguuugggagugccuggcgugggcggacuggguggcaucccuccugcugcagccgcuaaagcugccaaguacggugcugccggucuuggaggcguacuugguggagccggccaguuucccuugggaggcgucgcagcaaggcccggcuuuggacugucccccauuuuuccagguggcgcuugccuggggaaggcuugcgguagaaagaggaaguag

SEQ ID NO: 5415 - RNA, 2034 nt, Artificial Sequence
  Description of Artificial Sequence: Synthetic coding sequence
auggcugguuugacugccgccgccccaagaccagguguccuccugcuguuacuaucuaucuuacacccuucaagaccaggcggcguccccggggccauccccggaggcguucccggcggcguauucuaccccgcacucgggccgggagguaaaccacuuaagcccgucccaggcgguuuagccggggccggacucggggccgggcuaggggcauuucccgcggugacauucccaggugcccucguacccgguggaguggcugacgccgcugcagccuauaaagccgcaaaggcuggcgcuggauuaggaggcgucccaggugugggcggguuaggcgugucagcuggagccguaguuccccagccaggggcuggagucaagccaggaaaggugcccggggugggacugccugggguguauccuggcggcgugcuuccuggggccagauucccaggggugggggugcugcccgggguacccacaggcgcaggaguaaaaccaaaagcaccaggaguugggggugcauucgcuggaauucccggggucggaccuuucggggggccucagccuggagugccccugggcuacccgauaaaggcuccuaaacugccugguggauacggguuacccuacacaacugguaagcuaccauacggauaugguccagguggcgucgccggugcugcugggaaggcggguuacccaaccgggacaggcguugguccucaggcggcagccgccgcggcggccaaggcugcugcaaaguucggggcaggggccgcuggcguccuuccaggaguggggggggcugguguuccgggcguuccuggcgcuaucccagguauaggaggcauugccggugugggaaccccugccgcagccgcagcggccgccgcagcugccaaagcugcaaaauauggagcagccgccggucuggugccaggcggcccuggauuugggccaggaguuguuggaguuccuggcgcuggaguaccaggaguaggcgugcccggagccgggauuccaguggugcccggcgcaggcauaccgggugcagccgucccuggcguggugagcccagaggcugccgcaaaggcugccgcuaaagcagcuaaguacggagcuagaccuggugucggggugggaggcaucccuaccuacggagugggcgcaggugguuuccccggauucggagucggugugggggguaucccagggguggcagggguuccagggguuggcggggugccagggguuggcggggucccuggcguggguauaagcccugaagcgcaagccgcugccgcugcaaaagcagcaaaguauggauuggugccaggaguuggcguggcucccggcgucggcguagcacccggaguggguguggcccccggcgugggauuagcuccaggagucggagucgccccggggguggggguugcuccuggcguaggaguggccccgggaauugggccaggaggagucgcagcagccgccaagucggccgcgaaagucgcugcuaaagcccaacugagagcagcagccggcuugggagcagggauaccgggucugggaguugggguuggcgucccuggguugggcgugggagcuggugugcccggcuugggcgugggagcaggagugccgggcuuuggagcgguuccaggggcccuggccgccgcuaaggccgcuaaauauggcgcagcugucccuggagugcuuggcggcuuaggggcucuuggaggaguggggauucccgguggggucguaggggcagggccagccgccgcggcagccgcugcaaaggcugcugcgaaggccgcucaauuuggacucguuggugcugcgggguugggaggacugggcgugggaggucucggaguuccaggaguuggaggcuuaggcgguauaccucccgcggcugccgcuaaagcagcgaaguacgguguugccgcgaggcccggauucgggcucagcccgaucuucccuggaggcgcgugccuuggaaaggccuguggccggaaaagaaaguag

SEQ ID NO: 5416 - RNA, 2118 nt, Artificial Sequence
  Description of Artificial Sequence: Synthetic coding sequence
auggccggucuuacggcugcugcaccucgcccaggugugcuucuuuugcugcucucuauucugcauccuucucgcccaggcggugucccuggugccaucccgggaggaguacccggcgguguguuuuauccuggagcgggacuaggugccuuaggugggggggcccuuggaccaggggggaagccucugaagccugugccagggggacuggccggcgccggacugggcgcuggauuaggcgccuuucccgcaguaacuuucccaggagcauuggugcccggcggcguugccgacgcugcugcugccuacaaagcugccaaagcaggagcaggucucggcggagugcccgggguuggagggcugggggugagugcuggagccgucgugccucagccuggggcuggcgugaagccagguaaaguucccggagugggguugccaggaguguauccaggcggagugcugccaggugcacgauuuccgggcgugggggugcugccaggggugccuacuggugcuggagugaaaccgaaggccccaggagucgguggggcguuugcgggaauuccuggagugggucccuucggggguccccagccaggagugccuuugggauaccccauuaaagcaccuaagcuacccggaggguaugggcuuccuuauaccaccgguaagcuuccuuaugguuacggaccggggggcgucgcgggagccgcuggcaaggcaggguauccaacaggaacaggcgugggaccucaggccgccgccgcagccgcugcaaaagcugcagccaaauuuggugccggagcagccgguguguugccugggguaggaggcgcgggagugccaggcgugcccggcgccauuccaggaauaggaggaaucgcgggggucgguacccccgcggcagcugcugccgcugcugccgcggcuaaagcagcuaaguauggggcagccgcugggcucgucccggguggcccagguuucggccccggcgugguaggaguuccaggggccggcgugccaggugugggcguucccggggccggaauccccgucgugcccggagcaggaauccccggcgcagccguuccagggguggucucucccgaagccgccgcuaaggccgccgcuaaggccgcuaaauauggugcuagaccaggggugggggugggcggaauuccuaccuauggagugggagccggaggguuuccaggauucggcguuggagugggagggauuccaggaguugcuggggugccaggcgugggcggagucccagguguaggcggggucccgggagucgguaucucaccugaggcacaggcagccgccgcagcaaaggcugcgaaguacgggcucgugccaggcguuggagucgccccggguguuggcguggcaccaggagugggaguugcuccaggugugggacucgcaccaggaguagggguagcaccuggggucgguguggcaccaggagugggcguagccccagguaucggaccuggaggcguagccgcagccgccaagagcgcagccaagguggccgcaaaagcccaacugagggcugccgccgggcuaggagcuggaaucccaggauuagggguuggcguugguguaccaggacucggggucggagccggcguuccuggauugggcguaggugccggggugcccggauuuggugcugugccuggagccuuggcggcggcuaaagcagccaaguacggcgcugcuguccccgguguucuggggggacuuggagcccugggggguguggggauucccgggggcguaguuggagcaggcccugcagcugcugccgcggcggccaaagcagcggcaaaggcugcacaguuuggacuagugggugcugcaggacuggguggauuaggcgucgggggccucggcgugccaggagugggggggcucggcgguauuccccccgcagccgcggcaaaagcugcaaaguauggcgcagcgggccucggagguguacugggaggagccggccaauuuccucugggagggguugcggccagacccggauuuggacucuccccuauuuuccccgggggcgcuugucugggaaaagccugcgggagaaagcgcaaauag

SEQ ID NO: 5417 - RNA, 645 nt, Artificial Sequence
  Description of Artificial Sequence: Synthetic coding sequence
auggccgggcugacagcagcagcuccgcgccccggcguauugcuauuguuacugucaauucuccacccuagccggccuggcggcgugccuggcgccauuccuggaggagugccugguggcguauucuacccgggggcuggacucggcgcucuaggugggggggccuuaggaccaggcggaaaaccucucaaaccagugccaggaggcuuggcaggagccggacugggggccggucucggcgcuuuuccagcugucacauuccccggagcccucguacccggcggcguggccgacgcugcagcugcguacaaagccgcuaaagcuggugcuggccugggaggcguuccgggcgugggcgggcucggagugagcgcaggugcuguagugccacagccaggugcaggcguaaaaccugggaaggugccgggcgugggccuccccggcguguauccaggcggcguuuugcccggcguuggcccguuugggggaccacagcccggcguaccacugggguaccccauuaaagcuccuaaguugccagguggcuauggccuccccuauacgacgggaaaguugcccuauggauauggacccggcggcguugcuggcgcugcuggaaaggccgguuauccgacagguaccuag

SEQ ID NO: 5418 - RNA, 504 nt, Artificial Sequence
  Description of Artificial Sequence: Synthetic coding sequence
auggccggauuaacugccgccgcuccccggccuggcguucugcuccuuuuacugucuauccugcaccccagcaggcccggaggaguaccaggggcaaucccuggcggcguuccaggggggguuuuuuacccuggcgcaggucuuggggcacucgggggcggagcacucggacccggcgguaagccucuaaaaccaguaccaggcggucucgccggcgccggucugggggcaggacucggcgccuucccagcuguaacauucccuggggcccucgucccuggcgggguugccgacgcugcugcagcauacaaagcagcaaaggcaggugucgggccauuuggaggaccucaaccuggagucccccuggguuauccuauaaaggcaccuaaauugccaggcgguuacggcuugccauauacaaccgguaaguuaccauauggguacggaccaggcggcgucgccggagcagccgggaaggcuggauacccaacugguacuggguag

SEQ ID NO: 5419 - RNA, 2079 nt, Artificial Sequence
  Description of Artificial Sequence: Synthetic coding sequence
auggccggguuaacugccgcggccccucgcccuggggugcuguuacuguuguuauccauucugcacccgucucgccccgguggcgugccaggcgcaaucccuggcggcgugcccgguggugucuuuuauccgggcgccggacuuggcgccuuagguggaggagcucuuggcccagguggcaaaccucuaaaacccguaccaggugggcuggcuggagcuggccuuggcgcaggacugggugccuucccugccguaaccuuccccggcgcuuugguuccuggcggcguggcugaugccgcagcggcguauaaggcugccaaagcuggagccggucuagggggcgugccugguguggggggacugggcguguccgcugcccccucagugccaggggcagucgugccucagccuggugcagggguaaagcccgguaaagugccaggcgugggauugccaggaguguaccccggaggugugcugccuggcgcuagauuuccaggagugggggugcucccaggggugccuacaggagcgggagucaagcccaaagcucccggaguugguggggcauuugcaggaauuccaggcgucgggccuuuuggagguccucagccgggagucccucucgguuauccuauuaaagcuccaaagcuucccgggggauauggucucccuuauaccaccggcaagcuccccuauggauacgggccuggaggcguggccggagcggccggcaaagcaggcuacccgacaggaaccggugugggaccacaggccgcagcugcugcugccgccaaagccgccgccaaguucggugcuggcgcugcuggcguucugccuggagucggcggcgcggguguccccggugugccaggcgcuauacccgguaucggaggcaucgcgggcgugggaacaccagccgccgcugcugcugcugcugcagccgcuaaagccgccaaauacggagcugccgccggccucgugccaggaggcccuggcuucggcccuggggugguuggggugccgggcgccggaguucccggggucggcgugccuggcgcuggaauccccgucgugccuggugccggcaucccuggagcugcuguuccagggguagugucuccagaagcugcugcuaaagccgcugcuaaagccgccaaauauggagcuagaccaggcgucggagugggagggauaccuacuuaugguguuggcgccggaggcuuuccaggauuuggcgugggaguaggcgggaucccagguguugcggguguuccugguguaggcggaguuccagggguggggggggugcccggagucggaauuucuccggaagcccaagcugcugccgccgccaaggcugccaaauacggacuggucccaggagugggggucgcuccagggguggggguggccccuggcgugggaguggcgccaggcguuggccuugcccccgggguaggagucgcaccagggguagggguugcuccuggaguggggguggcccccggcauaggcccugguggaguagcagcagcggcgaaauccgccgcaaaaguugccgcaaaagcacaguugcgcgcagcagccggucuaggcgcagguaucccaggacugggugugggcguaggcgugccuggacuaggugugggagcaggcguaccaggacugggugugggugcaggcgucccuggauuuggugccgugcccggagcccuugccgcugccaaagcugcgaaguauggggccgcuguuccugguguacugggagggcugggagcguugggggggguggggaucccagguggaguggugggcgcuggucccgccgcagccgcagcagcugccaaagcagccgcaaaggccgcucaauuuggccuagugggagccgcuggacugggaggacuggguguggggggacugggcgugccaggaguuggagggcucgggggcaucccuccugcagccgcugccaaggcagcuaaguacgggguggccgccagaccuggcuuugguuuaucaccgauuuucccggggggugcgugucuaggcaaagcgugcggacggaagagaaaguag

SEQ ID NO: 5420 - RNA, 507 nt, Artificial Sequence
  Description of Artificial Sequence: Synthetic coding sequence
auggcaggccugaccgccgcagcaccucguccuggcguguuguuguuacuucuguccauucuccauccaucucgaccaggagggguaccuggggcuauccccggagggguuccuggaggaguuuuuuaccccggagccggauuaggggcucugggcgggggagcccuggggccaggcggaaagccucugaagcccggcguggguccauuuggcggaccucagcccggaguuccgcugggauacccuauuaaggcaccuaaacuucccgguuacggcccugguggggucgccggggcugcagggaaagcuggcuauccaacugggacuggcguggguccccaggccgcugccgcugccgccgcaaaagcagcagccaaguuuggggcaggcgcugcaggaguguugccaggcguuggaggggcaggagugccuggcgucccgggcgcuauaccuggaauaggcggcaucgcuggcgucgguacgccugcagcugcagcugcggcauag

SEQ ID NO: 5421 - RNA, 885 nt, Artificial Sequence
  Description of Artificial Sequence: Synthetic coding sequence
auggccggccuuacagccgcagcaccucgaccgggggucuugcuucugcuguugucaauucuucauccaucgcguccuggcggcgugccuggcgcgaucccaggcgguguucccggcgguguguuuuauccaggcgcaggucugggagcauuggggggcggagcacugggcccggguggaaagccccucaagccaggucugggcgcuuucccugcagugacuuuccccggcgcucuggugcccggagggguugccgaugcggcagccgcauacaaagccgccaaagcuggagcaggacuggggggcgucccggggguggguggacucggagucagugcuggugcuguagugccucagccuggagcuggggugaagccuggaaaagucccagguguaggucugcccggcguguacccagguggcguauuaccuggagcucgcuuuccgggaguggguguacucccugggguucccaccggggccggcguaaaaccuaaagcuccuggcgucggaccauucggaggcccucagcccggaguuccccuggguuauccaauaaaggccccuaagcugccagguggcuacggucuuccauauacaacaggcaagcuuccuuauggauacggacccggcgggguggccggugcggccgggaaggcggguuacccuaccggcacuggagugggaccccaagcggcggccgccgcugcagccaaagcagcagcuaaauuuggggcaggggccgcgggggugcucccaggugugggaggggcuggagugccagggguaccaggggcuauccccgggaucggaggcauugcaggcguggguacaccugcggcagcagccgcagccgcagcugccgcaaaagccgcuaaguauuag

SEQ ID NO: 5422 - RNA, 531 nt, Artificial Sequence
  Description of Artificial Sequence: Synthetic coding sequence
auggcaggucugacugcugcugcuccacgccccggagugcugcuccucuugcucaguauucugcacccaucuagacccggaggcguaccaggcgcgauaccaggaggagugccgggaggagucuuuuacccgggagcaggcuuaggggccuuaggagguggugcauuggggccagguggaaagccuuugaagccagugcccggcggacuggcuggugcugggcucggcgcuggucuaggggccuuuccagcggugaccuuuccgggggccuugguuccgggcgguguagcugacgccgccgcagccuacaaggcggcuaaagcuggggccggacucggcggcgucccaggcgugggaggccuuggaguuuccgcaggagccguagucccucaaccgggcgcgggcguaaagcccgguaagguccccgguguugguggugcauucgcaggaaucccaggaguuggcccuuucggaggaccacaacccggcguuccacugggauacccuauuaaagccccuaaauugccauag

SEQ ID NO: 5423 - RNA, 1992 nt, Artificial Sequence
  Description of Artificial Sequence: Synthetic coding sequence
auggcaggacugacagcagcagcaccaagacccggugugcuucugcuacuucugaguauccugcauccauccagaccuggaggcgucccaggggcaauacccgggggagugccugguggagucuucuacccaggcgcgggauuaggggcacugggcggcggugcguuggggcccggagguaagccguuaaaacccguuccaggcggacuggccggggccggguuaggugccggugcagggcuaggcgguguucccggcguggguggucucggcgugucugcuggggccguggucccccagccaggcgcuggugucaagccaggcaaaguccccggcgucggucuccccgguguguacccaggaggcgugcugccuggcgcuagauuuccuggcgucggcgugcuccccggagugccaacaggugcuggagucaagcccaaagcccccggcguuggaggcgccuucgcagggauacccggaguagguccuuucggaggcccccaaccaggaguuccucucggauacccuauuaaggcccccaaacuuccuggaggguacggccugcccuauacaacaggcaagcugccuuacggcuacggccccggaggaguugcuggcgccgcaggaaaggcuggauauccgaccgguacuggaguggguccacaggccgccgcggccgcagccgccaaggccgccgcaaaguuuggagcaggcgccgccgguguccuuccaggggugggaggcgcaggaguuccgggggugccuggcgcaauacccggcaucggagggaucgcuggggugggcaccccugcagccgcagcugcagccgccgccgccgccaaggccgcuaaauauggugcggcagcaggacuggucccgggaggccccggcuuugggcccggcguggugggugugcccggugccggagugcccgggguuggcguuccuggggcugggauccccgugguucccggugcuggcauuccaggcgcagcuguuccaggaguuguaucuccugaggcagccgccaaggcugcugcaaaagcggcgaaguauggggcuagaccgggcguaggugugggcggaaucccuacauacgggguuggagcugguggguuccccggauuuggggugggcguggggggaauuccaggcguggcaggaguuccaggaguugguggcgugcccgggguuggcggcguaccaggaguaggaaucucaccugaagcucaagccgcugcagcugcgaaggccgcuaaauacggggucggcacccccgccgcugcagccgcgaaggcagcagccaaggccgcucaguuuggcuuaguccccgguguugggguggcacccggagucggcguugcgcccggcauaggcccugguggagucgcugccgccgcuaagagcgcugcuaaaguugcggccaaagcacagcuccgcgcugcugcgggucugggagcuggcauuccaggccucgggguuggcguggguguucccggccuaggagugggggcuggggugccaggacucgggguuggugccggagugccagguuuuggggcaguuccuggcgcacuugcugccgcuaaggccgcgaaguauggagcagcaguucccgggguucuagggggacugggcgccuuaggcgggguggggauuccagguggaguggugggggcggguccugccgccgcugcagcagcggccaaggccgccgcgaaggcagcacaguucgggcuggucggcgccgcugggcucggagggcugggcgucggagguuugggcgugcccgggguggguggucucggcggaauuccaccagcggcggcagcuaaggcugcaaaguacggagcugcugggcuuggcggcgucuugggcggggcuggccaguuuccucucggcgggguagcagcacgcccuggcuuuggacucucuccuaucuuucccggaggugcaugucuggguaaagccugcgguagaaaaaggaaguag

SEQ ID NO: 5424 - RNA, 2121 nt, Artificial Sequence
  Description of Artificial Sequence: Synthetic coding sequence
auggcgggccugacagccgcugcuccccggccugggguccucuuacuucugcugagcauucuccacccuuccaggccuggcggugucccaggugcaaucccaggugguguaccaggcggcguguucuacccaggggcuggacugggcgcuuuagggggcggggcuuuaggccccgggggaaaacccuugaaaccaguccccgguggccuugcaggagccggacucggcgcaggucugggugcauucccugcugugacauucccuggcgcauuagugccuggaggcguagcugaugccgcugcagccuauaaggcagccaaggccggugccggccugggcggugugcccgggguggguggauuaggcgucagugcaggagcaguugugccacaaccaggcgcaggcguuaagccugguaaaguaccuggggugggacuuccuggcguauacccagggggagugcugccuggggccagauuucccggggugggcgucuugccuggaguuccgacgggugcaggagucaaacccaaagcaccaggcgugggcggugcguucgcuggcaucccaggcgugggcccuuucggcggcccucaacccggggucccucugggauauccuaucaaggcaccaaaacugccaggagguuacggguuacccuauaccacuggcaagcugcccuauggauauggacccggaggagucgcaggcgcggcagggaaggccggauauccuacaggcaccggagucgggccacaggccgcggcggcagcugccgcaaaagccgcugcaaaauucggggcgggagcagcuggcguguugccgggaguugggggcgcuggcgugcccgguguaccaggagcuaucccaggaaucgggggaauugcgggcgugggaacccccgcagcugcagccgccgcagccgccgccgcgaaagcugccaaguauggcgcagcagcgggacuggucccuggcgggccaggguucgggccuggcguggugggcguaccaggcgcuggcgucccaggagucggagucccaggugcuggaauacccgugguucccggagccgguaucccuggugccgcugugcccggcgugguaucuccggaggccgcagccaaagcugcagccaaggccgcaaaauacggggcgagaccaggugugggggucgguggaauaccuacauaugggguaggugccgguggcuucccaggguucggagucgggguagggggaaucccaggagucgccggugugccuggagugggaggcgugccuggggugggcggcguacccggggucggaaucagcccagaagcucaggccgcagcagccgcuaaagcagcuaaguacggagugggcaccccugccgccgcagccgcaaaggcagcagcgaaagcggcccaauuuggacugguccccgguguagggguggcgccugguguggguguagcuccggggguaggaguggcgcccggaguaggauuagcuccagggguggguguggccccuggagugggcguggcuccuggcgugggcguggccccuggaauuggaccuggaggcguugccgccgccgcaaaaagugcagcaaaaguugccgccaaagcucagcuccgagcugcugcaggacugggcgcuggcaucccggggcuggguguugguguggggguaccugggcuggguguaggagcaggcgugccuggacucggaguuggcgcagguguuccaggguuuggcgcaguaccuggagcucuagccgccgcuaaagccgccaaauauggagccgccguucccgguguucugggcggccuaggggcacugggcgggguaggaauuccgggcggaguuguuggagcugggcccgccgccgcagcagccgcagcuaaagccgcagcgaaagcugcucaguuuggucucguaggggcagcaggguugggaggacugggagucgggggccuaggaguucccggggugggaggcuuaggggggauaccccccgcagcagcagccaaagcagcuaaguacggagucgcugcucgaccggguuuuggccugagcccaaucuuuccagggggggcgugucugggcaaggcuugugggaggaagaggaaguag

SEQ ID NO: 5425 - RNA, 2145 nt, Artificial Sequence
  Description of Artificial Sequence: Synthetic coding sequence
auggccggccucacugcagccgcuccuagaccugguguacuguuacugcuguugagcauccuucacccgagcaggcccggaggcguaccuggggcaaucccuggcggaguuccugggggaguguucuacccugcgcucgguccuggagggaagccuuuaaaaccagugcccggaggacuggccggggcaggauuaggagcuggucugggcgcuuuuccugcuguaacuuucccuggagcguugguccccggggguguugccgaugcugccgcagcuuacaaagccgcaaaggccggugcuggacuuggcgguguuccgggcguuggaggccuuggaguuagcgcuggugcaguggucccccagccuggagccggagugaagccgggcaagguccccggcgugggccucccgggcguauauccuggcggcguacugccaggugcgagguuccccggcgugggcgucuugccaggaguccccacaggagccggcguuaaaccaaaggcgcccggaguugggggagccuuugcugggauaccaggggucggaccauucgguggaccacagccaggaguuccccuaggcuauccuaucaaagcuccgaagcuccccggcggguacggccugccauacacaaccgggaagcucccuuacggcuacgguccuggcggggucgcuggcgcugcgggaaaggcaggauacccuacaggcacggguguggguccacaggccgccgcugccgccgccgcaaaagccgccgccaaauucggcgcuggcgcagccggaguuuuaccaggugugggaggcgccggggucccuggcguaccaggagcgauacccggcauaggaggcauugcaggagugggcacacccgcagcggcagcugcagcugcggccgcagcaaaggccgcuaaauacggugcagcugccggcuugguuccaggaggaccagguuuuggaccagguguggugggcgugccaggcgcuggagucccuggaguuggagucccaggcgcaggcauacccgugguccccggugccggaauccccggggccgcugugccugguguagugaguccagaggccgcugcaaaagcagcagcuaaagccgcaaaauauggcgccaggccugggguaggcguggguggcaucccaacguacggagucggugcuggaggguuccccggcuuuggggugggcgugggugguauaccaggcguagccgggguuccaggagugggggguguuccuggggugggcggggugccaggcguuggaauuagucccgaggcccaggcagcagcugcagcaaaagccgcuaaguacgguguagggacucccgcagcagccgcagccaaggcagccgcaaaagcugcucaguuuggacucgugccagggguggggguggcgcccggagucggcguggcaccggggguagguguggcucccggagucgguuuggccccgggaguuggaguggcuccugggguaggugucgcuccaggagugggagucgccccggggaucggcccugggggcguggcagccgcagcaaagucagccgccaaagucgccgccaaggcacagcucagggccgcugccgguuugggagcaggaaucccaggauuagggguuggcgucggggucccgggccugggcguaggcgcaggaguacccggucuagggguuggcgcuggugugccagguuuuggagcugugccuggagcgcuugccgcugccaaagccgcuaaguacggggccgcaguuccuggugugcucggaggacuaggagcuuuaggaggcgugggaauuccaggcggcguagugggggccggaccugcggcggcugcagccgcugccaaggccgcagccaaggcugcucaguucggcuuggucggagcugccggguugggugggcugggagugggaggacugggggugcccgggguaggaggacuugggggaauaccucccgccgcugcagccaaagccgccaaguacggcgcugcuggucuuggaggaguucuuggaggcgcaggacaguuuccccucggagggguggcugcuagaccugguuucggauuaagucccauuuucccugggggugcauguuuagggaaggcuugugggagaaaacgcaaauag

SEQ ID NO: 5426 - RNA, 651 nt, Artificial Sequence
  Description of Artificial Sequence: Synthetic coding sequence
augggcgcugcgcgucuccucccaaaucugacacucugucuucaauuacucauccucugcugccaaacacagggcgaaaaccacccuucucccaacuucaaccaguaugucagagaccaaggugcaaugacugaucaacugucucgccggcagauucgcgaguaccaacucuauagccggacauccgggaagcauguccaggucaccggacgacggauuucugccaccgcagaggacggaaacaaguuugccaaacucauaguggaaaccgauaccuuugggucucgugugcgaaucaagggcgccgaaucagaaaaguacaucugcaugaacaaacgcgguaaacuaauugguaaaccaagugggaagucaaaggauugugucuucacagaaauaguacuggaaaacaacuacaccgcuuuccagaaugcacgccacgaaggcugguucauggcguucacucggcaaggacgaccccgccaggcuucuagaucacgccaaaaucaacgagaagcacacuucauuaagcgucuuuaccaaggccagcucccauucccgaaccacgcagaaaagcaaaagcaauucgaguuugugggauccgcgccaacaagaagaacuaagcggacucgacggccucaaccccugacauag

SEQ ID NO: 5427 - RNA, 618 nt, Artificial Sequence
  Description of Artificial Sequence: Synthetic coding sequence
augggcgcagcgagauuacuacccaaccugacuuuaugccugcaacugcucauucuuugcugucagacccaguacguuagggaccagggggcuaugaccgaccaguuaucgcgccgucagauucgcgaauaccaguuguacuccagaacuuccggaaaacacguccaggucacgggccgucggaucagugccacugcagaggaugggaacaaauuugcuaaacucauaguggaaacagauaccuucgguucacgcguccgcaucaagggagccgaauccgaaaaauacauuuguaugaauaagagaggaaaauugaucggcaagccuucuggaaagagcaaggacugugucuuuacggaaauaguacuggagaauaacuacaccgccuuucagaaugcacgucacgaggguugguucauggcguucacacgccagggcagaccacgccaagcauccaggagucgucaaaaucaaagggaggcccauuucauuaagagacuuuaucagggacagcuccccuuuccgaaucacgcagagaaacagaagcaguucgaauucgugggcagcgccccaacacgaagaacaaaaaggacccggaggccccaaccucucacguag

SEQ ID NO: 5428 - RNA, 390 nt, Artificial Sequence
  Description of Artificial Sequence: Synthetic coding sequence
augggagauccuguagugacagagacccccacucucuuaggcuuaccugagcaaagacgcgcugcuguucgccaugugaauaagggcgcagggauccuugagauuaggucagugcacguuggugugguggugauuaaggcagugaguucaggcuucuacgucgccaugaacaggagaggcagacuguacggcucacgccuauauaccguggauuguagauuccgggaaaggauugaggagaaugggcacaacaccuacgcaagucaaagauggaggagacgaggccagccuauguuucuggcucuugaccggcgaggcggaccucgaccaggggggcgcacacgucgcuaucauuuaucugcucauuuccuaccuguccuagucucauag

SEQ ID NO: 5429 - RNA, 621 nt, Artificial Sequence
  Description of Artificial Sequence: Synthetic coding sequence
augagcggaccaggcacagcggccguagcacugcuaccagccgucuuacucgcucugcuggcacccugggcuggaagaggaggcgcagccgccccgaccgcacccaauggcacuuuggaagcggagcuggagaggcgaugggagucccugguggcgcugucccuggcucgacugccgguugcugcacaaccaaaagaggcugcuguucagagcggggcaggagacuacuuacucggcaucaagaggcuaaggagguuguacugcaacgugggcauuggguuucauuugcaggccuuaccggauggacguauaggcggcgcgcacgcugacacuagagacagccuguuggagcugagccccguggaacgaggagugguguccaucuucggaguggcgagucgauuuuucguugcaaugaguucuaaaggaaaauuguacgggucaccuuucuuuacagaugaaugcaccuucaaagaaauucuucugccaaacaacuauaacgccuaugaaucuuacaaguauccagggauguucauagcccucagcaagaaugggaagacuaagaaagggaaucguguauccccuaccaugaaagucacacauuuccucccucggcuuuag

SEQ ID NO: 5430 - RNA, 723 nt, Artificial Sequence
  Description of Artificial Sequence: Synthetic coding sequence
augacuccccacaggcuucuaccuccucugcuccugcucuuggcgcugcugcuagccgcgaguccuggcggugcccuggcuaggugccccggcugcggacaaggagugcaggcuggaugucccggcggcuguguugaagaagaggacgguggaaguccagccgaaggcugugcugaagcugaaggaugucugagacgagaaggucaggaauguggggucuacacuccuaacugugcucccggccuacaaugccauccaccaaaagacgacgaggcaccacugcgcgcguuacucuugggcagaggaagaugccucccagcccgugccccagcaguagcggaggagaacccuaaagagaguaagccccaagccgggacugcccggccucaagacgugaaucggagagaucaacaacggaacccuggcaccaguaccaccccaucccaacccaauagugccgguguacaggacacggaaauggguccaugucgacgccaccuagacucaguucuccaacaacuccagacugagguuuaccgcggagcucagacucuguacgugcccaauugugaucaucgaggauuuuacaggaagcgccaaugccgguccucacaggggcaaagacguggaccaugcuggugugucgauagaauggggaagucucucccagguucuccagauggaaacgggagcucaucuuguccaaccggcucuagcggcuag

SEQ ID NO: 5431 - RNA, 411 nt, Artificial Sequence
  Description of Artificial Sequence: Synthetic coding sequence
augacuccacacagacucuugcccccacucuugcuguugcuugcacugcuccuggcugcgucacccgguggugcgcuggccagaugucccggauguggucagggaguccaagccggauguccugguggguguguugaggaagaagacgguggaaguccagcagaaggcugugcggaagccgaaggcugucuuagaagggagggacaggagugcggagucuauacgccaaacugugcaccaggccugcagugccacccucccaaagacgaugaagccccauugagagcucugcuacugggaaggggaagauguuugccagcccgugcccccgccguccuaaguucccccagaaccuuacgaaaacuguccccugagcccggagccacaugcagcuguaggggcgaaaguuag

SEQ ID NO: 5432 - RNA, 717 nt, Artificial Sequence
  Description of Artificial Sequence: Synthetic coding sequence
augaccccccauaggcugcucccacccuuguuacuccuacuugcauugcugcuggcugcuucuccagguggagcccucgcgagauguccuggaugcggacaaggcgugcaggcuggcuguccagguggaugcguugaagaggaagacggaggaaguccagcugaagggugcgccgaagcugaaggaugucuuaggagggagggacaggaguguggcguuuacacucccaacugcgcaccuggguugcaaugucacccuccuaaagaugaugaagcuccccugagagcauugcuucugggaagaggccggugccuacccgcaagagccccagcugaggaaaacccuaaagagucuaagccccaggccgguaccgcaagaccucaggacguaaaccggcgcgaucaacagcggaaucccgguacauccacuacaccgucucagccgaauagugcaggugugcaggauacagaaaugggcccuugccgacgacaucuggacuccguuuugcaacaacuacagacugaaguguaucguggugcccaaacacuuuaugugcccaauugcgaccaccgcggcuucuacagaaagaggcagugcagaucaucucaaggucagagacgcggaccuugcuggugcguggauagaauggggaaaucacuuccuggcaguccggauggaaacggaagcagcucuugucccacuggcucaaguggcuag

SEQ ID NO: 5433 - RNA, 837 nt, Artificial Sequence
  Description of Artificial Sequence: Synthetic coding sequence
augccaaggcuuagcuuacuccuaccacugcucuuacuucugcuguugccccuguugccuccucuaagccccagccuugggauucgcgacgugggaggucgccguccaaaauguggcccuugucgccccgaaggauguccagcacccgcuccuugcccugcgccuggaaucucugcccucgacgaaugugguuguugcgccagaugccugggcgccgaaggagccucgugcggaggacgcgcaggggguagaugcgggccgggcuuagugugcgccucucaggcagcuggcgccgcaccugagggcaccggacuguguguaugugcccagcgcggcacgguguguggcuccgacggacguucauaccccagcguaugugcucugagacuccgagcucgccacacaccccgggcacaucccggacaccugcauaaggcccgggacggacccugcgaguuugcuccuguuguagucguucccccccgcaguguucauaaugucacuggcgcacaggugggccuuucaugugagguuagagccguucccacccccguuaucaccuggcggaaaguuacuaaaucuccagaggguacgcaagcccuggaagagcugccaggcgaucacgugaauauagccguucaaguuaggggcggccccuccgaucacgaggcuacugcuuggauacucaucaacccauuaaggaaagaagacgaaggagucuaucagugccacgccgcgaacaugguaggcgaagcagagagccauucuacaguaaccgugcuggaccuuagcaaguaccggagcuuucauuucccggcccccgacgauagaauguag

SEQ ID NO: 5434 - RNA, 459 nt, Artificial Sequence
  Description of Artificial Sequence: Synthetic coding sequence
auguguucacucccuauggcccgauauuauauuucuuucuugccagaaccccugccugcaaagagucuccagcauggugugcccuugagccucgauuccucacucucaucuuugcuagaaaaaaucuguauccuuccaaaucgcggccucgccagaacaaaggucccuauauuucuuggcauacaaggcggcagucggugccuggcuugugucgaaaccgaggaggggcccaguuuacaguuggaggacguuaacaucgaggaauuauacaaagggggagaagaggccacccgauucaccuuuuuucagucgucauccgguagcgcuuuccgucuugaagccgcagcauggccagguugguuucugugcggcccagcugaaccccagcagccuguucagcuuacuaaagagagcgaaccuucagcgagaaccaaguucuacuucgagcaguccugguag

SEQ ID NO: 5435 - RNA, 459 nt, Artificial Sequence
  Description of Artificial Sequence: Synthetic coding sequence
augugcucccucccgauggccagauacuacaucauaaaguaugcugaccagaaagccuuauauacuagagauggacagcugcucguuggugauccaguggccgacaacugcugcgccgagaaaauaugcauauugccaaaccgaggcuuagcaagaacaaagguccccauuuucuuaggaauccaagggggaucacgaugccuugcauguguggagacagaggaaggaccaucacuacagcuggaggauguaaauauagaggagcucuacaaaggcggugaagaggcgacccguuuuacguuuuuccaauccucuucggguuccgcauuuagacuggaagcggcagcuuggccuggcugguuccucugcggaccggcagaaccccaacagcccguucaacucacuaaagaauccgaacccucggcuaggacgaaguucuauuucgaacaaucaugguag

SEQ ID NO: 5436 - RNA, 459 nt, Artificial Sequence
  Description of Artificial Sequence: Synthetic coding sequence
augugcagccuaccgauggcacguuauuacauuaucaaauacgccgaccaaaaggcucuuuauacaagagacggacagcucuuaguuggagauccgguggccgauaauugcugcgccgagaagauuugcauccucccaaaucguggccuggcacguacuaaaguacccauauuuuugggaauccagggcggcucccguugucuugcuugcguugaaacugaggagggccccucccuacaacuugaagaugugaacauugaggaacucuacaagggcggagaagaagcaaccagguucacuuuuuuucaguccuccucaggcuccgcuuucagacucgaagccgcugcguggccaggaugguuucucuguggucccgcugaaccacagcagccugugcaacugacaaaagaaucugaaccaagcgcaaggacaaaguuuuacuuugagcagucgugguag

SEQ ID NO: 5437 - RNA, 600 nt, Artificial Sequence
  Description of Artificial Sequence: Synthetic coding sequence
augaauugugugugccgccucguccuuguuguccugagucuguggccagauaccgcaguggcuccaggcccuccgccagggccuccuagagugagccccgacccccgcgccgaacucgacucgaccgugcugcuuacuagaucuuugcuggcugacaccagacagcuggccgcacaguuacgagauaaguuuccugccgauggcgaccauaaccuagacagccuucccacacuugcaauguccgcuggugcacuuggcgcccugcaacuucccggagugcucacacgccugagggccgauuuacuguccuaccucagacacguucaauggcuccgacgcgcaggcggaucuagccucaagacccuggaacccgagcucggaacacuucaagcucgcuuggacaggcugcugcguagacugcaauugcucaugucgcgccucgcucucccccagccaccaccggaucccccagcaccaccgcuggcccccccaucgucagccuggggagguaucagggccgcgcaugcaauccucggaggccugcacuuaacacucgauugggcuguuagagggcuccugcugcuuaagacccgccuauag

SEQ ID NO: 5438 - RNA, 621 nt, Artificial Sequence
  Description of Artificial Sequence: Synthetic coding sequence
augaauuuucaacagcggcuucagagccuguggacucuggcccgacccuucugccccccgcuuuuggccaccgcaucucaaaugcagaugguugugcuuccaugucuaggauuuacacugcugcucuggucgcaaguuuccggggcucagggacaagaauuucacuuuggacccugccagguaaaaggagugguuccucagaagcugugggaggcauucugggcugugaaggacaccaugcaggcacaggacaauauaacauccgcacggcuccuucaacaggagguguugcagaacgugucagaugccgaaucuuguuaucucguacauacauuacuggaauuuuaucuuaagacgguauuuaagaacuaucacaauagaacugucgaggugagaacuuuaaagucuuucucuacguuagcuaacaacuucgugcucauaguaucgcagcugcagccuucucaagagaaugagauguuuaguaucagagauagugcccaccgcagguuccuguuauuucgcagagccuucaaacaacucgaugucgaggcugcccugaccaaagcccugggcgagguggauauccuguuaacuuggaugcaaaaauucuauaagcuguag

SEQ ID NO: 5439 - RNA, 465 nt, Artificial Sequence
  Description of Artificial Sequence: Synthetic coding sequence
augaauuuucagcaacggcuccaaucccucuggacucuggcuagccggcccuuuugccccccccugcucgccacagccagucagaugcagauggugguccugccaugcuugggcuuuacucuucuccuguggucccaaguuagcggcgcccaaggacaggaguuucacuuugggcccugccaagugaaaggcguagucccacagaaacugugggaggcguucugggcaguaaaagacacaaugcaggcccaggauaauaucaccuccgcuagacugcuucaacaagaaguccuacagaaugugagucaggaaaacgaaauguucaguaucagagauucugcccaccgucgcuuccuacuuuuuaggagagcuuucaaacaguuggacguggaggcugcguugacaaaagcacuaggcgagguugacaucuuacuaacuuggaugcagaaauucuacaaacuguag

SEQ ID NO: 5440 - RNA, 624 nt, Artificial Sequence
  Description of Artificial Sequence: Synthetic coding sequence
augaauuuccagcagcggcuacagucccucuggacccuggcuaguaggccauucugcccuccucuauuagcaaccgcuucgcagaugcagauggugguguugccaugucugggauuuacccuguuacuguggucccaagugaguggagcacagggacaagaguuucacuuugggccaugccagguuaaaggggugguaccacaaaaacugugggaggcauucugggcaguuaaggauacaaugcaggcucaagauaauauuacaucggcuagauugcuucaacaggaagugcuucagaacguuagcgacgcagagucauguuauuuggugcauacacuccuagaauucuaccuuaagaccgucuucaaaaauuaucauaaucggaccgucgaggugagaacccugaaguccuuuucuacccucgccaacaauuucgugcugaucgucucccagcugcagccuucacaagagaaugaaauguuuuccauuagagacucugcccacaggagauuuuuauuauuccggcgagccuucaagcagcuggacguugaggccgcccugacaaaagcucucggagaagucgacauacuccuuacuuggaugcagaaguuuuauaaauuguag

SEQ ID NO: 5441 - RNA, 495 nt, Artificial Sequence
  Description of Artificial Sequence: Synthetic coding sequence
auggccagucauuccggccccucuaccuccguucuauuccuuuucuguugccuuggaggauggcucgccucccacacccugccuguacgccuacugaggcccuccgaugauguucagaaaaucguugaagagcuucagucgcugagcaaaaugcuucuuaaagauguagaagaggagaaaggagugcucgugucacagaauuauacucuuccuugucugagcccagaugcccaaccacccaacaacauacacucucccgccauccgcgccuaccugaagaccauccgacagcucgacaauaagucaguuauagacgaaaucaucgaacaucuagauaagcuaaucuuucaagacgcaccagaaacaaauauaagcguccccaccgacacccacgagugcaagcgguucauccuuacuauuucucagcaguuuuccgaaugcauggaccuagcccugaaaagccuuaccaguggagcucagcaggccacaaccuag

SEQ ID NO: 5442 - RNA, 507 nt, Artificial Sequence
  Description of Artificial Sequence: Synthetic coding sequence
auguguuucccaaaaguucuaagcgacgacaugaagaaacugaaggcuagaauggugaugaguagccucgcugagcuggaggaugauuucaaggaaggauaccuggaaacagucgcugcuuacuaugaagagcaacacccugaacugacaccccuccuggagaaagagagagacggcuuaagauguagggguaaccguaguccggucccggaugucgaagacccugccacagaggagcccggagaaaguuuuugcgauaagguaaugaggugguuucaagccaugcugcagagacugcaaacaugguggcaugguguacuggccuggguaaaagaaaaagugguggcuuuagugcacgccguccaagcauuguggaagcaauuucaguccuucugcuguucgcugagcgaguuauucauguccuccuuccagucuuacggggcaccaagaggagauaaggaggaguuaacgccccaaaagugcucugaaccucaguccucuaaguag

SEQ ID NO: 5443 - RNA, 2070 nt, Artificial Sequence
  Description of Artificial Sequence: Synthetic coding sequence
auggcuccagccccugugacucugcuggcccccggcgccgccucuaguaugagcuguucacagccaggucagcgaagccccucuaaugacuuucagguuuugcgggguacagaacuacaacaccuguugcaugccguuguuccagggcccuggcaggaagauguagcagacgcugaggagugcgcaggaagaugcggaccucucauggacugcugggcuuuucauuacaacguuuccucacacggaugccaguugcuaccauggacacagcacuccccucauuccagacuguggcauuccgguagaugugaucuguuucaggaaaagggcgaguggggauacaugcccacuuugagaaacggcuuggaagaaaacuucugucggaauccagauggggacccugggggaccauggugccauaccaccgauccugccgugcgcuuccagucgugcucaauuaaaagcuguaggguggcagcauguguuugguguaacggugaagaauaucgcggagcgguugaucgaacugaaucagggagagaaugccagcgcugggacuuacagcauccacaccagcauccuuuugaaccagguaaguuccucgaccaaggacuagacgauaauuauuguaggaacccagauggauccgagaggcccuggugcuauaccacugacccacagauugaacgggaauuuugugacuugccuagaugcgguagcgaagcacagccucggcaggaagcuaccagugucaguuguuuucguggaaagggugaggguuaccguggcacugcuaacacaacuaccgccgccuaucuggccuccguggggaccaggaagagccacaucagcacagaccugcgccagaaaaauacccgagcaagugaagugggagggggagcaggcgucgguacuuguuguuguggcgacuugagagagaacuucugcuggaaccuggacggcucagaagcuccaugguguuuuacucucagaccugggacaagggugggauucugcuaucaaauuagacgcuguaccgaugacguacgcccccaggauuguuaccacggcgccggagagcaauacagagggacagucagcaaaacucgcaagggaguacaaugccagagguggucagcugaaacuccgcauaaacuccaagcacugacacuaggacggcacgcucuuaugucagguacccgugcuuggaaauggcugagauugcccugccaugauuuugccccugcuccggccuccgugcauauauaccugagaacagccuguacuacgggaggggaacucuugccagaucccgauggcgacucucacgggcccuggugcuacacaauggauccuagaacuccauuugacuacugugcauugagacggugugaccaggugcaauucgaaaagugcgguaagagaguggaccgacuggaucagagaagguccaaauuacgcguggcugguggucaucccgguaacucaccuuggacuguuagccugcguaaucgacacaugccgcuuacagguuacgaaguuuggcuggggacccuuuuccaaaacccccagcacggugaacccggauuacaaagagugccagucgcaaaaauguuauguggaccuagcgguagucaguuaguucugcugaagcucgagcgcucagugacacugaaccagagaguagcgcugauuugccuuccgcccgagugguacguggugcccccagggaccaaaugcgagauugcuggauggggagagacuaagggcaccgguaaugacaccguucuuaacguagcccugcucaacgucaucucuaaucaggaauguaacauaaaacaucgagggcacguucgagaguccgaaaugugcacugaaggucuguuggcuccaguuggcgccugcgagggagauuaugguggcccguuagccuguuuuacacacaacugcugggugcuuaaaggcauucgcauccccaaccgaguuugcaccaggucuagauggccagcuguguuuaccagggucuccgucuuuguugauuggauucacaaagucaugcgucuggguuag

SEQ ID NO: 5444 - RNA, 2148 nt, Artificial Sequence
  Description of Artificial Sequence: Synthetic coding sequence
auggccccagccccuguaacacuacuggcuccaggcgcagcuagcagcaugucuuguucccagcccggccaacgaucacccucaaacgacuuccaggugcuacggggaacugagcuucagcaccuucuucaugcagucgugcccggacccuggcaggaagauguagcugaugccgaagagugugcgggucguugcggcccccuuauggacugcugggccuuccacuauaacgucagcucucauggaugucagcuucugccauggacacagcauagcccccacucaagacucuggcauaguggcagaugugacuuauuucaggagaaaggugaguggggauauaugccuacccuccgcaacggccuugaggaaaauuuuugcaggaacccagauggugauccugggggcccauggugccacacaacggacccugcgguacgcuuucaauccugcucaaucaagucgugucgcgucgcagcaugcguuugguguaacggagaggaguacaggggcgcaguggaccgaacugaaagcgggcgggagugccagagaugggaucuacaacauccacaucagcauccauuugaacccgggaaauuccuggaccagggucuggacgauaacuacuguagaaauccagacggaagcgagcgcccgugguguuauacaacagauccacaaauugaaagagaauuuugugaucuccccaggugugguagcgaagcccaaccuagacaggaagcuaccagcgucucaugcuuuagggguaagggagagggcuacaggggaaccgcuaauacaacuaccgcagcguaucuggccagcgucggaaccagaaagucucauauuucuacugaucucagacagaagaacacacgcgcaucggaaguagggggcggcgcaggugugggcacguguuguuguggagaucuccgcgagaauuuuugcuggaacuuggacggcagcgaagcgccguggugcuuuacuuugcguccagguacuagagucggcuucuguuaucagaucagaagauguacagaugaugugagaccacaggauugcuaucacggagcaggugagcaauauaggggcacugugaguaaaacacggaagggagugcaaugucaaagguggagugcugaaacaccacacaagcuacaggcucugacucucgguagacacgcguuaauguccggaacacgggccuggaaauggcugagacuaccaugucaugauuucgcccccgcucccgcauccguccacaucuacuugcguacagccuguacaaccggaggggagcuguugccagauccagauggagauagccacggcccaugguguuacacaauggauccucggacaccauuugacuacugugcgcucaggaggugcgaucaaguucaguuugagaaaugcggcaaaaggguagacagauuggaucagagaagaucaaaacucagaguagcggguggacaccccggcaacucacccuggacuguaagucuacgaaacaggcagggucaacacuuuugugcugggagucuaguaaaggagcaauggauucugacagcacggcagugcuuuucaagcugucacaugccucuuacaggcuacgaaguguggcucgggacucucuuccagaauccacaacacggagaaccuggucuucaacgggugcccgucgcgaagauguuauguggacccucugggucucaacugguguugcugaaacucgaaagaucugugacauugaaccaaagaguagcgcugauuugccuaccaccugaaugguacguugugccaccaggcacuaagugugagauugccggauggggugaaacaaaggguacaggcaaugacacugugcugaacguugcacuucucaacguuaucaguaaccaggaauguaauaucaaacaucguggccaugucagagaaagcgagaugugcacagagggccuucucgccccuguuggagcgugcgagggggacuauggggggccacuugccuguuucacucauaacuguugggugcuaaaagguauucggaucccaaaucgcguguguacacgguccagauggccugcaguauuuacaagagugagcguguuuguugacuggauucacaaagugaugcgacugggguag

SEQ ID NO: 5445 - RNA, 1527 nt, Artificial Sequence
  Description of Artificial Sequence: Synthetic coding sequence
augaacugucagcaacuguggcuuggcuuccuacuuccuaugaccguuuccggccgugugcucggauuggcugaaguugccccgguggacuaccugagucaguacggcuauuuacagaagccccuggaaggcucaaauaauuuuaaaccugaggacauuacagaggccuugagagcauuucaagaagcuuccgaacugccugugaguggccagcucgaugaugcgacacgggcccgcaugaggcagccgcgcuguggccuggaagaccccuuuaaucagaaaacacugaaguaccugcugcugggccgauggagaaagaaacaccuuacauuccggauucugaauuuaccaagcacacuuccgccacauacugcccgugcagcacugcgacaggcguuucaggacuggucuaacguggcaccacucacauuccaggagguacaggccggcgccgccgauauccgacuuucauuucacgggagacaaagcagcuacuguuccaacacauucgauggaccaggccgcguccuagcccacgcugacauacccgaacuugggagcgugcacuuugacgaggacgaguuuuggacagaagggacuuauagaggggugaaccuucguaucaucgcugcacaugaagucggucaugcacucggauuaggccauucucgcuacucucaggcauugauggccccagucuacgaaggauaucguccucauuucaagcugcaucccgacgacguugcaggaauccaagcccucuacggaaagaagucaccugugaucagagacgaggaagaggaggaaacagagcuuccuacaguaccuccuguaccgacagagcccucuccaaugccagacccuuguagcucggaacuagacgccaugaugcuugggccuagggggaagacauacgcuuucaagggagauuacguauggacugucagugauaguggaccuggaccauuguucagagugucagcgcuaugggagggacugccaggaaaucuagacgccgcuguauauaguccacgcacacaguggauucauuucuucaaaggugauaaaguguggagguauauuaacuuuaaaaugagcccuggcuucccaaagaaacugaauagaguagaaccgaauuuggaugccgcgcuguauuggccucucaaccagaagguguuccuauuuaaaggguccggcuacuggcagugggaugaacucgcuaggacagauuuuagcucuuacccuaaaccuauaaagggccuuuuuacaggagucccaaaucaacccuccgcugcaaugaguuggcaggacggcagaguguauuucuucaaggguaaaguguacuggaggcucaaucaacaacuucggguagaaaaagguuauccuagaaacaucucgcacaacuggaugcacuguaggccucguacaauagauacuaccccaucugguggaaacacuacgccaagcggcaccgggaucacacuggauacuacucugagugcaacugaaacaacuuuugaauacuag

SEQ ID NO: 5446 - RNA, 669 nt, Artificial Sequence
  Description of Artificial Sequence: Synthetic coding sequence
augggcgugaccugggauuucucuaugaguaauggcgggccgaggggaaagacauacgcauuuaaaggggauuacguguggacagugucggauaguggcccugggccucuauuuagaguuagcgcccuaugggaaggauuacccggcaaucuugacgcugccguuuauaguccacguacacaauggauacacuucuucaaaggagauaagguguggcgguacaucaauuucaaaaugucaccgggcuuuccgaagaaacugaauagggucgaaccaaaucuugacgccgcacuuuacuggccacuuaaccagaaaguguuccuguucaaaggaaguggcuauuggcagugggaugaguuggcuaggaccgauuuuuccucguaucccaaaccuauuaaaggacuguucacuggagucccuaaucaaccuagugcggcuaugucguggcaggacggucggguguacuuuuucaaagguaagguguauuggcgguugaaucagcaguuacgggucgaaaagggcuacccuagaaauaucagccauaauuggaugcauugccggcccagaacaauugauaccacgcccucaggaggaaauacaaccccaagcggaacuggcauuacccuggacacaacccucagcgcgaccgagacaaccuuugaauacuag

SEQ ID NO: 5447 - RNA, 918 nt, Artificial Sequence
  Description of Artificial Sequence: Synthetic coding sequence
augaauugucagcagcuuuggcugggauuucuuuugccuaugaccgugaguggcagagucuuaggccuagcugaggucgcuccaguugacuaucucagccaguauggcuaccugcagaaaccgcuagaagguucuaacaacuucaaacccgaagacauuacagaagcacuucgagccuuucaagaagcaucugaacucccuguuucaggucagcuagacgaugcuaccagagcacguaugagacagccgcgcuguggacucgaggacccauucaaccagaaaacccugaaguaucuccucuuaggacgguggagaaaaaaacaucucacauuccgcauucucaaccucccuaguacacuaccgccucauacagcaagagccgcccucagacaggcuuuccaagauuggagcaaugucgccccuuugaccuuucaggaggugcaggccggugcagcggacauccgccugucauuucacggaaggcagagcaguuacuguuccaacacauuugaugguccaggaaagaagagcccaguaauaagagacgaagaagaagaagagaccgaacugccaaccgugccucccgucccgacagaacccagcccaaugccugaccccugcucgucagaacucgaugccaugauguugggcgaggccccaccacugcaagccguuggccgccgcuggggucagccugccgacccagaagcauggaccaacggcagcgauaugggucuucagcaugaacaauggagagccccaugggaggaucuuuguuuucagggaggcuuauguguggauuguauuagauuucgaaccgggccucuagugccuagcgugugcccacucgguggagccccaaggaaaccuggauguugcugccuccuugcuucaaacaccauggacucuuugcuuuag

SEQ ID NO: 5448 - RNA, 1173 nt, Artificial Sequence
  Description of Artificial Sequence: Synthetic coding sequence
auggguaggggagcccgggucccuucugaggcucccggugcuggaguagaaagaaggugguugggagcagcgcuuguugcacucugccugcuaccugcucugguucuucuggcaagauuaggugcuccagcuguuccugcaugguccgccgcacaaggggacguggccgcccugggccucucagccguuccccccacccgcguacccggaccccucgccccuagacguagacgcuauacacucacuccagcccgguuaaggugggaucacuucaacuugacauaccggauccucucauuuccucgcaaucucuugucuccgcgagaaacccgcagagcccuagccgccgcauuuagaauguggucagaugucucaccguuuucuuuucgggagguggcucccgaacaaccgucugacuuaagaaucggcuucuacccuauaaaucacacagauugucuuguguccgcccugcaucacugcuuugauggcccuaccggcgaauuagcucaugcauucuuuccuccucacgggggcauccauuuugaugauucagaguacuggguacucgguccgaccagauauucguggaagaaggguguuuggcuuaccgaucucguucacguggcugcucaugaaauaggacacgccuugggccugaugcauagucagcauggaagagcuuuaaugcaccuuaacgccacacugagagguuggaaggcuuugucccaggacgaacuuuggggacugcaucgacuguacggaugucuggaccgccuauucgugugugccuccugggcuagacggggcuucugcgaugcacgacgacgacugaugaagcgccucuguccaucuucaugugauuuuugcuaugaauucccuuucccaacuguugcgaccaccccaccuccuccaaggacaaagacgcggcuugugccagaaggcagaaacgugacguuccgcugcggccagaagauccuccacaaaaaaggaaagguuuauugguacaaagaucaggagccuuuggaguuuucuuaucccggguaccuugcucucggcgaagcccaucugaguauuaucgccaacgccgucaacgagggcacuuauaccugcguagucagaagacagcagagaguucuaacaaccuacucuuggagagugcgagugagaggcuag

SEQ ID NO: 5449 - RNA, 1161 nt, Artificial Sequence
  Description of Artificial Sequence: Synthetic coding sequence
augggcagaggagcgcguguacccucggaggcacccggagcagggguggaacggagauggcuaggagccgcccucguggcccuuugccuccuucccgcacucguucugcuagcccgacugggugcuccagcugugcccgcuuggucagccgcacagggagacguugcugccuuaggacugagcgccguccccccuacucgcgucccuggcccauuggcccccaggaggagacgcuacacacugacacccgcgcgucugcgcugggaucacuucaauuugaccuaccguauauuaucuuucccucgcaaccuacuuucaccucgcgagaccagacgggcgcuggccgcggcauuucguauguggagcgacgugucuccguucucauuccgggagguggcccccgaacagccuuccgaucuucgaaucggcggaaggccucccccaccccgcccuggaccugcacgaccugcuucccagcccagagcaccaccacgccuucuuccagaccaaccccauggguugccugggcucagagccgccccauugcuucgaagaccucacgggggugcuggaccaagacuccugccucccgcuagacgccauccacugagaagacagagagugcucggucccgggccacacgcacuucagcucgaagagaggagagucgcacauggacccggcgccagaggcgggccccgggauaggccaagggcagguccugacgcacuaaccacaagaccaggggcccacgcucccgagagacacgccgcacgguuggagggcgucgugccaggccgugccgugggagccgcacccgcgcuucgaaugccuagacaggcugugagaguccgcguccugggggccgaagguuuauugcgcagaucaccugcagcccacgaagaagcucucccccagcaguuacgacuuuuacucagaauacccuugccacauggcggccaucacccaacugcuccgcaggaccagaaccaggcgggugcucgaggccaggaacgagauuuaccccuucgcccagaggacccuccacaggaacgugaaucuguacuggugcagggaccaggagcuccaggcgucuuguugccccgacucccuggucccggacgcggagcacccgaacaccaucgacaaagaagacaguag

SEQ ID NO: 5450 - RNA, 1293 nt, Artificial Sequence
  Description of Artificial Sequence: Synthetic coding sequence
augggacggggcgcccgcguacccucugaggcccccggugccggcguggagcgucgcuggcugggcgccgcccugguagcgcuuugucugcugccagcucucgugcuucucgccagacucggagccccugcaguucccgccugguccgccgcucagggcgacguagccgcccuugguuuaucagcagugccaccgaccaggguaccaggcccguuagcuccucgucgcaggagauacaccuuaaccccugcuagauuacgcugggaucauuuuaaucugacauaccggaucuugucuuuccccaggaaucuacucagccccagagagacuagacgggcucuggcugccgcuuucaggauguggucagaugucagccccuucagcuuucgagaaguugcucccgaacagcccagcgacuugagaauaggcuucuaccccaucaaccacaccgauuguuuagucagcgcacuucaucauugcuucgacggcccuaccggagaacuugcacacgcuuucuuccccccacauggaggcauccacuucgacgacagcgaguauuggguccugggacccacuagauauagcuggaagaaaggcgaucgccccggauccuggcguccguugcuguguucaacuguggggugucgagggcgggcucugggucagacugcuggaggcacauucaggggggggggaugucauuggucucuggccggcguuuggcugacagacuuggugcacguggcagcucacgaaaucggacacgcacugggacuuaugcacagucaacauggccgugcacugaugcaucugaacgcaacucuccgcggcuggaaagcccuuucucaagaugaacugugggggcuacauagacucuacgguugucucgaucgacuguuuguaugcgccucaugggcacgcagaggcuucugugacgcaaggagaagacucaugaaaaggcucuguccaucaucuugugacuuuugcuaugaauuuccuuuuccaacagucgcgacuacaccuccgccaccucgaacaaaaacccgccugguucccgaggggagaaauguaacauucagauguggucaaaaaauuuuacacaaaaaagggaagguguacugguauaaggaucaagagccauuagaauuuagcuacccaggauaccuugcucugggcgaggcacauuuaucgaucauugccaaugcuguaaaugaaggcaccuacacuugugugguccgcagacaacagagagugcugacaacauauucuuggagaguuagaguucgcgguuag

SEQ ID NO: 5451 - RNA, 717 nt, Artificial Sequence
  Description of Artificial Sequence: Synthetic coding sequence
auggguagaggugcaagagugcccucugaagcacccggugcagggguggagaggcgaugguugggagccgcucucguagcacugugucugcugccugcucugguccuucuugcuagguugggugcuccugcuguccccgccugguccgccgcucagggugacguagcagccuugggucuguccgcuguucccccuaccagggugccuggcccacuagcaccaagaagacgccgguacacacugacgccugcuagacugaggugggaucacuuuaaccugacauaucggaucuugagcuuuccucgcaaucuucuuuccccacgagaaaccagacgagcccuggcagcagccuuucggaugugguccgacguuagcccuuuuucauuccgcgaaguggcgccagaacagccuucugaccugagaauugguuucuacccuauuaaucacacugacuguuuagugucagcgcuccaccauuguuucgacggucccacaggcgagcucgcccacgcuuuuuucccuccccacggagguauacauuuugaugauucagaguauugggugcuugggccuacccgauacaguuggaagaaaggugacaggccuggauggccaccugguggucugucauccgcugcucagugggcagccgcagucggacucuggggaaggagacaggaaggacccucuggcguuguagcugcaacaggcguguag

SEQ ID NO: 5452 - RNA, 1938 nt, Artificial Sequence
  Description of Artificial Sequence: Synthetic coding sequence
augccaagaucccgcgggggcagagccgcaccuggcccuccucccccccccccaccccccggccaggccccgcgcugguccagguggaggguccccggcagguuacuucuucuauuacugcccgcccugugcugccuucccggagccgcacgggccgcugccgcugccgccggcgcagggaaccgggccgccgucgccguggccguugcgcgggccgaugaagcugaggcucccuuugcgggccagaacugguugaagucuuacggcuaucugcuaccuuaugacucaagggccagugcacuucacagugccaaagcucugcaauccgcagugaguacaaugcagcaguuuuacggcaucccagugaccggaguccucgaucagaccacuauugaauggaugaaaaaaccaaggugcggugucccagaccauccccaucugagccgaaggcguagaaauaagcgauaugcauuaacuggacagaaguggagacagaaacauauaacauauaguauccauaauuacacucccaaagucggcgaacucgacacccguaaggcuauucgacaggcauucgauguuuggcagaaaguuaccccucuuaccuuugaggagguacccuaccacgagauuaaauccgaucggaaggaagcagauauaaugaucuucuucgcaucaggauuucauggggauucgagcccauucgacggagaagguggauuccuggcccacgcguauuuucccggcccggggauuggaggggauacucacuucgauagugacgaacccuggacgcucggaaacgcgaaccaugacggcaaugaccuguuuuuaguagcugugcacgaacugggacaugcgcuagggcuggaacauaguagcgauccaagugcaaucauggcuccauucuaccaauacauggaaacacacaauuucaaacuaccacaggacgaccugcaaggcauccagaagaucuaugguccacccgcagagccccuggaaccgacccguccauuacccacguugcccgugcggagaauacacagcccaagcgagcgcaaacacgagagacagccccguccaccccgaccuccguuaggugacagaccauccacccccggaaccaaacccaauaucugugacggcaauuucaauacaguggcgcuguucaggggagagauguucgucuucaaagauaggugguuuuggcgccugcggaacaaucggguacaggaaggguauccuaugcagauugaacaauucuggaaaggucugcccgcaagaaucgacgccgcguacgagcgcgcugauggaagguucguuuuuuucaaaggggacaaguacugggucuuuaaagaagucacgguagaaccugguuauccacacagcuuaggcgagcuggggaguugccugccaagggaaggcaucgacaccgccuugagaugggagccugucggaaagacguauuuuuuuaagggggagagauauuggagauauagcgaggaacgccgagcgaccgacccaggauacccuaaaccaaucaccguuuggaagggcauaccucaggccccccagggcgcauucauuagcaaagagggcuacuacacauacuucuauaagggcagagacuauuggaaauucgacaaucagaagcugucuguagagccgggcuacccaaggaacauucuuagagacuggaugggauguaaucagaaagaagucgagaggcgcaaggagagaagguuaccccaagacgacguagacauuaugguuacgauuaaugacgucccuggaagugugaacgccgucgcagucguuaucccauguauccucucgcucugcauucucgugcucguguauacgauauuccaguucaaaaacaagaccggaccucagcccgucacuuacuauaaaagaccuguccaggaguggguuuag

SEQ ID NO: 5453 - RNA, 1542 nt, Artificial Sequence
  Description of Artificial Sequence: Synthetic coding sequence
augaagcgucuccucuuacuauuucuuuucuucauuaccuuuuccucagcuuuccccuuagugagaaugacugaaaaugaggagaacaugcagcuugcucaggcauaccucaaccaguuuuauucuuuggagaucgaagggaaccacuuggugcagucuaaaaacagaaguuuaauugaugauaaaauccgcgagaugcaggcauuuuucggccucacggucacuggcaaauuagauuccaacacacuggagaucaugaagacccccaggugcggcguccccgacgugggacaguacggauacacccuucccggcuggcggaaguacaaccucacguaccguaucaucaacuauacuccagauauggcucgggccgcgguagacgaagcuauccaagaggggcuugaagucuggucgaagguaacaccacugaaauucacgaagauaagcaaaggcauagccgacauaaugaucgcuuuucgaacaagagugcacgggagauguccaagguauuucgauggcccgcugggaguauugggacacgccuuuccuccaggccccggacucggaggggacacucauuucgaugaagacgagaacuggaccaaagauggcgccggauuuaaucuguuucuggucgccgcacaugaauucggccacgcucugggccugucccauaguaacgaccaaacagcccucauguucccuaauuauguuaguuuagauccaagaaaauacccccucucucaagacgauaucaauggcauccagagcaucuaugguggacuuccaaaagaaccagccaagccaaaggagccgacgaucccgcaugcgugcgaucccgaccugacauuugacgcuauuaccacuuucagaagggaggugauguuuuuuaaaggccggcaucucuggagaauuuauuaugauauaacugacguggaguuugagcucauugcgaguuucuggccaucacucccagcagaccuacaagcagcauaugaaaacccgcgagacaaaauuuugguguucaaggacgagaauuuuuggaugaucagaggauaugccguacuccccgauuauccuaaaucaauucacacccuggguuuccccggucgaguuaaaaagaucgacgccgccgugugugacaagacaacuaggaagacguacuucuucguggguaucugguguuggagauucgacgaaaugacacagaccauggauaagggcuucccucagcgcguuguaaagcacuuuccagguauaucaauuagagucgacgcugcauuucaauauaaaggcuuuuucuucuucucaaggggcaguaagcaguuugaguaugauauaaagacaaagaauaucacuagaaucaugaggaccaacaccugguuucaaugcaaagaaccuaagaacuccuccuucggguuugauauuaacaaggaaaaagcacacuccggugggauuaaaauucuguaucacaagucucucucacuuuucaucuuuggcauuguccaucuccucaaaaacaccucuauuuaccaguag

SEQ ID NO: 5454 - RNA, 393 nt, Artificial Sequence
  Description of Artificial Sequence: Synthetic coding sequence
augguugccagagugggacugcuguuaagagcucuacaacuucugcuuuggggccaucucgacgcucagccagcggaaagggggggccaagaguugagaaaggaagccgaggccuuucuagaaaaauauggauaccucaaugagcaggucccaaaggcacccacaucuacacgauuuagcgacgccauacgugcguuccagugggucucccaauugccuguuagcggugucuuggauagagcaaccuugaggcaaaugacccggccuagauguggcguuaccgauacuaacucuuaugcggccugggccgaaagaauauccgacuuguuugcgagacacagaacgaagaugagacguaagaaaagguucgcaaagcagggcgaacacuguuag

SEQ ID NO: 5455 - RNA, 1560 nt, Artificial Sequence
  Description of Artificial Sequence: Synthetic coding sequence
augguggccagagugggccugcuucuccgcgcucugcaguuacuauuauggggucauuuggaugcccagccagcagaacgugguggccaagaguugagaaaagaagccgaggcuuuucucgaaaaguauggcuacuuaaacgagcaaguucccaaggcuccaaccagcaccagguuuucugacgccauuagagcauuucagugggugagucagcuuccugugaguggcguguuggacagagcgacccugcgccagaugacaaggcccaggugcggugucacugauacaaauucuuacgcggccugggcugaacggauauccgaccuuuucgcuagacaucggaccaagaugagacggaaaaagagguuugcgaaacaaggaaauaaaugguauaaacagcaucugucauaucgccuggugaacuggcccgaacaccccgaaccugcugugcguggagccgugagagccgcguuucagcuguggaguaauguuucugcucuggaauucugggaggccccugcgaccggaccugcugauauucgacugacuuucuuucaaggggaucauaacgacggccucggcaaugcauucgacgggccgggaggggcucuugcacacgcguuuuugccucgcaggggugaggcucacuucgaccaagaugagcgguggagcuugucuagacggcgaggccgcaauuuauuuguaguccuggcgcacgagaucgggcauacccuaggacucacccacuccccagcaccaagagcuuuaauggcacccuauuacaaacgucuaggaagggacgcacuccugucaugggaugauguccuggcuguucagucccuuuauggaaaaccgcuaggagguuccgucgccguucaacugcccgggaaacuguucaccgauuucgaaacuugggacaguuauaguccacagggcagaaggccagagacucagggaccuaaguauugucacucauccuuugacgcgauuacaguugauaggcagcagcaacuuuauaucuuuaagggaagccauuuuugggaagucgccgccgaugggaacgugagugaaccccgcccauugcaggaacggugggucggccuccccccaaacaucgaagccgcagccguuucccucaacgacggggauuucuauuucuuuaaaggcggucggugcuggcgcuuucgcggaccuaagccugugugggggcugccacaacuuugccgcgcggguggacuccccagacacccugacgccgcucuuuucuuuccaccccuaaggaggcuaauuuuguuuaagggggcccgauauuaugugcucgcuaggggaggucugcagguugagccauauuacccgagaucguugcaggacuggggcggaauucccgaagaaguuucaggcgcccugccucgaccagauggcagcaucaucuucuuuagagacgacagguacuggcggcuggaucaagcaaagcugcaggcaacaaccaguggacgcugggcaacagaauuaccuuggaugggcuguuggcaugcaaacucaggcagcgcacucuuuuag

SEQ ID NO: 5456 - RNA, 1179 nt, Artificial Sequence
  Description of Artificial Sequence: Synthetic coding sequence
augguggcuagagugggacuacuguugcgugcgcugcaguuacuguuaugggggcaccucgacgcucagcccgcagaaagaggaggccaagaacugcgcaaggaggccgaagccuuccuagagaaauacggcuaccugaacgaacaggucccaaaagcaccuacaagcacacgguucucugacgcaauacgggccuuucaaugggugagccaacuuccaguaagcggaguuuuggacagagcaacccugcgacagaugacuagaccuagguguggcgugaccgauaccaacaguuaugcagcuugggcugagaggauaagcgaucuguucgcucgacacagaacaaagaugagacguaagaagcgcuucgccaaacagggcaacaagugguacaagcaacaccugagcuaccgccucgugaauuggccagaacaccccgaacccgccguacggggugcgguucgagcugcguuccaauuaugguccaacgucuccgcacuugaauucugggaagccccggcaaccggcccugcugacauucgccugaccuuuuuccagggcgaucacaacgauggauuggguaacgccuucgauggaccuggaggagcucuugcccaugccuucuuacccagacgaggagaggcccauuucgaccaggaugaaagauggagcuugagucgccgccguggccggaaccuguuuguagucuuggcccaugaaaucggccauacucugggccugacacacucaccagccccucgggcacuaauggcccccuauuacaaaagauuagggcgggaugcuuuacugucuugggacgaugugcuggcagugcagucauuauacggaaaaccccuggggggaagugucgcugugcaacucccggggaaacuguucaccgauuucgagacuugggacuccuauucuccucagggccgcagaccagagacccaaggaccuaaguacugccacagcuccuucgaugccaucaccguagaucggcagcagcagcucuacauauuuaagggaagucauuuuugggaggucgcugccgacgggaaugucagugaaccuagaccccugcaggaaaggugggugggccugcccccaaacauugaggcugccgcagugagccuaaacgacggagauuuuuacuuuuucaaggugcagucuguguag

SEQ ID NO: 5457 - RNA, 678 nt, Artificial Sequence
  Description of Artificial Sequence: Synthetic coding sequence
augguugcuagagugggacuuuuacugagggcccuucaacugcuccuguggggucauuuagacgcucagcccgcagagaggggaggacaagaguugagaaaggaggcugaggcuuuucuggaaaaguacggguacuuaaacgagcaagucccuaaggcaccaaccucaacuagauucuccgacgcgaucagagcauuccagugggugucucaacuaccgguguccgguguucuagacagagcgacacuccgacagaugacaagaccuaggugcggaguaacagauaccaauagcuaugcugcuugggcugagcgcaucuccgaucuguuugcucgucacaggacuaaaaugcgacguaagaaaagauuugccaagcaaggcaauaaaugguacaagcagcacuuauccuauaggcuugucaacuggcccgaacaucuaaggucccgccaguucggcgcgcccugugcaccuccuagcucauguggcgcaaccucccagcgcuggucauccggacgcccacagccacaagccccccugacuuccggcucccccucuucuaaagguacuacaaccaugggcugggcuaugccuuugauggcucaaggagcuccuuggcgcaccccuuccugcccagcugccgcaaaaagaacaucaacuaaaaugagugccggaccguag

SEQ ID NO: 5458 - RNA, 1095 nt, Artificial Sequence
  Description of Artificial Sequence: Synthetic coding sequence
augcaccggcugauuuucgucuauacgcuaauuugcgcaaauuuuuguucuugccgcgacacauccgcaaccccacaaagugccucuaucaaagcgcuccgaaacgccaauuuacgccgcgaugacuuguaucggcgcgaugagaccauucagguaaaggguaacggcuacgugcagucaccaagguuucccaauucauacccacgaaaucuguuacuuacuuggagacuccacucccaagagaauacacggauccagcucguauucgacaaccaguucggucuggaagaagccgagaaugauaucugucgguacgacuucguggaggucgaagauaucuccgagaccagcacaauuauccgaggacguugguguggucacaaggaaguuccgcccagaauuaaaucaaggacuaaccagaucaaaauuacauucaaauccgacgacuacuucguggccaaaccagguuuuaagaucuacuauaguuuacucgaagacuuccagccagcggcggcuagcgaaacuaacugggaauccguuacaucaaguaucagcggcguguccuacaauucuccuucuguaaccgaucccacgcugaucgccgacgccuuggacaaaaagauugccgaauucgauacuguggaggaccuccuuaaauauuuuaacccugagagcuggcaggaagaccuggagaauauguaccucgacacaccacgcuaccggggaagaaguuaucacgacagaaagaguaaaguagaccuggacagguuaaacgaugaugcuaagcgcuauucauguacgccgcggaauuacagcguuaacauccgagaagagcugaaacuagcuaacguaguguuuuucccucguugccuacucgugcagagauguggaggaaauuguggaugcggcacuguuaauuggcggucgugcacauguaacaguggaaaaacggugaagaaauaucaugaaguucugcaauuugagccgggccacaucaaacgaagaggaagagccaaaaccauggcccuuguggacauccaguuagaccaucaugagagaugcgacuguaucuguucuaguagaccaccuagguag

SEQ ID NO: 5459 - RNA, 1113 nt, Artificial Sequence
  Description of Artificial Sequence: Synthetic coding sequence
augcaucguuugauauuuguguauacccuuauuugcgccaacuucugcagcugccgggauacaucggcuaccccccaaucagccucuauaaaggcccugagaaacgccaaccugagacgagaugaaaguaaucaccucaccgauuuguacaggcgagaugaaacuauccaagugaagggcaaugguuacguacaauccccacguuuccccaauucuuacccacggaaucuucuauugacauggaggcuucauucucaagagaauacuagaauacagcuggucuucgauaaccaauuuggauuagaagaggccgagaacgacauuuguagguaugacuucguggagguggaagacauuagcgaaaccucaacuauuauacggggaagaugguguggucacaaagaggugcccccaagaauaaagucuagaacaaaucagauuaaaauuacauucaagucugacgacuauuucguugccaaaccaggguuuaaaauauacuacagcuugcuggaggacuuccagccagcagccgccagugaaacaaauugggaaucuguuacuucaucuaucaguggggucucguauaauaguccuucagugaccgacccaacucuuauugcugacgcuuuggauaagaaaauugccgaguuugacacuguggaagaccuacugaaauauuucaauccagaaucuuggcaggaagaccuugagaauauguaccuggauacuccacgauauagaggccgcagcuaucacgaccggaaguccaagguagacuuagauaggcuuaaugaugacgcuaagagguacucaugcaccccgaggaauuacuccguaaacauuagagaggaacugaaauuagccaacgucgucuucuucccuagaugccugcucguccagagaugcggaggaaacugugggugcgguacagugaauuggcggucauguacuuguaacucuggaaaaacugucaagaaauaucacgagguacugcaguuugagccaggacacaucaagcggcgcggcagggcaaaaacaauggcauugguggauauacagcucgaucaccaugaaagaugugacugcauuugcuccagcaggcccccucgauag

SEQ ID NO: 5460 - RNA, 726 nt, Artificial Sequence
  Description of Artificial Sequence: Synthetic coding sequence
augaaccgaugcugggccuuguuucugucccuuuguugcuaccuccgacuagugucugccgagggagacccuaucccagaggaguuauaugaaauguuaucggaccauuccauucgcaguuuugacgaucuacagcgccuguugcauggcgaccccggggaggaagacggugcugaauuggaucuaaauaugacacguagucacaguggcggcgaacucgagucauuggccaggggaagaaggagccucggaucucugacaauagcugaaccagccaugaucgcugaguguaagacaaggacagagguuuuugagaucucuaggcgacugauugaucguacaaacgccaacuuccucguuuggccccccugcguugaagugcaacgcugcuccgguuguuguaauaauagaaaugugcaaugucgcccuacccaaguacaauuacgcccaguucagguucggaagauugaaauaguucgaaaaaaaccaaucuuuaagaaagcgacaguuacccuagaggaucaccuggcgugcaagugcgaaacaguagcugcagcuagaccagugacacguucucccggagggucucaagaacagcgcgcaaagaccccucaaaccagaguaaccauucggaccguucgaguacgacgaccuccaaagggcaagcacaggaaauucaagcauacccaugauaagaccgcccugaaagaaacacuuggagcauag

SEQ ID NO: 5461 - RNA, 681 nt, Artificial Sequence
  Description of Artificial Sequence: Synthetic coding sequence
auguuuaucaugggccuuggggaucccauuccugaagaacuuuacgaaaugcugagcgaccauucaauacguucauucgaugaccuacagagacuguugcacggggacccaggugaggaggacggggcugaauuagaccucaacaugaccagaagucauuccggcggggaacucgagucauuggcacggggucgaagaucacugggaucccuuacgaucgcugagccugccaugaucgccgaauguaaaacacgcaccgagguguucgagauuucaagacgccugaucgaucgcacgaacgcuaacuuucugguguggccucccugcgucgaagugcagcgguguuccggaugcugcaauaaccgcaacgugcaaugccggccaacucaaguacaauuacggccugugcaggugagaaaaaucgaaauagugagaaagaagcccaucuuuaaaaaagccacaguuacucuggaggaccaccuggcguguaagugugaaacaguagccgcagcccgucccgucacaaggagccccgguggcucccaggaacaaagagcaaagacuccucagacucgcguuacgauucgcacagugcggguacgcagaccucccaaagguaaacaccgcaaguucaaacacacucacgacaagacagcccucaaagagacccugggugccuag

SEQ ID NO: 5462 - RNA, 411 nt, Artificial Sequence
  Description of Artificial Sequence: Synthetic coding sequence
augcucagcgaucacucuauuagaucuuucgacgaucuacagaggcuccuacauggcgauccaggcgaagaagauggugcugaacuggaccuuaauaugacucgcagccacagcggcggagaguuagaaucccuggcgcgcggaagacggagucugggcagcuuaaccauugcugagccagccaugauagcagagugcaagacucgaaccgagguauuugagauaucccgucgccugaucgaucggaccaaugccaauuuucuuguguggcccccuuguguggaaguucaaagaugcaguggaugcuguaauaauagaaacgugcagugcagaccuacccaggugcagcuucgccccguacaaguuaggaagaucgagauugugaggaaaaaaccaaucuucaaaaaauag

SEQ ID NO: 5463 - RNA, 435 nt, Artificial Sequence
  Description of Artificial Sequence: Synthetic coding sequence
augcuuucagaucauucuaucaggaguuucgaugacuuacaaagauugcuucauggagaucccggagaagaagauggggcagaacuggaucugaauaugacccguucacauucagguggggagcuggaaucgcucgcucgcggaagaagaaguuuggguucacucacuaucgccgagccagccaugaucgccgaaugcaagacucgaacggaaguauuugaaauuucacggagacuuauugaccgcacuaacgccaauuuucugguguggccgccgugcguggagguccagagauguucuggaugcugcaacaaccgaaacguacaaugccgcccaacacagguacagcugcgcccaguucaaguaaggaagaucgagauugugagaaagaagcccauuuuuaaaaaagcaaccgucacacuugaggaccacuag

SEQ ID NO: 5464 - RNA, 411 nt, Artificial Sequence
  Description of Artificial Sequence: Synthetic coding sequence
augauacucaauuggaaacuccuaggcauuuuggugcugugucuucacaccagagggauuucuggaucugaaggacaccccagucaccccccagcggaagauagagaggaagcgggaucuccgacuuugccucaaggcccaccgguuccaggagaccccuggccuggcgccccucccuuauuugaagacccuccucccacucgccccaguagaccuuggagagaccuuccugagaccggcguguggcugccugaaccuccacgaacugauccaccacaaccuccccgaccagaugaccccuggcccgcaggaccccaacccccagaaaacccauggccuccagcccccgaaguugacaaucggccccaggaagagcccgaccucgaccccccgcgcgaagaguauagguag

SEQ ID NO: 5465 - RNA, 417 nt, Artificial Sequence; identical to SEQ ID NO: 5350
  Description of Artificial Sequence: Synthetic coding sequence

SEQ ID NO: 5466 - RNA, 417 nt, Artificial Sequence
  Description of Artificial Sequence: Synthetic coding sequence
augaccgcccuguucuugaugucuauguuauuuggucuaacaugcggccaagcaaugucguuuugcaucccuacugaguauacuaugcauauugagcgccgcgaaugugcguauugucugacuauaaauaccaccaucugcgcuggauacuguaugacuagagauaucaacggaaaacucuuccugccgaaguacgcccugucucaagacgugugcacuuacagagauuuuauuuaccgcacagucgagaucccaggauguccacuucauguugcccccuauuucucuuauccaguugccuuguccugcaaauguggcaaaugcaacacagauuacuccgauuguauucaugaggcuauuaagacuaacuacugcaccaaaccucagaaauccuaucucguuggauucagcguguag

SEQ ID NO: 5467 - DNA, 621 bp, Artificial Sequence
  Description of Artificial Sequence: Synthetic coding sequence
atgtactccgccccttcggcctgtacctgcctgtgtctgcatttcttgcttctgtgttttcaagtgcaggttctggtcgcagaagaaaatgtggacttccggattcacgtggagaatcaaaccagagcacgggatgacgtgtccaggaaacagttgagactgtaccaactgtactcgcgtacctccgggaagcacatacaggtgcttggacgtcggatttccgcacgtggggaggacggagacaagtatgcacagctccttgtggaaaccgatactttcggttcacaagtccgcatcaaaggcaaggagacggagttttacttgtgcatgaatagaaaaggaaaactcgttggaaaacccgacggaacctcaaaagaatgtgtgttcatcgagaaagtgctcgagaacaactacactgcacttatgtccgcgaagtattcgggttggtacgtgggatttactaaaaagggccgccccagaaaaggtcctaagacccgcgagaaccagcaagatgtccactttatgaaacgctaccctaagggccagcccgagcttcagaagcctttcaagtacactacggtcaccaagcgctcccgaaggatcagaccaacccacccagcg

SEQ ID NO: 5468 - DNA, 621 bp, Artificial Sequence
  Description of Artificial Sequence: Synthetic coding sequence
atgtacagcgctccaagcgcctgcacttgtctgtgcctccatttcttgctgttgtgcttccaggttcaggtgctggtagcggaagaaaatgtggattttcgcatccacgtggagaatcagacccgcgcacgagatgacgtgagccgcaagcagctacgcctgtatcagctgtatagtaggactagcggtaaacacatacaggtgctgggacgccgcatttccgcccgtggcgaggacggagacaaatacgctcagctactggtggagactgatacatttgggagccaggtgaggattaagggtaaggagacggagttctacctgtgcatgaatcggaagggtaagctggtcggcaaaccggatggcacttcaaaggagtgcgtgttcatcgaaaaagttcttgaaaacaactacacagcattgatgtccgccaaatattctggttggtacgtgggatttacgaagaagggccgtcctaggaaaggcccgaaaacccgcgaaaatcagcaagacgtgcatttcatgaagcgctatccaaagggacagccggagttgcagaagccgttcaaatatactaccgttactaagcgcagcagacgtatccggccaacacacccagcg

SEQ ID NO: 5469 - DNA, 621 bp, Artificial Sequence
  Description of Artificial Sequence: Synthetic coding sequence
atgtactctgccccttcggcttgtacctgcctgtgtctccatttcctcctgctctgcttccaagtgcaggtgctggtggccgaggagaacgtcgacttccggatccacgtcgaaaaccagactagggctcgggatgacgtttcccgcaaacagctgcgcctgtaccagctttacagccgtacttcgggaaagcacatccaggtgcttggtagaaggatcagcgcgcgcggcgaggacggtgataagtacgcacagctcttggtcgaaacggacacttttggatcgcaggtccgaattaagggcaaggaaaccgagttctacctctgcatgaaccgcaaggggaagctggtgggaaagccagatggaacctcaaaggaatgcgtgttcatcgaaaaggtcctggagaacaattacactgcgctgatgtcagccaagtactccggctggtacgtgggattcaccaaaaagggacggccgcggaaagggccgaaaacccgcgaaaatcagcaagacgtgcattttatgaaaagatatccgaaaggacaacccgaattgcaaaagccgtttaagtacaccaccgtgacgaagcggtcccgcagaatcagaccaactcaccctgca

SEQ ID NO: 5470 - DNA, 621 bp, Artificial Sequence
  Description of Artificial Sequence: Synthetic coding sequence
atgtactccgccccctccgcctgtacttgcctttgccttcatttcctcctcctgtgcttccaagtgcaagttctggtggcagaggaaaacgtggacttccgcatccacgtggagaaccagactcgcgcccgggatgacgtgtcgcggaagcagcttagactctaccaactctactcgagaaccagcggtaagcatatccaggtcctgggacgccgcatctcggcgcggggcgaggatggagacaagtatgcgcagctgctcgtggaaactgatactttcggaagccaggtgcgcatcaagggaaaggagactgagttctacctgtgcatgaatcgcaagggaaagctcgttggcaagccggacggcacctcgaaagaatgcgtgttcatcgaaaaggtgctggaaaacaattacactgccctgatgtccgctaagtactcgggttggtatgtgggattcacgaagaagggcagaccacggaagggacctaagaccagggaaaaccagcaggacgtgcacttcatgaaacggtaccctaagggacaaccggaactccagaaaccatttaagtacaccactgtgaccaagcggtcgagacgcattcgccccacccatcctgct

SEQ ID NO: 5471 - DNA, 621 bp, Artificial Sequence
  Description of Artificial Sequence: Synthetic coding sequence
atgtactccgcgccctcggcatgcacgtgtctttgtctccattttctcctcctctgctttcaggtgcaagtgctggtcgccgaggaaaacgtggatttccggatccacgtcgaaaaccagactcgggcaagagatgacgtctcccgcaagcaacttcggctgtaccagctgtactcaagaacgtccggtaagcacatccaagtccttggacggcggatttcggcacgcggagaagatggagataagtacgcccagctgcttgttgaaaccgatacctttggatcacaggtgcgaataaagggaaaagaaaccgagttttacctttgcatgaatagaaagggaaagctggtgggtaaacctgatggtactagcaaggaatgcgtgttcattgaaaaggtgctggagaacaattacaccgcactcatgtcagcgaaatactcgggttggtacgtcgggttcactaagaagggtcggccacgcaagggacccaagacccgtgagaatcaacaggatgtgcacttcatgaagcgctacccaaagggccaaccagagctgcagaagccttttaagtacaccactgtgactaagagaagcagaaggattcggcctacccatccagca

SEQ ID NO: 5472 - DNA, 621 bp, Artificial Sequence
  Description of Artificial Sequence: Synthetic coding sequence
atgtactcggcaccttctgcatgcacgtgtctctgccttcactttctgctgctgtgtttccaagtgcaagtgttggtcgcagaggaaaacgtggattttcgtatccatgtggagaaccagaccagagcacgcgatgatgtcagccgtaagcagcttcggctgtaccagctgtactcaagaacgtccggaaaacatatccaggtgctcggccggcgcatttccgctagaggcgaagatggagacaaatacgcacaacttcttgtggaaactgatacttttgggtcgcaagtccggattaaaggaaaggaaactgagttttacctttgtatgaatcgcaaggggaagctcgtgggaaaacctgatggcactagtaaggaatgcgtgtttatcgaaaaagtgctggaaaacaattacaccgctcttatgagcgccaagtattcgggatggtacgtgggattcacgaagaaggggcgtccacggaaaggcccaaagacccgagagaaccagcaagacgtgcatttcatgaagagataccccaagggacaacctgagctgcagaagccattcaagtacaccactgtcacgaagcgcagcagaagaattcgccccacccaccccgct

SEQ ID NO: 5473 - DNA, 621 bp, Artificial Sequence
  Description of Artificial Sequence: Synthetic coding sequence
atgtactcggcgccgtcggcatgcacgtgcctttgtctccattttctcctgctgtgcttccaggtgcaagtgctcgtcgctgaagagaatgtggacttcagaattcacgtcgaaaatcagaccagggccagggatgacgtttcccgaaaacaacttcggctgtatcagctgtactcacgcacctcgggcaagcacatccaggtcctgggccggcgcatcagcgctaggggagaggatggagataagtacgcccaattgctggtcgaaactgacacgtttggatcacaggtgagaatcaagggaaaagaaacggaattctatctctgcatgaacagaaaaggaaagttggtcggaaagcccgacggaacgtccaaagagtgcgttttcatagagaaggtgctggaaaacaattacactgcgctgatgtccgcaaagtactcgggatggtacgtgggatttaccaagaagggaaggccgcggaagggtccaaagactcgcgagaaccagcaggatgtgcatttcatgaagagatacccaaagggccagcctgaactccaaaaacctttcaagtacacgaccgtgaccaaacggagccggagaatccggccgacccaccccgcg

SEQ ID NO: 5474 - DNA, 621 bp, Artificial Sequence
  Description of Artificial Sequence: Synthetic coding sequence
atgtattccgcaccttcagcttgtacttgcctgtgcctgcactttttgctactctgtttccaagtgcaagtcctggtcgctgaggagaacgtggattttcggatccatgtggagaatcaaacgcgggcaagagacgatgtcagtcgaaagcaactgcggctttaccagctttacagccgcactagtggcaagcatatccaggtgctcggacgtcgtatctccgcccgcggcgaagatggggataaatatgctcagcttttggttgagactgacactttcggatctcaggtgcgaatcaaagggaaggagaccgagttctatctatgtatgaatcggaagggaaagttggttggcaagccagatggcacatccaaagaatgtgtttttatcgaaaaggtgctcgagaacaactatacggcgctgatgtccgctaaatattctggctggtacgtgggattcaccaagaagggcaggccacgcaaggggcctaagaccagggaaaaccagcaagatgttcatttcatgaaacgctaccctaagggacagccagagttacagaaaccatttaagtacacaacagtcaccaaaaggtcacggaggatcaggccaacccacccagct

SEQ ID NO: 5475 - DNA, 621 bp, Artificial Sequence
  Description of Artificial Sequence: Synthetic coding sequence
atgtattctgcccccagtgcgtgtacctgcttatgcctgcatttcttactgttgtgtttccaggtgcaggtgctggtcgccgaggagaacgtcgatttccgaatccatgtggaaaatcagaccagagctagagatgatgtgtctcgcaaacagttgcgtctttatcagctttatagtcggactagtggcaagcatatccaggtattggggcgccggatctccgctcgaggggaagacggtgataaatatgcacaactacttgtggagaccgatactttcgggagccaggtccgaataaaggggaaagagaccgaattctacctctgtatgaatcggaagggcaagttggtgggaaagccagacgggacctccaaggagtgtgtgtttattgagaaagttctggaaaataactatactgctctcatgagcgccaagtatagcggatggtatgtgggctttactaaaaaggggcgcccaaggaaggggccaaagacccgggagaaccagcaagacgtacattttatgaagcggtatcctaaaggccagcctgagctccaaaagccattcaaatacacgaccgtcacaaaacggagtagacggattagacctactcatccagcc

SEQ ID NO: 5476 - DNA, 621 bp, Artificial Sequence
  Description of Artificial Sequence: Synthetic coding sequence
atgtattccgcaccctcagcgtgtacgtgtttgtgtctgcatttcttgttgctgtgttttcaagtgcaagtattggtggcagaagagaatgtagactttcgcattcatgttgagaatcagacacgcgcgcgcgatgatgtttcaagaaaacaacttcgtctttaccaactttactcaaggacatcaggaaaacatatacaagtgctgggccggcgcatctccgcgcgcggcgaagatggtgataaatacgcgcagctgctggtcgaaacagatacctttggctctcaagtccggataaaaggcaaagagacagagttttatctttgcatgaaccgcaaagggaagttagttggtaaaccagatggaacatcaaaagaatgtgtatttatcgagaaagtccttgaaaataattatacggcgctgatgtcagccaaatattcgggctggtatgtcggatttacaaaaaaaggcagaccgcgtaagggacctaaaacaagagagaatcagcaagatgtgcattttatgaagcggtatccgaaaggccagcctgagctgcaaaaaccgtttaaatatacgactgtcacaaaacgcagcagacggattcgtccaacgcatccagct

SEQ ID NO: 5477 - DNA, 621 bp, Artificial Sequence
  Description of Artificial Sequence: Synthetic coding sequence
atgtactcggcgccttcagcatgtacctgcttgtgtctccattttctgctgctgtgtttccaagtgcaagtgctggtcgctgaagaaaatgtggactttcggatacatgtggagaaccaaacgagagcccgcgatgatgtctcccgaaagcagttgcgactgtaccagctctacagccgcacctccgggaaacacattcaagtgctgggacgtcgtatttcagcacgtggagaagatggcgacaagtacgcccaacttcttgtggaaaccgatactttcggatcacaagtgagaatcaaagggaaggaaacggagttttacctgtgcatgaaccgcaaaggaaagctcgtcggcaaacccgacggaaccagcaaggagtgtgtgtttatcgagaaagtcttggaaaacaattacactgcgctgatgtcggccaagtactcaggttggtatgtcggcttcaccaagaaaggccggccacgcaaaggaccaaagactcgcgaaaaccagcaagacgtgcactttatgaaaaggtaccctaaaggacagcctgagcttcagaaaccctttaagtacaccacggttacgaagcgatcgagaaggattcgtccgacccatcccgca

SEQ ID NO: 5478 - DNA, 621 bp, Artificial Sequence
  Description of Artificial Sequence: Synthetic coding sequence
atgtacagcgctccatccgcatgtacttgtctttgcttgcacttcctcctgctgtgcttccaggtccaggtgctcgtggccgaagaaaacgtggatttcagaatccatgtggagaaccagactcgcgcgagggatgatgtgtcacggaagcagctgcgcctgtaccagctgtactcgcggacctcgggaaaacatatccaagtgctcgggcgcagaatctcagcgcgcggagaagatggagataagtacgctcagctcctcgtcgagactgataccttcggatcgcaagtgagaattaagggcaaagagactgagttttacctgtgcatgaacagaaaaggcaagctggtgggaaaaccggatggcacctcaaaggaatgtgtctttatcgagaaggtcctggaaaacaactacactgcacttatgtccgctaaatactcgggatggtacgtaggtttcactaagaagggtcggcccagaaagggccccaaaactagagagaaccagcaagacgtgcacttcatgaagcggtacccaaaaggccagccggaactgcagaagcctttcaagtacacgactgtcaccaagcggagccgtcgcatccggccgacgcaccctgcc

SEQ ID NO: 5479 - DNA, 621 bp, Artificial Sequence
  Description of Artificial Sequence: Synthetic coding sequence
atgtattcagcaccatccgcatgtacatgtctgtgccttcacttcttgctcctttgttttcaggtccaggtgctcgtcgccgaagaaaacgtggattttaggatacatgtggaaaatcagacaagagctagggatgatgtttctaggaaacagcttcgactctatcagctgtattccaggacttctgggaagcacatccaggtgctgggaagaagaatctctgccaggggagaggatggggataaatatgcgcagttactggttgaaacagacacattcgggtcccaggtcagaatcaaaggaaaagaaactgaattttatttatgcatgaatagaaaaggaaagctagtgggaaagcccgatggaacttctaaggaatgcgtgtttatagaaaaagtgctggaaaataattatactgcactcatgtccgctaaatactccggatggtatgtggggttcacaaaaaaagggagaccccggaaaggacctaaaacaagggaaaaccagcaggacgtccacttcatgaaacggtaccccaaagggcagcctgagcttcaaaaacccttcaaatatactacagtgactaaaaggtcaagacgaatcagacctacacatccagca

SEQ ID NO: 5480 - DNA, 621 bp, Artificial Sequence
  Description of Artificial Sequence: Synthetic coding sequence
atgtactcagcgccctccgcatgcacctgcctgtgccttcatttcctgttgctttgtttccaggtacaagtgctcgttgctgaagaaaatgtcgactttcgaattcacgtggagaatcagaccagggcaagagatgatgtgagtaggaagcaactgaggttataccagctgtattccaggacctcaggaaaacatattcaggttcttggcagaagaatctctgctcgcggtgaagacggcgacaagtacgcccaactcctggttgagactgacacctttgggtcccaggttcgcataaaggggaaagaaaccgaattctacctctgcatgaatcgcaaggggaaactggtgggaaagccagacggaacctcgaaagaatgtgtatttatagagaaggtgttggagaacaactatactgctcttatgtccgctaaatacagcgggtggtatgtgggctttacgaaaaagggaagaccgcgcaaggggccgaaaactcgcgagaatcagcaagatgtccactttatgaaaagatacccaaagggtcagccggagcttcagaaacctttcaagtacacaactgtgactaagcgaagtagaagaattcgtccaacccacccagcc

SEQ ID NO: 5481 - DNA, 621 bp, Artificial Sequence
  Description of Artificial Sequence: Synthetic coding sequence
atgtattctgcaccatcggcttgtacgtgtctttgtcttcacttcttgttgctttgtttccaagtgcaagttcttgtggccgaagagaatgtagatttcaggatccatgttgagaatcaaactagagcccgggacgacgtttcaagaaagcaactgcgcctttatcagttatactcacgtacttctggtaagcatatccaggttcttggtcgccgtattagtgctagaggcgaggatggcgataagtacgcacaactactggtcgaaactgacacatttggttcccaagtccggatcaaaggaaaagagacggaattctacctatgtatgaacaggaagggaaagttggtgggtaaacctgatggaacttctaaggaatgtgtttttatcgaaaaggttttagaaaataattacactgcgttgatgtctgccaagtactctgggtggtacgtcggtttcacaaagaaggggaggccgcggaaggggcccaaaacaagggagaaccaacaggatgtgcatttcatgaagcggtatcctaaggggcagcctgagctccaaaagcctttcaagtataccactgtcactaaaagatcacgacgaatccgccctacacatcccgct

SEQ ID NO: 5482 - DNA, 621 bp, Artificial Sequence
  Description of Artificial Sequence: Synthetic coding sequence
atgtactcagcaccttcggcgtgtacctgtctctgccttcacttcttgctgctctgttttcaggtccaggtgctcgtggccgaggaaaacgtggattttcggattcatgttgagaatcagacgagagcgagggacgatgtgtcgcgaaaacaacttcgcttgtaccagctttactcaagaacttcggggaagcatatccaagtgcttgggcggcgcatctcggcccgaggtgaagatggagataagtatgcccaactgctcgttgagactgatacttttggtagccaggtgcggattaagggaaaggagactgaattctacctctgcatgaatcgcaaaggtaagctggtgggaaagccggatggaacgtctaaagaatgtgtgtttattgaaaaggtccttgagaataactataccgcactgatgtcggccaaatacagcggatggtacgtgggatttaccaaaaagggacgaccgagaaaaggtccaaaaacccgcgaaaatcaacaagatgtgcatttcatgaaacggtacccaaagggccagccggaactgcaaaagccattcaaatacactaccgtgactaaaagaagcaggagaataagaccaacccatcccgca

SEQ ID NO: 5483 - DNA, 621 bp, Artificial Sequence
  Description of Artificial Sequence: Synthetic coding sequence
atgtacagcgccccaagcgcgtgcacttgcctctgtctgcacttcctgctcctttgttttcaagtgcaagtgcttgtggcagaagagaacgtcgacttcagaatccatgtggaaaaccagactcgagcgagggatgacgtgagccgtaagcagctccgcctctaccagctgtactcaaggacctcggggaaacacatccaggtgctcggccgccgcatttcagctcggggagaggacggtgataagtatgctcagcttctcgtcgaaaccgacaccttcggtagccaggtcagaatcaaaggcaaagaaactgagttttacctttgcatgaacagaaaaggcaaactggtgggaaagccagacggcacttccaaagagtgcgtgttcatcgaaaaggtgttggagaataactacacggcacttatgagcgccaaatactcgggatggtacgtcggcttcaccaaaaagggacgcccgcgaaaaggaccaaagacgagggaaaaccaacaggatgttcacttcatgaaacgctaccctaaagggcaaccggagctgcaaaagcctttcaaatacactacggtgactaagagatctcggaggatccgcccgacgcatccggcc

SEQ ID NO: 5484 - DNA, 621 bp, Artificial Sequence
  Description of Artificial Sequence: Synthetic coding sequence
atgtactctgcgccctctgcatgcacatgtctctgcctacacttcttgctgctctgtttccaagtgcaggtgctggtggcagaagagaacgtcgacttccgtatccacgttgagaaccaaacacgcgcacgcgacgacgtttctcggaagcagctccgcctttaccagctctactcccgtactagcggtaagcatatccaggttctagggcgccgtatctccgcccggggtgaggacggggacaagtacgcccaattgctggtcgagaccgatacgttcggatcgcaggtccggattaagggcaaggagaccgagttctacctttgcatgaaccgcaagggtaagctagttggaaagcctgacggtacctctaaggagtgtgtgttcattgaaaaggtgttggaaaacaactacaccgccttgatgtcggccaaatattcaggatggtacgtcggcttcaccaaaaaaggtcgcccgcgtaagggcccgaaaacccgtgaaaaccagcaggacgtgcactttatgaagcgataccctaagggtcaaccagagctccagaagcctttcaagtacaccacggtcacaaagcgctcccgacggatccgacctactcacccagcc

SEQ ID NO: 5485 - DNA, 621 bp, Artificial Sequence
  Description of Artificial Sequence: Synthetic coding sequence
atgtactcggcaccgtcagcttgcacctgcctgtgcctccatttcctgctcctttgctttcaagtgcaagttttggtggccgaggaaaatgtggacttcagaatccacgtggagaaccaaacccgggcacgcgacgatgtgtcgcgcaagcagctcagactgtaccaactgtactcgagaacttcgggcaagcacattcaggtgctcggtaggcgcatctcagcacggggggaggacggggacaagtacgcccagcttttggttgagacggacaccttcgggagccaagtccgaatcaagggaaaggagactgagttttacctgtgtatgaatagaaaaggcaagctcgtgggcaaaccggacggtacttcgaaggaatgtgtgttcattgagaaggtcctggagaataactacaccgccctgatgtcggccaagtactctggatggtacgtgggcttcaccaaaaaggggcgccctcggaaaggcccaaaaactcgcgagaaccagcaggacgtgcatttcatgaagcgctacccgaagggacaaccagaactccagaaacctttcaagtacaccaccgtgactaagcgcagcaggaggatccggcctactcaccctgcc

SEQ ID NO: 5486 - DNA, 621 bp, Artificial Sequence
  Description of Artificial Sequence: Synthetic coding sequence
atgtactccgctccttcagcgtgtacctgtctctgtctgcattttctcctgctgtgttttcaagtgcaagttctcgtcgcagaggaaaatgtggacttcaggattcacgtggaaaatcaaacccgggcaagagatgatgtgtcaaggaaacaactgcgcctgtaccagctttactcaagaacctccggcaagcacattcaggtgctggggagaaggataagcgccagaggagaggacggggacaagtacgcgcaacttttggtggaaactgacacctttggcagccaagtgcggattaagggtaaagaaacggagttctacctttgtatgaaccgtaagggtaagctggtcggaaagccggacgggacttcgaaggaatgcgtctttatcgaaaaggtgctggagaacaattacaccgcattgatgtccgccaagtacagcggttggtacgtgggattcaccaaaaagggtcggcctcgaaagggacccaagacccgcgaaaaccagcaagatgtgcatttcatgaagcgctacccaaagggacaacctgaactgcaaaagcctttcaagtacactacggtgaccaagaggtccaggagaattcggccgacccatccagcc

SEQ ID NO: 5487 - DNA, 621 bp, Artificial Sequence
  Description of Artificial Sequence: Synthetic coding sequence
atgtatagtgcaccgtcggcttgtacatgcctgtgccttcattttctgttactgtgctttcaggtccaggtcttagtcgccgaagaaaatgttgatttcagaatacatgtggaaaatcagacgagggcgcgggatgatgtgtcgcgtaaacagctgcgcttatatcagttatactcgcgcacaagtggaaagcacatccaggtactaggccggcgtatatctgctaggggggaggatggcgacaaatatgctcagctgcttgtggaaaccgatacgttcggatcgcaggtccgcatcaaaggtaaggagactgaattctacttgtgtatgaaccgaaagggaaagctggtgggaaagcctgatggaaccagtaaggagtgcgtttttatcgaaaaggtcttggagaataactatacggcacttatgtcggccaagtattcgggatggtatgtgggcttcaccaagaagggtcgccctcgtaagggccctaagacacgcgaaaaccaacaagatgttcattttatgaagaggtaccctaagggacaaccagagctacagaagcccttcaagtataccactgtgacaaaaaggtcgcggcgcatccggcccacccatcctgct

SEQ ID NO: 5488 - DNA, 621 bp, Artificial Sequence
  Description of Artificial Sequence: Synthetic coding sequence
atgtactccgcgccttccgcatgcacctgcctgtgcttgcactttctgttgctgtgtttccaggtgcaggttctggtggctgaggaaaacgtggatttcagaatccacgtcgaaaaccagacccgcgccagggacgatgtctcccgcaaacaactgagactctaccagctctactcccgcactagcggaaagcacatacaggtcctggggcggcggatctccgctcgaggagaggacggggacaagtacgcccagctgttggtcgagactgataccttcggctcccaggtgagaatcaagggaaaggaaactgagttctacctctgtatgaatcgcaagggcaagctcgtgggaaagccagacggaacttcaaaggagtgtgtgtttatcgagaaggtcctggagaataactacactgcactcatgtcggccaagtacagcgggtggtacgtggggttcaccaagaagggacgcccgcggaaaggtcctaagacccgcgaaaaccaacaggatgtccactttatgaaaagatacccgaagggtcagccggagcttcagaagccgttcaagtacacgaccgtgactaagcgctcgagaaggatccgccctactcatccggcc

SEQ ID NO: 5489 - DNA, 621 bp, Artificial Sequence
  Description of Artificial Sequence: Synthetic coding sequence
atgtattctgccccttcagcctgcacctgcctgtgtctccacttcttgctgctctgtttccaagtgcaggttttagtggccgaggaaaacgtggatttcagaatccacgtggagaaccaaacccgcgcacgagacgacgtcagtcgcaagcagctgaggttgtatcagctctactctcggactagtgggaagcatatccaggtgctcggcagacgaatatctgcccggggggaggacggagacaaatatgctcagcttcttgtggagacagatactttcggatcccaagttcgcattaagggtaaagagactgagttttatctatgtatgaaccggaaaggcaaactagtgggaaagccggacggcacctcaaaagagtgtgtgtttatcgagaaggtcctggagaataattacactgcactgatgagtgctaagtactccggatggtacgtcggtttcactaaaaaagggaggcctcgaaaagggccaaaaacgcgggaaaaccaacaggatgtgcacttcatgaagaggtatccaaaaggacagccagagctgcagaaacccttcaaatacacaacagtgacaaagaggtctagaaggatccgtccaactcatcctgcc

SEQ ID NO: 5490 - DNA, 621 bp, Artificial Sequence
  Description of Artificial Sequence: Synthetic coding sequence
atgtactcggccccgagcgcatgcacgtgcctgtgcctccattttctgttgctgtgcttccaggtccaagtcctcgttgcggaagaaaacgtggatttcaggatccacgtggaaaatcaaacgcgtgccagagatgacgtgtccagaaagcaactgagattgtatcagctttactctcgcacgtcaggtaagcacatccaggtcctgggccgcagaatttcggcgcgcggcgaagacggcgataagtacgcgcagctcctggtggaaactgacacctttggttcacaggtccgcatcaagggaaaggaaaccgagttttacctctgcatgaacaggaaaggaaagctggtgggcaagccggacggcacttcaaaggagtgcgtgttcatcgaaaaggtccttgagaataactatactgctctgatgtcggcgaaatactccggctggtacgtgggattcactaaaaaaggacgccctcgcaagggaccgaagacccgggaaaaccaacaggacgtgcacttcatgaagaggtacccaaaggggcaacccgaactgcagaagccgttcaaatacaccaccgtgaccaaaaggtcacgccggattcgtccaactcatccggcg

SEQ ID NO: 5491 - DNA, 621 bp, Artificial Sequence
  Description of Artificial Sequence: Synthetic coding sequence
atgtacagtgccccctcggcttgcacttgcctctgccttcattttctgctgctgtgcttccaggtgcaagtgctggtggctgaagaaaacgtggacttccggatccatgtggaaaaccagaccagagcgcgcgacgacgttagccggaaacagctgcgcctgtaccagttgtatagccgcacttccggaaagcatatccaggtcctgggtaggcgcatttcagccaggggagaggacggcgataagtacgcgcaactgctcgtcgagacggacactttcggctcccaggtgagaattaagggtaaagaaaccgaattctacctctgcatgaaccgaaaggggaagctggtgggaaagcccgacgggacctcgaaggagtgcgtgttcatcgagaaagtcctggagaacaattacaccgccctgatgtcggccaagtactcggggtggtacgtcggctttaccaagaagggtagaccgcggaagggcccgaaaacgcgggaaaatcaacaagacgtgcacttcatgaaaaggtacccaaaggggcagccagaacttcagaaaccattcaaatacacgaccgtcaccaagcggtcaaggcgcatcagacccacccatccggcc

SEQ ID NO: 5492 - DNA, 621 bp, Artificial Sequence
  Description of Artificial Sequence: Synthetic coding sequence
atgtactcagctcccagcgcatgcacctgcctttgccttcatttcctcctcctctgctttcaggtccaggttttggtagctgaggagaatgtcgactttcggatccacgtggaaaatcagacccgcgctagagacgacgtaagcaggaaacaactcaggctctatcaactgtactctagaacatctggaaaacacatccaggtgctcgggaggcgcatttccgcacgcggagaggacggggacaagtatgctcagcttttggtggagacagacactttcgggtcccaggtgaggataaagggaaaggagacggagttttatctctgtatgaacaggaaagggaagctggtgggcaagcccgatggcacttctaaagagtgcgtgttcatcgagaaggtactggagaataattacaccgcacttatgagtgctaaatatagtgggtggtatgtggggttcacaaagaaggggcggccacgcaaaggccctaagactagggaaaatcaacaggacgtgcacttcatgaagcggtatcccaaaggccagcccgagctccagaagcctttcaagtatactaccgtgactaagcggtcaagaaggatccgccccactcacccagca

SEQ ID NO: 5493 - DNA, 621 bp, Artificial Sequence
  Description of Artificial Sequence: Synthetic coding sequence
atgtattctgcaccaagcgcgtgcacgtgcctgtgtctgcattttctgttgctgtgcttccaggtccaggtccttgtggctgaggagaacgttgatttccgaatacacgtggagaatcagacacgtgcacgggacgatgtctccaggaagcaattaaggctttaccagctgtattctcgcacaagtggaaaacacattcaggtcttggggaggcgaatcagcgctaggggagaggacggcgataagtatgcccagctgctggtggagacagatactttcggttcacaggttcgcatcaaggggaaggaaactgaattttatctctgcatgaataggaaaggaaaattggtggggaaacctgatggaacctctaaggaatgcgtttttatcgaaaaggtgctggagaacaactacacggctctgatgagcgccaaatactctggatggtatgtgggattcacgaagaagggaaggcccagaaaagggcccaagaccagggagaaccagcaagatgtgcacttcatgaaaaggtatcctaaaggacagccagaacttcagaaaccttttaaatatacaactgtgaccaagcgcagtcggcgaattcgtccaacccacccagct

SEQ ID NO: 5494 - DNA, 621 bp, Artificial Sequence
  Description of Artificial Sequence: Synthetic coding sequence
atgtactccgccccgagtgcctgcacatgtctttgcttacacttcctactgctgtgttttcaagtgcaggttcttgtggccgaggagaacgttgacttccgaatacatgtggagaaccagactcgggccagggatgatgtttcacggaagcagctgagactgtaccagctgtatagtaggacttcagggaagcacattcaggtgttaggtcgaaggataagtgcccgcggcgaagatggtgacaaatacgctcaactccttgtagagacagatacattcggctcccaggtgagaatcaaggggaaggagaccgaattttacctctgtatgaaccgtaagggcaagcttgtgggcaaacctgacgggacaagtaaggagtgcgtgtttatcgaaaaagtgttggagaacaattacacagccttgatgagcgctaagtacagtggatggtacgtgggctttactaaaaagggccgtccaagaaagggacccaaaacaagagagaaccagcaggacgtgcattttatgaagcgttatcccaagggacagcctgaacttcagaagcctttcaaatacaccactgtgaccaaaagatctagacgaattcgtccaacccatccagca

SEQ ID NO: 5495 - DNA, 621 bp, Artificial Sequence
  Description of Artificial Sequence: Synthetic coding sequence
atgtactctgctcccagtgcttgcacatgtctttgtttgcattttttgcttctttgtttccaagtgcaagtgttagttgctgaagagaatgtcgatttccgtatccacgtcgaaaaccagactcgggctcgtgatgacgtctcacggaaacaattaagactttaccaactatactcaagaacatcaggcaagcatattcaggtcctcggaaggagaatttcggctagaggcgaagacggggataaatacgcacagttgcttgttgaaactgatacattcggatcacaagtgagaattaagggtaaggaaacagagttttatctatgcatgaatcgaaaaggaaagctggttggaaaaccggatggaacaagtaaagagtgtgtttttatcgaaaaggtgttggaaaacaattacactgcactaatgtcagctaaatattccggatggtatgttggtttcactaagaaagggcgtccacgtaaaggaccaaaaactcgtgagaaccaacaagatgtgcattttatgaaacgatacccaaagggacaaccagaactccaaaagccgtttaaatatactacagtcacgaaaaggtcacgacgtatccggccaacacatccagca

SEQ ID NO: 5496 - DNA, 621 bp, Artificial Sequence
  Description of Artificial Sequence: Synthetic coding sequence
atgtactcggctcccagtgcctgcacatgtctctgcttacatttcttgctgctgtgtttccaggtgcaagtactagtggccgaagagaacgtagacttccggatccacgttgagaatcagacacgcgctagggatgatgtcagtcgtaaacagcttcgcttgtatcagctctactctagaaccagtggtaaacatatacaggtccttgggagaagaatcagcgctcggggggaagatggggataagtacgctcagctcttagtggaaacagacacgttcggtagccaggtgaggatcaaagggaaggagacggaattttatttatgcatgaatagaaagggaaagctggtgggcaagcctgacggcacctccaaagagtgtgtgtttatcgagaaagtgttggaaaacaactacacagccctgatgtcggccaaatattccggttggtacgttggcttcacaaagaaggggcgaccacgcaaaggccctaagacacgtgaaaaccagcaggatgtgcattttatgaagaggtatccaaagggacagccagaactgcagaaacccttcaaatatacgactgtcacaaaaaggtccaggaggatccgaccgacccaccctgcc

SEQ ID NO: 5497 - DNA, 621 bp, Artificial Sequence
  Description of Artificial Sequence: Synthetic coding sequence
atgtacagtgccccatccgcttgcacttgtctgtgtctgcactttttgttactgtgttttcaggttcaagtccttgtcgcagaagaaaatgtggattttcgcattcacgttgaaaaccagaccagggccagggacgatgtatcacgaaaacagcttcgattgtaccagttgtactcacggacatcaggcaagcatatccaggtgcttggtaggcgcatttctgcccgtggcgaggatggggataagtacgcccagctgctggtagaaacagatacatttggatcacaggttaggattaaaggcaaagaaaccgagttttatctgtgcatgaacagaaaggggaagctcgtcgggaaaccagatggcacgtcaaaagagtgtgttttcatcgagaaggtgctggagaataactacactgcacttatgtccgccaagtatagcggctggtatgttgggtttactaaaaaaggtcgaccaagaaaaggccctaagacgagagagaatcagcaggatgtccactttatgaagcgctatccaaagggacaacccgagttgcagaaacccttcaaatacaccacagtgacgaaaagatcccgtaggatccgacccacccaccctgcc

SEQ ID NO: 5498 - DNA, 621 bp, Artificial Sequence
  Description of Artificial Sequence: Synthetic coding sequence
atgtatagcgcgccgtcggcctgcacgtgcttgtgcctgcatttccttctgctgtgtttccaggtgcaggtgctagtagcagaggaaaatgtcgacttcaggattcatgtggagaaccagactcgagcccgcgacgacgtgagtagaaagcagctgcgattgtatcaactgtacagtcgaactagtggaaagcatattcaagtgttgggtcgccgtataagcgccaggggagaggatggcgacaagtacgcccaactgctcgtcgaaacggacaccttcggtagccaagtcagaattaagggcaaggaaacggagttctacctctgtatgaaccgaaagggaaagctcgttggcaagccagacggcaccagcaaggaatgtgtgtttatcgaaaaggtgctggaaaacaattataccgctctcatgagcgcaaagtactccggctggtacgtggggtttactaaaaagggacgcccccgcaaaggacccaaaaccagagaaaatcaacaggatgtgcacttcatgaagcggtaccccaagggccaaccggagttacagaagccatttaagtacaccactgtcactaagcggtcccgcagaatacgccccactcacccggcc

SEQ ID NO: 5499 - DNA, 621 bp, Artificial Sequence
  Description of Artificial Sequence: Synthetic coding sequence
atgtatagtgcacctagtgcgtgtacctgtttgtgccttcattttctgctgttatgttttcaggtgcaggtgttagtagcagaagagaacgtagactttcggatccacgttgagaaccaaacccgagctagagatgatgtatctagaaagcagcttcgtctgtatcagctgtacagtcgcacaagcggcaagcacatccaggtattgggccgtaggatctcagctagaggggaggatggagataagtatgcccaactactggtcgaaaccgacacttttggaagtcaggtgcgcatcaaagggaaggagacggaattctacttatgcatgaatcggaagggtaagttggtcggaaagccggacgggacaagcaaggagtgtgtgttcatcgaaaaagtgttggaaaacaattacaccgccttgatgtctgcaaagtactctggttggtatgtgggatttaccaagaaagggagaccaagaaaaggacccaagacacgggaaaatcaacaggatgtccactttatgaagcgctaccccaagggccagccggagctgcagaaaccgttcaaatatacaaccgtcaccaagcgcagccgccgcattcggccaacacatccggcc

SEQ ID NO: 5500 - DNA, 621 bp, Artificial Sequence
  Description of Artificial Sequence: Synthetic coding sequence
atgtacagcgctccgagtgcgtgcacctgtctgtgcttgcacttcctgctgctctgctttcaagttcaggtgttggttgctgaagagaatgttgacttcaggatccacgttgagaaccagaccagggcgagagatgatgtgtcaagaaaacaacttagactctaccagctttatagccggactagtgggaaacatatacaagtcctcgggaggcgcatctcagccaggggtgaggacggggacaagtacgcacagctgctcgtcgaaactgacaccttcggctcccaggtcaggatcaagggaaaagagaccgaattctatctttgcatgaaccgcaagggcaaactggttggaaaacctgacggcacatcaaaagaatgcgtctttattgagaaagttctggagaacaactacaccgcactgatgtcagcaaaatacagtggatggtacgttggtttcactaagaaaggcaggccacgaaaagggcccaaaacacgggagaaccaacaggacgttcacttcatgaaacggtacccaaagggtcagccagagttgcagaaacctttcaaatacactaccgtgacaaagcgctccagacgaattcgcccgacccaccccgcg

SEQ ID NO: 5501 - DNA, 621 bp, Artificial Sequence
  Description of Artificial Sequence: Synthetic coding sequence
atgtattccgccccctctgcttgtacctgcctgtgtttgcacttcctgctgttgtgctttcaggtgcaagtgctggttgccgaagaaaatgtggatttcaggatccacgtggagaaccaaacaagggccagagatgacgtatccagaaagcaacttaggctttatcagttgtattcaagaacatctggcaagcatatccaagtactcggtcgcaggatatctgccagaggcgaggatggagacaagtatgctcagctcttggttgagactgacacctttggctctcaagtgcgcatcaagggaaaggaaaccgagttctatctttgtatgaatagaaagggcaagcttgtcggtaaacccgacggaacaagtaaagagtgtgtctttatcgagaaagttctggagaacaattataccgctctgatgtctgccaaatactctggctggtatgtgggcttcaccaagaagggtagacctcgtaagggtcccaaaactagggaaaatcagcaggatgtgcatttcatgaaaaggtacccaaagggccagccagagttgcagaagcctttcaaatacaccacagtgaccaagaggtcccgtcgcatcagacccacccatcctgcc

SEQ ID NO: 5502 - DNA, 621 bp, Artificial Sequence
  Description of Artificial Sequence: Synthetic coding sequence
atgtacagcgccccgtcagcgtgcacatgcctgtgtctgcatttccttttgctttgttttcaggtgcaggttctggtcgccgaagagaacgtggatttccgtattcacgttgaaaatcagaccagagccagggacgatgtgtcaagaaaacaattgcgactttaccagctttattccagaacatccggtaagcatattcaggttctcggcaggcggatttccgcccgcggcgaggatggagataaatatgcacaattacttgtggaaacagacactttcgggtcgcaggtgaggattaaagggaaagagaccgagttctacttatgcatgaataggaaggggaaactcgtgggcaaacctgatggtacttctaaagaatgcgtgtttattgagaaggtgctggaaaacaactacacggcactaatgtctgccaagtatagcggctggtacgtgggcttcactaagaagggcagaccacggaaaggccctaagaccagagagaatcagcaggatgtacattttatgaaacggtatccaaaaggacagcccgagctgcagaaaccctttaagtatacaactgtcactaaacgatcacgccgtatacgtcccacccatccagct

SEQ ID NO: 5503 - DNA, 621 bp, Artificial Sequence
  Description of Artificial Sequence: Synthetic coding sequence
atgtacagcgctccttctgcctgcacttgtctctgcttgcacttcctgctgctgtgttttcaagtgcaagtcctggtcgctgaagaaaacgttgacttccgcatccacgtggagaatcaaactcgggcacgggatgatgtgtcccgcaagcagctgaggctgtatcagctctactcgcgaacctcgggcaagcacatccaagtgctgggaaggcggatctcggcaaggggcgaggacggagacaaatacgctcaactcctcgtggaaactgacactttcggatcacaagtcagaatcaaggggaaagaaactgagttttacctgtgcatgaacagaaagggaaaacttgtgggaaaaccggatggcacctccaaggagtgcgtgttcatcgagaaagtgctggagaacaactacaccgccctgatgtcggcaaagtattccgggtggtacgtgggattcactaagaagggcagacccagaaaaggaccgaaaactcgggagaatcaacaggatgtccactttatgaagcggtacccaaagggacagccagagctccagaagccattcaagtacactactgtgactaagaggagcagaaggattcgccccacgcacccggct

SEQ ID NO: 5504 - DNA, 621 bp, Artificial Sequence
  Description of Artificial Sequence: Synthetic coding sequence
atgtactcagcgccatcggcatgcacgtgtctttgtctccactttcttctgctctgtttccaagtgcaggtgctcgtggcagaggaaaatgtcgattttaggatacatgttgaaaaccagacgcgggcgagagacgatgtgtccagaaagcaactcagactttatcaactctactccagaacctcggggaagcatatacaagtgctgggtcgaagaatttcggctcggggagaagatggagacaagtacgcacaacttcttgtcgaaacggatactttcggttcgcaggtgcgcattaagggtaaagaaactgagttttacctttgcatgaatcgcaaggggaagctcgtgggtaagccagacggtacctcaaaggagtgcgtgttcatcgagaaggtccttgaaaacaactacactgctctcatgagcgcaaagtattccggctggtacgtgggctttaccaagaagggacggcctaggaaggggcccaaaaccagggagaaccagcaagacgtccactttatgaagcgataccccaaggggcaaccagaactgcagaagcctttcaagtacactactgtgactaagaggtcgcggcgtattaggccaacgcatcccgcc

SEQ ID NO: 5505 - DNA, 621 bp, Artificial Sequence
  Description of Artificial Sequence: Synthetic coding sequence
atgtattccgcaccctctgcctgtacctgtctgtgtctccacttcctacttctgtgctttcaagttcaggtgctagtcgccgaggaaaacgtggatttccgcattcatgtggaaaatcagacgcgcgccagagatgacgtttcaaggaagcagctgcgcctttaccagctgtactctcgtacttctgggaaacatatccaagtcctgggcagaagaattagcgcccgtggagaggacggcgacaagtacgcacaacttctggttgagacggatacttttggctcacaggtgcggatcaaaggcaaggaaactgaattttacctgtgcatgaatcgtaagggcaagttagtcggcaaaccagacgggacttctaaggagtgtgtctttatagagaaagttctggagaataattataccgcactcatgtccgctaaatacagcggatggtacgttgggttcaccaagaaaggcagaccccgcaagggaccgaagacacgagagaatcagcaggacgtacattttatgaagagatacccgaaaggacagccagagctccagaaaccatttaaatataccacggtaaccaagcgaagcaggaggatcaggcccacacaccctgcg

SEQ ID NO: 5506 - DNA, 621 bp, Artificial Sequence
  Description of Artificial Sequence: Synthetic coding sequence
atgtacagcgcgccttctgcttgcacttgtctgtgtctgcattttttattactttgtttccaggtccaggttctggttgctgaggagaatgtagactttcggatacacgtagagaatcaaaccagagcacgagacgacgtctcccggaaacagttgcgcctgtaccagctttacagcaggactagcggcaagcacatccaagttctgggaaggcgaatttctgctcggggcgaggatggggataagtacgctcagttgttagtggaaacagacacgttcggctcgcaagtgcgaatcaaaggcaaagaaaccgagttttatctttgtatgaacagaaaaggtaaactagtggggaagccggatggcacaagcaaagagtgcgtgttcatcgagaaagttctggaaaacaattacaccgctttgatgtctgccaagtacagtggctggtacgtgggcttcaccaaaaaggggcgcccgcgcaagggccccaagactcgggagaatcagcaggatgtgcacttcatgaagcgatacccaaaagggcagccagagttgcagaagccattcaagtacactaccgttacgaagagatctagacggatccgaccgacccacccagct

SEQ ID NO: 5507 - DNA, 621 bp, Artificial Sequence
  Description of Artificial Sequence: Synthetic coding sequence
atgtactcggcaccttcagcgtgcacctgcctgtgcctccacttcctgctcctgtgtttccaggtgcaggtgctggtggccgaagaaaacgtcgatttccgcatccatgtggaaaaccagactcgggctcgcgacgacgtgtcgaggaagcaactgcggttgtaccaactctactcgagaacttccggaaagcacattcaggtgctggggagacgcattagcgcgcggggagaagatggtgacaagtacgcccagctgctggtggaaaccgacacgtttggttcgcaagtccgaatcaagggaaaggaaaccgagttttatctctgtatgaatcggaagggaaaactggtgggtaagccggacggaacctcaaaggagtgcgttttcatagagaaagttctggaaaacaattacacggcgctgatgtccgccaagtactcggggtggtacgtgggattcaccaagaagggtcgccctcggaaaggtccgaaaactcgcgaaaaccagcaggatgtgcactttatgaagcgctaccccaagggacaaccagaactgcagaagccgttcaaatacaccaccgtgaccaagagaagccggcggatcagaccaacccacccggcc

SEQ ID NO: 5508 - DNA, 621 bp, Artificial Sequence
  Description of Artificial Sequence: Synthetic coding sequence
atgtacagcgctccctcagcatgtacttgcctgtgccttcacttcctcctactttgttttcaggtccaggtcttagtcgcagaagaaaacgtggatttccggatccatgtggagaaccagacacgagcccgcgacgacgtgagccgcaagcaactgagactgtatcagttgtattcccgaacaagcgggaaacatatccaggtgctcggtcgtcgaatttcagctaggggcgaagacggcgataagtacgctcaattgctagttgagacagacactttcgggtctcaggttcgcatcaagggcaaggagacagagttttacctatgtatgaacagaaagggcaaactcgtgggtaagccggatggtacatccaaggaatgtgttttcattgaaaaagtgcttgaaaataattacaccgctttgatgtccgcaaagtattctggatggtatgttgggttcaccaagaaagggcgcccccgcaaaggcccgaagacgagggagaaccaacaggacgtacatttcatgaaaagatatccgaaagggcaacctgaattacagaagcccttcaaatataccaccgttacaaagaggtctcgacggattcgtcccacccaccctgct

SEQ ID NO: 5509 - DNA, 621 bp, Artificial Sequence
  Description of Artificial Sequence: Synthetic coding sequence
atgtacagcgccccctcggcctgtacctgtctgtgtctgcactttctgctcctctgttttcaggtccaagtcctggtcgctgaggaaaacgtggacttccggatccacgtggagaaccagacccgcgctagagacgacgtgtcccgcaaacaattgcgcctgtaccagctgtactcgcggacctcagggaagcatattcaagtgctgggacggaggatcagcgcccggggcgaagatggagacaaatacgcccagctgctggtcgaaaccgataccttcggttcacaggtgaggattaaggggaaggaaaccgagttttacctgtgcatgaaccgcaaaggtaagctggttgggaagcccgacgggacttcaaaggaatgcgtgtttatcgagaaggtgctggagaacaactatacggcgctcatgtctgccaaatactcgggatggtatgtcggtttcaccaaaaagggacgaccgagaaaaggccctaagacccgggaaaaccagcaggatgtccactttatgaagcggtacccgaagggacagccagaactgcagaagccgtttaagtacacgactgtgactaaacggtcccgcagaatcagaccgactcatccagcc

SEQ ID NO: 5510 - DNA, 621 bp, Artificial Sequence
  Description of Artificial Sequence: Synthetic coding sequence
atgtattccgctccctcggcctgcacctgcctgtgtttacacttcctgttgctttgcttccaggtgcaggtgctcgtcgcagaagagaacgttgactttcggattcacgttgaaaatcaaacaagagctcgggatgatgtcagccggaagcagttacggctttatcaattgtattcacgtacttcaggaaaacatattcaagtgctgggacggcgaatctccgcgcggggagaagatggcgataagtatgctcaactgctcgttgagacagatactttcggctctcaagtccgaattaaggggaaagagacagaattctacctctgcatgaacagaaaaggaaagctggtgggaaaacccgacgggaccagcaaagagtgcgtgttcatcgaaaaggtgctagaaaataactacacagccttaatgtctgctaagtactcaggatggtacgtgggattcacaaaaaaaggcaggccgcgcaaagggcccaagactagagagaaccagcaggacgtgcacttcatgaagcggtatcctaaggggcagcctgagctccaaaaacccttcaaatatacgaccgtaaccaaaaggagccgccggattaggccaacccatcctgcc

SEQ ID NO: 5511 - DNA, 621 bp, Artificial Sequence
  Description of Artificial Sequence: Synthetic coding sequence
atgtacagtgccccatccgcctgcacctgcctttgtctgcattttctgctcctctgtttccaagtgcaagtcctggtggctgaagaaaacgtcgatttccgcatccacgtggagaatcagactagagcacgggacgacgtcagtcgcaagcagcttcggctgtaccagctttatagccgcaccagcggtaagcacatccaggtcctcgggaggcggatcagtgcgaggggagaagatggagataaatacgcgcagctcttggttgaaactgatacctttggatcacaggtccgcattaaagggaaggagacggaattttacctctgtatgaacagaaagggtaaactcgtgggcaaacccgacggaactagtaaagagtgcgtgttcatcgagaaggtcctggaaaacaactacacagctttgatgtccgccaagtacagcggttggtatgtgggattcactaagaagggacgccctagaaaaggtccgaagactcgggagaatcagcaggacgtacacttcatgaaaagatatccaaagggacagcccgagcttcagaagccattcaaatatacaacagtcaccaagcgctcccgccgaatcaggccgacccacccggct

SEQ ID NO: 5512 - DNA, 621 bp, Artificial Sequence
  Description of Artificial Sequence: Synthetic coding sequence
atgtacagcgctcccagtgcttgcacctgcctgtgcctccactttcttctactgtgtttccaagtacaggtgttggttgccgaggagaatgtagactttaggatccacgtggagaaccaaaccagggctcgcgacgatgtgagccgaaagcagctcaggttgtaccaattgtacagtcgcacatccggcaagcacatacaagtgctgggcaggaggattagcgcccggggtgaggatggcgataagtacgcacagcttcttgtcgagaccgacacttttggctcccaggttcgcatcaaagggaaggaaactgagttctatctctgcatgaacaggaaggggaagctggtgggcaagcctgacggaactagcaaggagtgtgtctttatagagaaagtcctcgagaataactacacggctcttatgagcgctaagtatagcggttggtatgtcgggtttacgaagaaaggtcggccacggaaagggcccaaaactagagagaaccagcaggatgttcatttcatgaagcgttatccaaaggggcagcctgagctgcagaagcctttcaaatatactacagtgaccaagaggagccgacgcatccggcccactcatcccgcc

SEQ ID NO: 5513 - DNA, 621 bp, Artificial Sequence
  Description of Artificial Sequence: Synthetic coding sequence
atgtatagtgccccctctgcttgcacatgcctgtgtctacatttcctgctgctctgctttcaggtgcaggtgctggtcgccgaggaaaacgtggattttaggatccatgttgagaaccagacgcgggcgcgcgatgacgtgtcaaggaagcagctgcgcctgtaccagctgtatagtagaactagcgggaagcacatccaggttctcggacgccgtattagcgcaaggggggaggatggggataagtatgcccagctcttagttgaaactgatacatttggatcccaggtaaggatcaagggcaaagaaacggagttctacctctgcatgaatagaaagggaaaactggttggcaagcctgatggtacatcgaaggagtgtgtcttcatcgaaaaggttttagaaaataactataccgccctcatgtcagctaaatatagcggttggtacgtcggttttaccaagaaggggcggccacggaaaggtccaaaaacaagggagaaccagcaagacgttcacttcatgaagagatatcctaagggacagcccgagcttcagaaaccatttaagtacacgactgtgacgaaaaggtcgagacggatacggcctactcaccctgca

SEQ ID NO: 5514 - DNA, 621 bp, Artificial Sequence
  Description of Artificial Sequence: Synthetic coding sequence
atgtattccgccccctccgcgtgcacatgcctgtgtctgcatttccttctgctgtgcttccaggtgcaggtgcttgtggctgaagagaacgttgacttcaggattcatgttgagaatcagacaagggcaagagacgatgtttctaggaagcagcttcgcctgtaccaattatactctagaacgtccggcaaacacatccaggtactcggacgacgcattagtgccagaggcgaagacggcgataagtatgctcagcttctagtcgagacagacacattcgggtctcaggtgagaatcaagggcaaggagaccgagttctatctgtgcatgaacaggaaggggaaactagtgggcaagcctgatgggaccagtaaagagtgcgtctttatcgagaaagtgttggaaaacaactacaccgctctgatgagtgccaagtactcaggatggtacgtaggatttacaaaaaagggccggccccggaagggcccgaaaaccagggaaaaccagcaggatgtgcacttcatgaagcgctaccccaaaggccagcccgaacttcagaaacctttcaagtacaccacagtgactaagaggagcaggaggattagaccaactcaccccgct

SEQ ID NO: 5515 - DNA, 621 bp, Artificial Sequence
  Description of Artificial Sequence: Synthetic coding sequence
atgtacagtgctccatctgcctgtacttgtctgtgtctccactttctcttactgtgtttccaggtccaggttctagtggccgaagaaaatgttgatttcagaatccacgtcgaaaaccagactagggccagggacgatgtttcacgtaagcaactgcggctctaccagttgtactcgaggacttccgggaaacatattcaggtcctgggacgccgaataagcgcgagaggtgaagatggtgacaaatacgcgcagctactagtggagactgacacgttcggctcacaggtgcggataaaaggaaaagaaactgagttctacttatgtatgaataggaaagggaagctggtggggaagcctgacggaacatcaaaagaatgtgtttttattgagaaggttctagagaacaactacaccgctctgatgtcagctaagtactcggggtggtatgtgggcttcaccaaaaagggaagaccacgaaagggacctaagacacgcgagaatcagcaggatgtccacttcatgaaaaggtaccccaaggggcagccagaactccagaaaccatttaagtacacgacagttacgaagcggagccgtagaattaggcctactcacccggcc

SEQ ID NO: 5516 - DNA, 621 bp, Artificial Sequence; identical to SEQ ID NO: 5475
  Description of Artificial Sequence: Synthetic coding sequence

SEQ ID NO: 5517 - DNA, 621 bp, Artificial Sequence
  Description of Artificial Sequence: Synthetic coding sequence
atgtactccgcaccttcagcttgcacatgcttatgtcttcactttttgttgttgtgctttcaggtacaggtactcgtcgcagaggagaatgtcgactttaggatccacgtggaaaatcagacacgagcccgcgacgacgtttctcgaaagcagctgcgcctttaccagctctacagccgcaccagcgggaagcacatacaggtcctaggccggaggattagtgccagaggcgaggatggagataagtatgctcagctgctcgtagagacagatacctttggcagccaggttaggatcaagggaaaagaaaccgaattctatctctgcatgaaccgtaaaggtaagttggtgggaaaacccgatggcacctcgaaggagtgtgtgttcatcgagaaagtgctggaaaacaattatacagcactcatgtcggctaagtactccggctggtatgtcgggttcacgaaaaaagggcgtccaaggaagggtccaaaaactagagagaatcagcaggacgttcacttcatgaagagatacccaaagggccaaccggagctgcaaaagcccttcaaatataccactgtgacaaaacgctctcggcgcattcgtcctacccaccctgcc

SEQ ID NO: 5518 - DNA, 621 bp, Artificial Sequence
  Description of Artificial Sequence: Synthetic coding sequence
atgtactcagctccttcggcatgtacctgcctgtgtttgcacttcctgctgctgtgctttcaggtccaagtcctggtggctgaagaaaacgtggactttaggatccacgtcgaaaaccaaactcgtgcacgcgatgatgtgtcaagaaaacagctgcgcctctaccaactgtacagcagaacttcaggaaagcatattcaagtccttggtagacggatctcggcaagaggtgaggacggagataagtacgcccagctgctcgtggagactgacacctttgggtcccaagtccggattaaggggaaggagactgaattctacctttgtatgaaccgaaaaggcaaacttgtgggcaagccggatggtacctcgaaagaatgcgtgtttattgagaaagtgcttgaaaacaactacaccgcgctgatgtcagcaaagtatagcggctggtacgtgggctttaccaagaagggacgtccacggaagggacccaaaacccgcgagaaccagcaggatgtccacttcatgaaaagataccctaagggacaacctgagctgcagaagcctttcaaatacaccaccgtcactaaaagatcacggagaattaggccgacccatcccgca

SEQ ID NO: 5519 - DNA, 621 bp, Artificial Sequence
  Description of Artificial Sequence: Synthetic coding sequence
atgtactcagcgccgtcagcctgcacctgtctgtgcctgcacttcttgctgctttgcttccaggtccaggtcctggtcgccgaagaaaatgtggatttcagaatccatgtcgagaaccaaaccagagctagagatgatgtgtcacggaagcagctgcggctgtaccagctgtacagccgcactagcggaaagcacatccaggtgttgggacggaggatctcagcgcggggagaggacggcgacaagtacgcacagctgctcgtggaaaccgatactttcggctcacaagtccgcattaagggaaaggagactgaattctacctttgtatgaatcgcaaagggaagctcgtgggtaagccagatggaacttcgaaagagtgcgtgttcatcgagaaggtgctggagaacaattacaccgcgctgatgtctgcaaagtacagcggatggtacgtgggatttaccaagaagggccggccgagaaagggtccaaaaacccgtgaaaaccaacaggacgtgcatttcatgaaaagatacccaaagggacaacctgagttgcagaagccgtttaagtacaccaccgtgaccaagcggagccggcgcatccggccaactcatccggct

SEQ ID NO: 5520 - DNA, 621 bp, Artificial Sequence
  Description of Artificial Sequence: Synthetic coding sequence
atgtactccgcaccttcggcatgtacctgtctgtgcctgcacttcttgttgctttgttttcaagtgcaggtccttgtggccgaagaaaatgtcgatttcagaatccacgtggaaaaccagactagagcgcgggacgatgtgtcacggaaacagctgcggctgtaccaactttacagcagaacctcaggtaagcatatccaggtgctggggcgtcgaatttccgcacggggagaggacggagataagtacgcacaactgcttgtggaaactgacacctttggtagccaggtcagaataaagggaaaagaaactgaattctacctgtgtatgaatcgcaaaggaaagctcgtggggaaacctgacggcacttcgaaagaatgtgtgtttatcgagaaagtgttggaaaacaactacactgcgttgatgtccgctaagtactccggatggtacgtggggtttacgaagaagggacgtcctagaaagggccctaagacccgcgaaaaccaacaagacgtgcatttcatgaaacggtatcctaagggccagccagaactgcaaaagccatttaagtacacgaccgtcactaaaagatcccgccggattcgacccacccatcccgca

SEQ ID NO: 5521 - DNA, 621 bp, Artificial Sequence
  Description of Artificial Sequence: Synthetic coding sequence
atgtattctgccccatcagcatgtacatgtctgtgcctgcattttctcctcctgtgcttccaagtgcaagtactcgtcgccgaggagaatgtagatttccgcattcatgtggagaatcaaacgagggcgagagatgacgtgagcagaaagcagttgcgactctaccagctctactcccggaccagtggcaaacacatccaggtgctcggcagaaggattagtgcgcggggcgaagacggagataaatacgcgcaactcttggtggagacagatactttcggatcccaggtgcggataaagggcaaagaaactgaattctacctgtgtatgaatcggaaaggtaaacttgtcggaaagccagacggtacatctaaagaatgcgttttcatcgaaaaggtgcttgagaataattatactgctctgatgtccgcaaaatactcaggatggtatgtgggcttcaccaagaaaggacggccacgcaaaggtcccaagactcgcgagaatcagcaagatgtgcatttcatgaagaggtacccaaagggtcagccggagctgcaaaagccattcaaatacaccacggtgacgaaacgaagtcgaaggatacgcccgacccatccggct

SEQ ID NO: 5522 - DNA, 621 bp, Artificial Sequence
  Description of Artificial Sequence: Synthetic coding sequence
atgtacagcgcaccctccgcatgcacttgtctttgcctgcattttctgcttctttgttttcaagtccaggtgctggtcgcagaggaaaacgtcgattttcgcatccatgtcgaaaaccaaactagagcgcgggatgatgtatctcggaagcagctgagactgtaccaactgtatagtcgaacctcgggcaagcacatacaagtgctggggagaagaatttccgcacgaggagaagatggtgataagtacgcacagctgctcgtcgaaacggatacttttgggtcgcaggtccggatcaagggtaaggaaaccgaattctacctctgtatgaaccgtaaaggaaagctcgtgggaaagccggacggaactagcaaggaatgtgtgtttattgagaaggtgcttgaaaacaactacactgcactgatgtccgcaaagtattccggatggtacgtgggttttactaagaagggcagacctagaaaggggcccaagacgcgtgaaaatcagcaggacgtgcatttcatgaagaggtacccaaaagggcagcctgaacttcaaaaaccgttcaaatacactacggtgaccaagcggtcaaggcggatccgacctactcaccctgcc

SEQ ID NO: 5523 - DNA, 621 bp, Artificial Sequence
  Description of Artificial Sequence: Synthetic coding sequence
atgtatagtgccccaagtgcttgtacatgcctatgccttcactttctcttactatgctttcaggtacaggtactggtcgctgaagaaaacgtcgatttccggatacatgtcgaaaatcagactcgggcccgggatgatgtgtcccgcaagcagctgcgcctgtatcagctgtactcacggacttctgggaaacacatccaggtgctcggaagacgcatatctgctcgcggagaagacggggataaatatgcgcagttgctggttgagacagatacatttgggtctcaggtgcggatcaaggggaaagaaactgaattttatctttgcatgaataggaaaggaaagctagtcgggaaacccgatggaacgtctaaagaatgtgtgttcatagaaaaagtgctcgaaaataattatactgcccttatgtctgcaaaatattccgggtggtatgttggatttactaaaaaagggcgaccaagaaaaggacccaaaactagagaaaatcaacaggatgtccactttatgaaaaggtaccctaaggggcagcccgaactccagaaaccatttaaatacactacagtcactaaaagatcacgaagaatccggcccactcaccccgcc

SEQ ID NO: 5524 - DNA, 621 bp, Artificial Sequence
  Description of Artificial Sequence: Synthetic coding sequence
atgtattcagcacctagcgcatgcacttgcctttgtctccactttctgcttctgtgttttcaggtgcaggtgctggtcgcggaagaaaacgtcgacttcaggatccacgtggagaaccaaacgcgtgcccgggacgacgtgtcgcggaaacagctgcggctttaccaactttactcgcgtacttcggggaagcacatccaggtgctcggacggcgcattagcgcacggggagaagatggtgataagtacgcccagttgcttgtcgaaaccgatacttttgggtcacaagtccggattaaggggaaggaaactgaattctacctgtgcatgaaccggaagggaaagctggttggaaagccagacggcacttcaaaggagtgtgtgtttattgaaaaagtgctggaaaacaactacaccgcacttatgtcggcaaagtactcgggatggtacgtgggtttcaccaagaagggccgcccccggaagggacctaaaactcgtgaaaatcaacaggacgtgcatttcatgaagcgatatccaaaaggtcaacctgagttgcaaaaaccattcaaatacaccaccgtcactaaacgctcgcgacgaattaggccaacccatcccgca

SEQ ID NO: 5525 - DNA, 621 bp, Artificial Sequence
  Description of Artificial Sequence: Synthetic coding sequence
atgtactcagctccctctgcctgcacctgtctgtgtctgcactttctgcttttgtgcttccaggtgcaagtgctcgtggccgaggagaacgtggacttccgtattcacgtagagaatcagactagggcaagagatgatgtgtccaggaaacagctgaggctataccagctctacagcagaacgagcggtaagcacattcaggtgcttgggaggcggatatcagcacggggggaggacggcgacaaatacgcccaattgctagtcgagactgacacgtttgggagtcaggttaggatcaaaggtaaggagacggagttctacctatgcatgaaccgaaagggcaaactggtgggcaagcccgacggcaccagtaaagaatgcgtgtttattgaaaaggtactggagaataactataccgccctcatgagcgccaaatactcagggtggtacgttggcttcacaaagaagggtcggccacgcaagggcccaaagacgcgggaaaatcagcaggatgtgcactttatgaagcggtaccctaaggggcagccagagcttcagaagcctttcaagtataccacagttactaaacgtagtcggagaatccgacctactcatccagca

SEQ ID NO: 5526 - DNA, 621 bp, Artificial Sequence
  Description of Artificial Sequence: Synthetic coding sequence
atgtattcggctccatcagcctgtacttgcctttgcctgcatttcctgctgctgtgtttccaggttcaggtcctcgtggccgaagaaaatgtggacttcaggatccacgttgagaatcaaactagggctcgcgatgatgtgtctagaaagcaactgagactgtaccagttgtatagtagaacatcgggaaagcatattcaagtcctgggccgccgcatttccgcgcggggggaagacggagacaaatatgcacaactgctggttgaaacagatacatttggctcgcaggtcagaataaaaggtaaggagaccgaattttatttgtgcatgaatcgaaaagggaaactcgtcggtaagcccgatgggacatccaaagagtgtgtatttattgagaaggtactggagaataactatactgccctaatgagcgccaagtattctggctggtacgtcgggttcacgaagaaaggaagacctcggaaggggccgaagacacgggagaatcagcaggacgtgcatttcatgaaacggtatcccaaaggacagccggagctgcaaaaaccgttcaagtatacaactgtgaccaagagatcccgacgaattcgcccaacacatccggct

SEQ ID NO: 5527 - DNA, 621 bp, Artificial Sequence
  Description of Artificial Sequence: Synthetic coding sequence
atgtatagtgccccatctgcttgtacctgcttgtgcctgcactttctgctgctttgctttcaagtccaagtgctcgtggctgaagagaacgttgatttccggatacatgtggagaatcaaacgcgtgcccgcgacgacgtgtctaggaaacaattgagattatatcagttatattcacgcaccagtggtaagcatatccaagtgctcggccgaagaatcagcgctcgtggggaggatggcgacaaatatgcccagctgctggtggagactgataccttcgggtcacaggttcggattaaaggcaaagagactgaattctatctctgcatgaacagaaagggtaagttagtcggcaaaccagatgggacctctaaggagtgtgtcttcatcgagaaagtgctggagaataattataccgctcttatgtctgctaagtatagtgggtggtacgtgggctttacaaagaaaggcagacctcgaaaaggccctaaaaccagggagaaccaacaagacgtgcattttatgaaacggtatcccaaaggacaacctgagctgcagaagcctttcaaatacactacagtgactaaacgcagtagaagaatcagacccacacacccggct

SEQ ID NO: 5528 - DNA, 621 bp, Artificial Sequence
  Description of Artificial Sequence: Synthetic coding sequence
atgtactcagcacctagcgcatgtacttgtctttgtctgcacttcctgctcctttgttttcaggttcaggtgcttgtggccgaagaaaatgtggactttcggattcatgtggaaaaccaaacgagggcacgggacgacgtgtcgagaaaacagcttcggctctaccagttgtactcgaggacttcgggtaagcatattcaggtgctcgggcgaagaataagcgcgcgaggagaagatggcgataagtacgcacaactgctggtcgaaacggatactttcggctcccaagtcaggattaagggcaaagagactgagttttacctttgcatgaatcgtaaaggaaaacttgtgggcaaaccagacggcacctccaaggaatgtgtgttcattgagaaagtgcttgagaacaattacacggcactgatgtccgcgaaatacagcgggtggtatgttggattcaccaagaagggccggcctaggaagggcccaaagacccgcgaaaaccaacaggacgtgcatttcatgaaaagatacccaaaaggtcagcctgagttgcagaagccctttaagtacactaccgtcaccaagcggtcgagacggattagacccactcacccggca

SEQ ID NO: 5529 - DNA, 621 bp, Artificial Sequence
  Description of Artificial Sequence: Synthetic coding sequence
atgtactcggccccgtcagcgtgcacttgtctgtgcctccacttcctcctgctctgctttcaagtgcaagtgctcgtggcagaagaaaacgttgatttccgcatccacgtggagaatcagacgagagcccgtgacgatgtgagccggaaacaactcaggctgtaccagctctattccagaacttccggcaagcatatccaggtcctgggacggcggatctcagcacgcggcgaggatggagataagtacgcgcagctgctggtggagactgacacttttggatcccaggtccgcatcaaggggaaagaaactgaattctacctgtgtatgaatcggaaaggcaagctggtcgggaaaccggatggcacctcgaaggagtgtgttttcatcgagaaggtgctggagaacaactacactgctctgatgagcgccaaatactctggatggtacgtgggatttaccaagaaggggaggccgagaaaaggtccgaaaacccgtgagaaccaacaggacgtccactttatgaaaagatacccaaagggacaacctgaactgcaaaagcccttcaagtacaccactgtcactaagagaagccggagaatccgcccaactcatccggca

SEQ ID NO: 5530 - DNA, 621 bp, Artificial Sequence
  Description of Artificial Sequence: Synthetic coding sequence
atgtactcggcaccatcggcttgcacctgtctgtgccttcactttctccttctctgcttccaagttcaggtcctggtcgcagaggagaacgttgattttagaatccacgttgagaatcaaaccagagccagggacgatgtgtcacgtaaacagttgaggctgtaccagctttatagcagaacgtccggtaaacacatccaagtgctggggcgtcggatttcagcgcgcggagaagatggtgacaagtacgcacaattgttggtggaaactgacacctttggaagccaagtgcgcattaagggaaaggagactgaattctacctctgcatgaaccgaaagggaaaacttgtggggaagcctgacggtactagcaaagagtgtgtgtttatcgagaaggtgcttgaaaacaattacactgcactgatgtccgccaagtacagcggttggtatgtcggatttaccaaaaaagggcgtcctcgcaagggacccaaaactagagaaaaccagcaggatgtgcatttcatgaagcgatacccaaagggccaacctgaacttcagaagccattcaaatacacgactgtgaccaagcgttcccggcggattcgtccaacgcatccggca

SEQ ID NO: 5531 - DNA, 621 bp, Artificial Sequence
  Description of Artificial Sequence: Synthetic coding sequence
atgtatagcgctccttctgcatgtacatgcctttgcctgcactttctcttactctgtttccaggtccaggtcctggtggcagaggagaacgttgatttcagaatacacgtggagaaccagacccgagcccgggatgatgttagtaggaagcagttgcgcctgtaccagctgtatagtcggacatcaggcaagcacatccaggtgttgggaagacgcatttccgcccggggcgaggacggagacaagtatgcacagctgctggtggaaaccgatacctttgggtctcaagtgcgcatcaaggggaaggaaacagagttctacctgtgcatgaaccgcaagggaaaacttgttggtaaacctgatgggaccagtaaagagtgtgtgtttatagaaaaggtgctggaaaacaattatactgctctcatgtccgctaagtattctggatggtacgtggggttcacaaaaaagggacggccccggaagggcccaaagaccagagaaaaccagcaagatgtgcactttatgaagaggtaccctaagggtcaacctgagcttcagaaacctttcaaatacacaacagtcactaagaggtctcgacgtatacgccccacacatccggca

SEQ ID NO: 5532 - DNA, 621 bp, Artificial Sequence
  Description of Artificial Sequence: Synthetic coding sequence
atgtacagtgcgcctagcgcctgcacatgcctatgtctgcacttcttactcttgtgcttccaagtgcaggtgttggttgccgaagaaaacgtcgattttcgcattcatgtagaaaaccaaacccgcgctcgcgatgacgtgtcgcgcaaacagctgcgactgtatcagctgtactcaagaacctctggcaagcacattcaggttctgggtcgccggatttcggcacgtggggaagatggagacaaatacgcgcaactactggtggaaacggacacatttggctctcaagtccggattaaaggtaaagagactgagttctatttatgcatgaataggaagggtaagctggtgggtaaacctgatggcacgagcaaagaatgtgtctttatagagaaagttcttgaaaacaactatacagcgcttatgtccgccaagtattccggatggtacgttggctttaccaagaagggaaggcctcgcaaagggccgaagactcgagagaaccagcaagatgtgcatttcatgaagcggtatcctaagggtcagccagaactacagaagccatttaaatacacgacggtgacaaagagaagtcgtagaatcaggcctacgcaccctgcg

SEQ ID NO: 5533 - DNA, 621 bp, Artificial Sequence
  Description of Artificial Sequence: Synthetic coding sequence
atgtactcagcaccaagtgcctgcacatgtctgtgcctacacttcctactcctatgctttcaggtgcaggttctggttgcagaggagaatgtggactttcgcattcacgtagagaatcaaacaagggcccgggatgatgtctctaggaagcagttgaggctttatcaactgtacagccgtacgagcggcaagcacattcaggtcctggggcgccgcatttcggcccgcggagaggatggggataagtatgcccagctcctggtggagaccgacaccttcggaagtcaggtaaggatcaagggcaaggagacggaattttacctgtgcatgaaccggaaaggtaagctggtcggaaaacctgatggaacttcaaaggagtgcgtgttcatcgaaaaagtactggagaataattacactgccctgatgtctgccaaatattctgggtggtacgtggggttcaccaagaaaggtcggccgcgcaagggacccaagactagggagaaccagcaggatgttcatttcatgaagcgatatcccaaaggacaaccagagctccagaagccattcaaatacactacagttacgaagaggagtcgaaggattaggcccacacatccagct

SEQ ID NO: 5534 - DNA, 621 bp, Artificial Sequence
  Description of Artificial Sequence: Synthetic coding sequence
atgtattctgctcctagcgcctgtacgtgcctatgtcttcactttttactcctttgttttcaggtgcaggttctggttgctgaagaaaatgtggatttcaggattcatgttgagaatcaaacccgggcacgtgacgacgtaagcaggaaacagctgagattgtaccaactgtattccagaacgtcgggaaaacacatacaggtgctaggccggaggatctccgcacggggggaggatggcgacaagtatgcccaattgttagtggaaacagacacattcggcagccaggtgcgtataaaggggaaggagactgaattctacctgtgtatgaatcggaaagggaaactggtcggcaagcctgacggcacctcaaaggagtgtgtgttcattgagaaggtcctggaaaataactatactgcattgatgagcgccaagtacagcgggtggtacgttggatttaccaaaaagggcagacctagaaagggacctaagacgcgtgaaaatcaacaggacgtgcattttatgaagcggtaccctaaaggacaacccgaactgcagaagccgttcaagtatacaactgtcactaagcggtcgcgaaggatacggcccacgcatccagcc

SEQ ID NO: 5535 - DNA, 621 bp, Artificial Sequence
  Description of Artificial Sequence: Synthetic coding sequence
atgtactccgccccgagcgcatgcacttgcctctgtctgcacttcttgctgctgtgttttcaagtgcaagtcctggtggcagaagagaacgttgacttccggatccatgtggagaatcaaacgcgcgctcgggacgacgtgtcgcgaaagcaactcagactctaccaactgtattccaggacctcgggaaagcacatccaggtgcttggacgacgcatttcagccaggggggaagatggcgacaaatacgcgcagctgttggtcgaaactgatacgttcggttcacaagtccgcatcaagggaaaggaaacggaattctatctttgcatgaatcgcaagggcaagctggtcggaaagccggatggaacttcgaaagagtgcgtgtttatcgaaaaagttttggagaacaattacaccgctctcatgtccgcgaaatactctggctggtatgttgggttcaccaagaaaggacggccaagaaagggccctaagactcgggaaaaccagcaagacgtccatttcatgaagagataccctaagggtcagcccgaacttcagaagcccttcaagtacactaccgtcactaaacgcagccggcgcatccggccgacccaccccgcc

SEQ ID NO: 5536 - DNA, 621 bp, Artificial Sequence
  Description of Artificial Sequence: Synthetic coding sequence
atgtacagcgcgccgtcggcctgcacctgtctgtgcctccattttctcctgctgtgttttcaagttcaagtgctcgtggcagaagaaaacgtcgactttcgtatccacgtcgaaaaccaaactagagcgcgggatgatgtcagcagaaagcagctgcggctctaccagctgtactcgcggactagcgggaagcacattcaagtgctgggaagaagaatctcggctcggggggaggacggagataagtatgcacagctgcttgtggaaacggacacttttggttcccaagtgcgaataaaggggaaggaaaccgagttttacctctgtatgaatcgcaagggaaagctggtgggcaagccagacggaacctccaaagaatgtgtctttattgaaaaggtgcttgagaataactacaccgcactgatgtctgcaaagtactccggttggtacgtcggtttcaccaagaaggggcggccaagaaaaggccccaagactcgcgagaaccaacaggatgtacatttcatgaagaggtacccgaagggtcaacctgaacttcaaaagcctttcaagtacaccactgtgactaagcggagtaggcgtattcgaccaactcacccagca

SEQ ID NO: 5537 - DNA, 621 bp, Artificial Sequence
  Description of Artificial Sequence: Synthetic coding sequence
atgtacagcgcaccatcagcttgtacctgtctgtgccttcattttctgctgctgtgttttcaagtccaggttctcgttgctgaggagaatgtcgatttccgaattcacgtggagaaccagacaagggcaagggatgacgtgtcacggaagcagttgagactgtaccagctatacagccgaaccagtgggaagcacatccaagtcctgggcagaagaatctccgctcggggggaagatggagacaagtacgctcaacttcttgtggaaacagacactttcgggtcacaggtgcgtatcaagggcaaagagactgagttttacttgtgcatgaacaggaaagggaaactagtgggaaagcccgacggtaccagtaaggagtgcgtcttcatcgagaaagtgttagagaacaactacacggccctcatgagtgccaaatatagcggctggtatgtgggattcacaaaaaagggaaggcctagaaaaggccctaaaactagagagaatcagcaggatgtgcacttcatgaaacggtaccctaaggggcagcccgagctgcaaaagcctttcaaatacactaccgtgacaaagcggtcaagaaggatcaggcctacacatcccgct

SEQ ID NO: 5538 - DNA, 621 bp, Artificial Sequence
  Description of Artificial Sequence: Synthetic coding sequence
atgtactcggcaccttcggcctgtacctgtctctgccttcactttcttcttctttgtttccaagtgcaagtcctggtggcagaggagaatgtcgactttagaattcatgtggagaatcaaactcgagccagagacgatgtctcacgtaagcaattgaggctctaccagctctactcacgcacctcaggaaagcacattcaagtgctgggaagaagaatctctgcccgcggggaggacggagacaaatatgctcagcttctggtcgagactgatacctttggttcgcaagtgcgaattaagggaaaggagactgagttttacctctgcatgaatcgtaagggaaaattggttggaaagcctgatgggacttccaaggagtgtgtgtttatcgaaaaggtgctggaaaacaactacaccgcacttatgtcggccaagtactccggatggtacgtgggattcaccaaaaagggccggccaaggaagggacctaaaacccgggaaaaccagcaagatgtccactttatgaaacgctacccgaagggtcagccagaactccagaagccgttcaagtacaccactgtcaccaaacgatccagaagaatcagaccaacccaccccgca

SEQ ID NO: 5539 - DNA, 621 bp, Artificial Sequence
  Description of Artificial Sequence: Synthetic coding sequence
atgtactctgctccctctgcctgtacgtgtctgtgcctacacttcctcctgttgtgctttcaggttcaggtccttgtggcagaagagaacgtggactttagaattcatgtggaaaatcaaactcgtgccagagatgatgtgagtaggaagcagctccgactgtaccagctttatagcaggaccagtggaaaacacatccaggtccttgggcgaagaatttcagctcgaggagaagacggcgataagtacgcgcagctcctcgttgaaaccgatactttcgggtctcaagtccgaatcaaaggcaaggagacggaattctatctgtgtatgaacagaaagggtaaactcgttggcaagccggacgggactagtaaagaatgtgtattcatagagaaggttcttgaaaacaactacacagccctgatgagcgccaaatactcagggtggtatgtgggctttaccaaaaaaggccgaccgaggaagggcccgaagactcgggagaatcagcaggatgtgcacttcatgaagaggtatccgaagggccagcctgagttgcagaagcctttcaagtacacgactgtgactaagcgaagcaggagaatccgccctacccaccccgcc

SEQ ID NO: 5540 - DNA, 621 bp, Artificial Sequence
  Description of Artificial Sequence: Synthetic coding sequence
atgtattccgcccctagcgcatgcacgtgcctgtgcctgcacttcctcctgctgtgcttccaagtgcaagtgctggtggcggaagaaaacgtggatttccgcattcatgtggaaaatcagacccgggcccgcgacgacgtgtcgcggaagcagcttagactgtaccagctctactcgagaactagcggtaagcacatccaggtgctggggaggcgaatcagcgcacgcggggaggacggagacaaatacgcccagctcctggtggaaactgacactttcggttcccaggtccgaatcaagggaaaagaaaccgagttctacctttgtatgaatcgcaagggaaagctggtcgggaagccagacggaacctccaaagagtgtgtgttcatcgaaaaagtcttggagaacaactacactgcacttatgtcagcaaagtactcgggatggtacgtgggcttcactaagaaaggtaggccgaggaagggaccaaagacgcgtgagaatcagcaggacgtccacttcatgaaaagataccccaagggacagccggaactgcagaagccgttcaaatacactactgtgaccaaacgctcgagacgcatcagaccgactcacccggcc

SEQ ID NO: 5541 - DNA, 621 bp, Artificial Sequence
  Description of Artificial Sequence: Synthetic coding sequence
atgtacagcgcaccgtccgcctgtacctgtctttgtctccactttctgcttctttgctttcaagtccaggtgcttgtggcagaagaaaatgtggattttcgaatccatgtggagaaccaaaccagagcacgcgatgatgtgtccagaaagcagctccggctgtaccaactgtactcaaggacgtcgggcaagcatatccaagtgctgggtagacggatctccgccagaggagaggacggtgacaaatacgcccagctgctggtggagactgacaccttcggaagccaggtgcggatcaagggcaaggaaactgagttttacctgtgtatgaaccggaagggaaagctggtcggaaaacctgatgggacctcaaaggagtgcgtctttatagaaaaagtcttggaaaacaactatactgcacttatgtcggcaaagtactccggatggtacgtgggtttcactaaaaagggaaggccgcgcaaaggacctaagacccgcgaaaaccagcaggacgtgcactttatgaagcgctaccccaagggtcaacctgaacttcaaaagccattcaaatacactactgtgactaagcggtcacggcgcattaggccgactcatccggca

SEQ ID NO: 5542 - DNA, 621 bp, Artificial Sequence
  Description of Artificial Sequence: Synthetic coding sequence
atgtattcagcaccatctgcttgtacatgtttatgtttacattttttgttactttgttttcaagtgcaggttcttgttgcagaagaaaatgtagatttcagaatacatgttgaaaaccaaactagagctagagatgatgtatcaagaaaacaattacgactttatcaattatattcaagaacaagtggtaaacatattcaagttttaggaaggcgaatttcagctcgaggagaagatggagataaatatgctcaacttcttgtagaaactgacacatttggttcccaagttaggattaaaggaaaagaaacagaattttatttatgtatgaatagaaaaggaaaattagttgggaaacctgatggaacaagtaaagaatgtgtttttattgaaaaagttttagagaataattatactgctttaatgtcagcaaaatattcaggttggtatgtaggatttactaagaaagggcgtccaagaaaaggaccaaagacacgtgaaaatcaacaagacgttcattttatgaaaagatatccaaaaggtcaaccagaattacaaaaaccatttaaatataccactgtaactaaaagatctaggcgtattcgaccaactcatccagct

SEQ ID NO: 5543 - DNA, 621 bp, Artificial Sequence
  Description of Artificial Sequence: Synthetic coding sequence
atgtactcggctccctccgcgtgcacgtgtctctgcttgcactttctgctgctgtgcttccaggtccaggtgctcgtggccgaagaaaacgtggatttccggatccacgtggagaatcagacgagagcgcgcgatgatgtgtcgcgcaaacagcttcgcttgtatcagctgtacagccgaacttccgggaagcacattcaagtgctgggacggcggatctccgcccgaggagaggatggcgacaagtacgcccagctcctggtcgagactgacaccttcggatcgcaggtgagaataaaggggaaggagactgaattctacctgtgtatgaatagaaagggcaaactcgtgggcaagccagacggaacctcaaaagaatgcgtgtttatcgagaaggtgctggaaaacaattacaccgccctcatgtcggcgaagtactccggatggtacgtgggttttaccaagaaaggcaggcctagaaagggaccaaagactcgcgaaaaccaacaagatgtccatttcatgaagcgctacccaaagggccaaccagaattgcaaaagccgtttaagtacactactgtgacgaagagaagccgcagaattcgcccaactcatccagca

SEQ ID NO: 5544 - DNA, 621 bp, Artificial Sequence
  Description of Artificial Sequence: Synthetic coding sequence
atgtattcagccccttcagcctgcacctgcctttgtttgcactttctactgttgtgttttcaggtccaggtgcttgttgcagaggagaacgtggacttccgtatccatgtggaaaaccagactcgggctagagacgacgtaagtagaaagcagctcaggttgtaccagctctatagccgaacttctggcaaacacatacaggtgctgggccgaagaatctctgcccgaggggaggacggggataagtacgcccagctcttggtagagacagacacctttggcagccaagtgcgaatcaaggggaaagagactgagttctacctgtgcatgaataggaagggaaagctagttggaaagccagacggcacctccaaggaatgcgtgtttatcgagaaagttcttgaaaataactataccgctcttatgtccgcaaaatactctgggtggtacgtcggttttaccaaaaagggcagacccaggaaggggcccaagacaagggagaaccaacaggatgttcactttatgaaaagatatcccaaaggtcagcccgagctgcagaaaccctttaagtatacaacagtgaccaagagatccagacgaatccgacccactcatcccgcc

SEQ ID NO: 5545 - DNA, 621 bp, Artificial Sequence
  Description of Artificial Sequence: Synthetic coding sequence
atgtattcggcaccttcggcatgtacttgtctgtgcttgcatttccttcttctttgttttcaagtccaggtgctcgtggctgaagaaaatgttgattttcggatccatgttgaaaaccaaacgcgcgcgagagatgatgtgtcgcgcaagcagctgagactttatcaactttacagccgaaccagcggcaaacatattcaggtgctgggccgtaggatttcggccaggggcgaggacggagataagtacgcccagcttcttgtggaaaccgataccttcgggtcacaagtccgcattaagggaaaagaaaccgagttctacctttgcatgaaccgtaagggtaagctggtcggaaaacctgatggaacctctaaggagtgtgtgtttattgagaaggtcctggaaaacaactacaccgcactcatgagcgcaaagtacagcggatggtatgtgggttttactaagaaaggacgcccccgtaagggaccaaagaccagagaaaaccagcaggatgtgcactttatgaagagatacccaaagggtcagcctgagctgcaaaagccctttaagtacactaccgtgaccaaacgtagccgtagaattcggcctacgcatccagca

SEQ ID NO: 5546 - DNA, 621 bp, Artificial Sequence
  Description of Artificial Sequence: Synthetic coding sequence
atgtactccgctccaagtgcttgcacctgtctgtgcctacactttctcttgctttgttttcaagtgcaggttctcgttgccgaagaaaatgtcgacttccgaatccatgtcgaaaaccagacccgggcaagggatgacgtgtcacgtaagcagctaagactctaccagctgtactctcgtacaagcggcaagcacatacaggtcttggggagacgaatttccgcaaggggtgaggacggcgacaaatacgcccaactcctggtggaaaccgacactttcgggtctcaggtgcgtataaaaggcaaggagaccgagttctacctgtgcatgaacagaaaaggtaagttagtgggcaaacctgatggcacttccaaagagtgtgtgttcatcgagaaggttttagaaaataactatactgctctgatgtccgcaaaatacagcgggtggtacgtgggctttactaaaaaaggcaggccacgtaaaggtcccaaaactagggagaaccagcaagatgtacactttatgaagcggtacccaaaagggcagcccgaactccagaagccatttaaatacaccaccgtgaccaaacggtcccggcgcataagacctactcaccctgca

SEQ ID NO: 5547 - DNA, 621 bp, Artificial Sequence
  Description of Artificial Sequence: Synthetic coding sequence
atgtattccgccccatctgcatgcacatgcctgtgcctgcacttcttgctgttgtgctttcaggtgcaggtgcttgtcgcagaagagaacgtggattttcgaatccacgtggagaaccagacccgggcacgtgacgacgttagccgaaagcagctcagattgtaccaactatattcgcgtacaagtggaaagcacatacaggtgcttgggcgcaggatttctgcgcgcggcgaggacggcgataagtatgcccagctgttggtggaaaccgatacgttcggttcccaagtacgaatcaagggcaaagaaaccgagttctacctatgtatgaaccggaagggaaagctggtgggcaagcccgacgggacatcaaaagaatgcgtttttatcgagaaagtccttgaaaacaactacacagctttaatgtcggctaagtattcgggttggtacgtgggttttactaagaagggacgaccaaggaagggccctaagacgagagagaatcagcaggatgttcacttcatgaagaggtaccctaagggccagccggagctacagaaaccattcaagtacaccacggtgactaagcgcagccgcaggatcaggccaacccaccctgcg

SEQ ID NO: 5548 - DNA, 621 bp, Artificial Sequence
  Description of Artificial Sequence: Synthetic coding sequence
atgtatagcgcaccaagcgcatgtacttgtctgtgcctgcacttcctgctgctctgttttcaggtgcaggtgttggtggctgaggagaatgttgattttaggatccatgtcgagaaccagacaagagctagagacgacgtctcccgaaaacagctgaggctgtaccagttgtattcaaggacttcaggaaagcacatccaagtgctaggtaggcgcatctcagctcgtggcgaagacggagacaagtacgctcagctgttggtagagaccgataccttcggaagccaagtcaggataaagggcaaggagactgagttctacttatgtatgaatagaaagggtaagctcgtcggaaaacctgatggaacaagcaaggaatgtgtctttattgagaaggttctggagaataattatactgctctgatgagcgccaaatactcgggatggtacgtcggtttcaccaaaaaaggaagaccaagaaagggaccaaaaacccgggaaaaccagcaggacgtgcatttcatgaaacggtaccctaagggacaacccgaactgcagaaacctttcaaatatacaacagtaaccaaacgttccaggcggatccggccaacccaccccgcc

SEQ ID NO: 5549 - DNA, 621 bp, Artificial Sequence
  Description of Artificial Sequence: Synthetic coding sequence
atgtattcagcgccctctgcttgcacttgcctctgtttgcattttttgctcctgtgtttccaggtgcaggtgctggtagctgaagagaatgtggactttcgcattcatgttgagaatcaaaccagggctagggacgatgtgtctagaaagcaattgcgcctttatcagctgtactctagaacaagcggaaaacatatccaagtgctcggaaggaggatttcagccaggggcgaagacggtgataagtacgctcagctcttggttgagactgatacctttggaagccaagtcaggatcaagggtaaggagactgagttctacctgtgcatgaaccgcaaaggcaaactggttggtaaaccagatggtacaagtaaggaatgcgtattcatcgagaaggtgctggagaacaactatactgccctgatgagcgctaagtattccggatggtacgtgggattcactaagaaaggtaggcccaggaaaggccccaaaaccagagagaaccagcaggacgttcacttcatgaagagataccctaaaggtcagcccgagcttcaaaagccatttaagtatacaaccgtaacaaaacgcagtaggcgcatccgccctacacaccctgcc

SEQ ID NO: 5550 - DNA, 621 bp, Artificial Sequence
  Description of Artificial Sequence: Synthetic coding sequence
atgtattcggcgccgtcggcgtgtacgtgtttatgtttacattttctattactatgttttcaagtacaagtattagtagcggaagaaaatgtagattttcgtatacatgtagaaaatcaaacgcgtgcgcgtgatgatgtatcgcgtaaacaattacgattatatcaattatattcgcgtacgtcgggtaaacatatacaagtattaggtcgtcgaatatcggcgcgaggtgaagatggtgataaatatgcgcaattattagttgaaacggatacgtttggttcgcaagtacgtataaaaggtaaagaaacggaattttatttatgtatgaatcgaaaaggtaaactagttggtaaaccggatggtacgtcgaaagaatgtgtttttatagaaaaagtactagaaaataattatacggcgttaatgtcggcgaaatattcgggttggtatgttggttttacgaaaaaaggtcgtccgcgaaaaggtccgaaaacgcgagaaaatcaacaagatgtacattttatgaaacgttatccgaaaggtcaaccggaattacaaaaaccgtttaaatatacgacggttacgaaacgttcgcgacgaatacgtccgacgcatccggcg

SEQ ID NO: 5551 - DNA, 621 bp, Artificial Sequence
  Description of Artificial Sequence: Synthetic coding sequence
atgtactcggcgccgtccgcttgcacctgtctctgcctgcacttcctcctgctgtgcttccaagtgcaagtgctggtcgccgaggaaaatgttgattttagaatccacgtcgaaaatcagacccgcgcacgcgatgacgtgtccagaaagcagctgaggctgtaccagctctacagccgcaccagcgggaagcacatccaggtcctgggtagacgcatctccgctagaggcgaggacggcgacaagtacgcccagttgctcgttgagactgacaccttcggatcccaagtcagaatcaagggaaaggaaaccgaattctacctctgtatgaaccggaagggtaagctggtgggaaaaccagacggaacctccaaggagtgtgtgttcatcgagaaggtcctggagaataactacaccgctctcatgagcgcaaaatacagcgggtggtacgtgggatttaccaagaagggacgcccccggaagggaccaaaaacccgcgaaaaccagcaggacgtgcactttatgaaacggtacccgaaaggccaacccgaacttcagaaaccgttcaagtacaccaccgttactaagaggtccagacgcatccggccgacgcatccagca

SEQ ID NO: 5552 - DNA, 621 bp, Artificial Sequence
  Description of Artificial Sequence: Synthetic coding sequence
atgtactccgctccgtccgcatgcacttgtctgtgtctgcacttcctgctgctgtgctttcaagtgcaggtcttggtcgcagaggaaaatgtcgactttaggatccacgtggagaaccaaactcgggccagagatgatgtttcgcggaaacagctgcgcctctaccagctctactctcggacctcaggcaagcatattcaggtgcttgggcggagaatctcggcacgcggggaagatggtgacaagtacgcccagctcctggtggagactgatacgtttggatcacaggtccggatcaagggcaaggaaactgaattctacctctgcatgaacaggaaaggaaagctggtcggaaagccggacggcacctcaaaggaatgtgttttcatcgaaaaagtgcttgagaataactacaccgctctgatgtcagccaagtattcgggatggtatgtgggcttcaccaagaagggacggccaagaaaaggaccgaaaacgagggagaatcaacaggacgtccatttcatgaagcggtaccctaaggggcagcctgagctccagaagccattcaagtacaccactgtcactaagcgctcccgccgcatccgcccaacccatcctgcc

SEQ ID NO: 5553 - DNA, 621 bp, Artificial Sequence
  Description of Artificial Sequence: Synthetic coding sequence
atgtacagcgctccaagcgcctgcacctgcttatgcctccatttcctgctcctgtgctttcaggtccaggtgcttgtagccgaggaaaatgtggatttcagaatccacgtggaaaaccagacgcgagcccgcgacgatgtttccagaaagcagctgagactttatcaactatacagccgcacttcaggcaaacacatacaagtgttgggtcggaggatcagcgccagaggggaagatggggacaagtacgcccaactcttggtcgaaacggacacatttggttctcaagtgcggattaaaggcaaggagacagagttctatctgtgcatgaacagaaaaggcaagttggtgggcaaacctgacggcacaagtaaagagtgtgtgtttattgaaaaagtcctcgagaacaactacactgctctgatgagcgcaaagtattctggatggtatgtcggcttcacaaaaaaggggcgaccgcgcaagggcccaaagacgagagaaaatcagcaagacgtgcactttatgaaaagataccccaagggacagccggagctccaaaaaccgtttaagtacacaacagtgacgaagaggagtcggcgcatacgcccgacccacccagca

SEQ ID NO: 5554 - DNA, 753 bp, Artificial Sequence
  Description of Artificial Sequence: Synthetic coding sequence
atgcttggcgctcgcctgcgactttgggtctgtgcactttgttcagtgtgttcaatgtccgtgcttcgggcataccctaacgcatcaccacttcttggttcatcatggggaggtctgatccacctttacactgcaactgcaagaaactcctaccacctgcaaattcacaagaacgggcatgtggatggagcacctcatcagacgatttactccgcactgatgatacgctccgaggacgcaggatttgtggtgattaccggagtgatgtcaagacgatatttgtgtatggactttcgaggaaatatcttcggcagccattactttgatccggaaaactgccggtttcaacaccaaacccttgaaaatggttatgacgtgtaccattcgccacagtaccatttcctcgtctccctcgggcgtgcaaaaagagcattccttcctggcatgaatccacccccctactcccagtttctctctaggcggaatgagatcccgctcattcactttaacactccaataccacggcgtcacactagatcagccgaagatgactcggaacgggatccactgaacgtgctcaagccaagagccagaatgactcctgcacctgcatcatgttcgcaggaattgccgagcgccgaggataactctcctatggcatccgatccactgggtgtggtgcggggtggaagagtgaatacccatgcaggaggaaccggccctgaggggtgtagaccgttcgcgaagtttatc

SEQ ID NO: 5555 - DNA, 753 bp, Artificial Sequence
  Description of Artificial Sequence: Synthetic coding sequence
atgctcggggcaagactgcgcttgtgggtctgcgcgctctgctctgtttgttccatgtccgttctccgagcctatcccaatgcttctcccctacttggaagttcctggggaggattaatacatctttatactgcaacagccagaaattcctatcatttacagatccataaaaatgggcatgttgatggagccccacatcagactatttactcagcccttatgatacggtccgaagatgccggatttgtggtcataactggggtgatgtctcgaaggtatctgtgtatggattttcgggggaatatctttggatcccactactttgaccccgagaactgtaggtttcagcatcagacgctcgagaatggatacgacgtctatcattcaccccagtaccatttcttagttagtctaggacgagcaaagcgggccttccttcccgggatgaaccctccaccatacagtcaattcctgtcccgcaggaacgaaatcccacttatacacttcaatacacctatacccaggagacacacacggtcagccgaagatgatagtgaaagggatcctctcaatgttctcaaaccccgtgcacggatgacaccagcacccgcttcctgttctcaggaactcccttctgccgaggacaatagtcccatggcatccgatccattaggagtagtaagagggggaagggtcaatacacatgcagggggaactggaccagaaggatgccggccgttcgctaaatttatc

SEQ ID NO: 5556 - DNA, 753 bp, Artificial Sequence
  Description of Artificial Sequence: Synthetic coding sequence
atgctgggagcgagactgagactttgggtgtgcgccctctgttcggtgtgctccatgagtgttttgcgggcctacccgaatgcttccccgttgctcgggtcatcttggggaggactcattcacctgtatactgccaccgcccgcaactcataccacctgcagatccataagaatggtcatgtcgacggagccccccaccaaacgatctactcagcactgatgatccggtcagaagatgccggcttcgtggtcatcaccggagtgatgtcccgccggtacctgtgcatggactttaggggaaacatcttcggctcccactacttcgatcctgaaaattgtcgcttccaacaccagacgctggagaacggatacgatgtgtaccattccccccaataccacttcctcgtgtcgctcggaagagccaaacgggcattcctccctggaatgaatcctccgccgtactcgcagttcctgtcgcggcgaaatgaaatccctctgatccacttcaatacgccgatcccccgcaggcatactcgctcagcggaggacgattctgagcgggacccacttaatgtcttgaaaccacgggctagaatgactccggcgcctgcctcgtgcagccaagagctgccgtcagcagaggacaattccccaatggcttcggatccattgggagtggtgcggggaggacgggtgaatactcatgccggcgggaccggacctgaaggatgtagaccttttgcgaagttcatc

SEQ ID NO: 5557 - DNA, 753 bp, Artificial Sequence
  Description of Artificial Sequence: Synthetic coding sequence
atgctgggagcccgcttaagactatgggtttgcgccctttgctctgtctgttccatgagcgttctgcgagcctacccgaacgctagtcccctgctgggctcttcgtggggggggcttatccacctttacaccgccactgcacggaacagctaccatttgcaaatccataagaatggccatgtggacggcgctccacaccagaccatatactccgccttgatgattcgttcagaggacgcaggattcgtggtgatcactggggtcatgtcacgaagatatctttgtatggactttcggggaaatattttcggcagccattattttgatccagaaaactgcagattccagcatcagacactcgagaacgggtacgatgtctaccactctccccaatatcacttcctggtttcactgggacgagcaaaacgcgctttcttgccagggatgaacccacccccctattcacaatttctgagccgaagaaatgagatccccctgatccactttaatactcctatccctcgacgtcacacacggtccgccgaggacgactcagaaagagaccctcttaacgtgcttaaaccacgagctaggatgacccctgcaccggcgagttgttctcaggagttgccatctgctgaggataatagcccaatggcctccgaccctctgggagtggtccgtgggggtcgcgtgaatacacacgcagggggcacaggacctgaaggatgcagaccttttgctaaattcata

SEQ ID NO: 5558 - DNA, 753 bp, Artificial Sequence
  Description of Artificial Sequence: Synthetic coding sequence
atgctcggtgctcgactgcggctttgggtgtgcgcactgtgctctgtctgtagtatgtcggttctgagagcctacccaaacgcctcacccctgttgggcagtagctgggggggtctgatacacctttacacagcgactgcaaggaacagttatcatcttcagattcataagaacggtcacgtggacggtgcaccacatcagacaatctattctgcactaatgattaggtctgaagacgcaggtttcgtggtcattactggcgttatgtcccgccggtacctgtgcatggacttcagagggaatatctttggcagtcattactttgaccccgagaactgcagattccagcaccagacactggagaatggatatgatgtctaccatagcccacagtaccacttcctcgtgagcttgggccgggctaagagagccttcctgcccggaatgaaccccccaccatactctcagttcctctcaagacggaacgagattccattaattcattttaacactccaatccctcgcagacacacgcggtctgcagaggacgattcggagagggacccgcttaatgtgctgaaacccagagccaggatgacacccgcaccagcttcctgctcacaggagctgccaagcgccgaagataactcccctatggcctccgaccctcttggcgtggtcagagggggccgggttaacacacatgcgggaggcactggcccggagggatgccggccctttgctaagtttata

SEQ ID NO: 5559 - DNA, 753 bp, Artificial Sequence
  Description of Artificial Sequence: Synthetic coding sequence
atgctaggcgcaagattacgtctgtgggtgtgtgctctttgttcggtgtgcagcatgtccgttttaagagcctacccaaatgctagtccccttctgggtagcagctggggaggactgatccatctctacaccgctactgcacggaatagctaccacctgcagattcacaagaacgggcatgtggatggcgccccacatcagaccatctacagtgccctgatgattcgttccgaagacgcggggttcgtcgtcatcactggcgtcatgtctcgtcgctacctctgtatggacttcagggggaatatcttcgggtcgcattactttgatccggaaaactgccggttccaacaccaaaccctcgaaaacggttacgatgtctatcactctccacaatatcacttcctggtgtcgttagggagagctaagagggccttcttgccgggcatgaacccacctccctatagtcaattcctatccagacggaatgaaatccccctcatccacttcaacacgccaattcctagaagacacacacggtccgctgaagatgacagcgagagggaccctctcaacgtgctcaagcccagggcgcgcatgacaccggcccccgccagctgcagtcaagaactaccctccgccgaagacaactcacctatggcttcggacccactgggggttgtaaggggaggtcgagtaaacacccacgctggtgggacagggccagagggttgcagaccgttcgcaaagtttata

SEQ ID NO: 5560 - DNA, 753 bp, Artificial Sequence
  Description of Artificial Sequence: Synthetic coding sequence
atgcttggggcccgcctgaggctttgggtgtgtgccctgtgctccgtctgttccatgagtgtgctgagggcctacccaaatgcgtcccctctgttaggctcctcatgggggggcctgattcatttgtacacagcgaccgcccgaaattcctatcaccttcaaattcataagaatgggcatgtggatggggcaccccaccagacaatttacagtgctctaatgattcgttctgaggacgcgggtttcgtcgtaattaccggggtgatgtcacgaagatacttatgtatggactttagagggaacatcttcggtagccactacttcgacccggagaactgcaggttccaacatcaaaccctggaaaatggatatgatgtgtatcattcccctcagtaccacttcctcgtttcactgggacgggccaagagagcattccttccgggtatgaatccccctccctactcccagtttctttctagacgtaacgagatccctcttattcacttcaacacacctatccctcgaaggcatacccgaagcgccgaggatgatagcgaacgagaccccctgaatgtattgaaacccagggcaaggatgacccctgctcccgcctcgtgctcccaagaactcccatctgcggaagataactcccccatggcttccgaccccctgggagtagttcggggaggaagagtaaacacccatgcgggaggcaccggcccagaggggtgtcgcccttttgcgaaattcatc

SEQ ID NO: 5561 - DNA, 753 bp, Artificial Sequence
  Description of Artificial Sequence: Synthetic coding sequence
atgctgggtgcccgcttgcgtctgtgggtgtgcgccctctgtagcgtgtgtagtatgagcgtactccgtgcgtaccctaacgcctcccccttgctcggatcgtcctggggtggtctgattcacttgtacaccgccaccgcccgtaactcctaccatctccagatccataagaacggtcacgtcgacggtgctccccaccagactatctactcagccctcatgattcgcagcgaggatgctggcttcgtggtcattaccggtgttatgtccaggcgctacttgtgtatggatttccgcggtaacatcttcggcagtcactacttcgaccccgaaaactgccggttccagcatcagacgctggagaacggctacgacgtttatcattcccctcagtaccattttctagtttcgctgggtagggctaagcgtgccttcctccccggcatgaatccgccgccctatagccagttcctcagcaggcgtaacgaaattcctctcattcacttcaacaccccaattcccaggcgccatacccgttctgccgaggacgatagtgagcgggatcccctcaacgtcttgaagccccgtgctcgtatgactcccgcacctgcatcctgctctcaagagctgccatcggccgaggataactcgcctatggcctccgatcctctcggtgtcgtccgtggaggccgagtgaacacgcacgccggtggtactggtcccgagggctgccggccttttgctaagttcatt

SEQ ID NO: 5562 - DNA, 753 bp, Artificial Sequence
  Description of Artificial Sequence: Synthetic coding sequence
atgcttggagctagactgcgactttgggtctgcgccttgtgctcagtttgctccatgagcgtcttgcgggcctatcccaatgccagtccactcctgggcagttcatgggggggcctcattcacctgtacactgcaactgctcgaaatagttatcatcttcagattcacaagaacggacacgtggatggcgcaccccatcagactatctactctgcgcttatgattcggtctgaggacgcaggtttcgtcgtaattacaggagtgatgagtagacgctacctctgtatggactttagaggtaatattttcgggtctcactactttgacccggaaaactgtcgcttccaacaccagactctggaaaatgggtacgacgtctatcacagccctcagtatcacttcctggtcagtcttgggagggccaagcgcgccttcctgccaggcatgaacccacctccgtattcacaattcttgtctaggaggaacgagattcccttgatacacttcaacactcccattcctaggaggcacaccagaagcgctgaggatgatagtgaacgggaccccttgaacgtgctcaagcccagagctcgcatgacgcccgctccagcctcttgctcccaggaactcccatccgccgaagacaattctcccatggcgtctgaccctctgggcgttgtacggggcgggagagtgaacacacacgcggggggaaccgggcctgaggggtgtcggcctttcgccaaattcatc

SEQ ID NO: 5563 - DNA, 753 bp, Artificial Sequence
  Description of Artificial Sequence: Synthetic coding sequence
atgctcggcgcaagactccggttgtgggtctgcgcgctctgttcggtctgttccatgtctgtgctgagagcataccccaatgcatcacctcttcttggcagctcctggggcgggcttattcacctgtacacggcaactgccagaaattcttatcatctgcaaatacataagaacggacatgtggacggagcaccccatcaaactatctattcggctttgatgattagatcggaagatgctggttttgtggtgatcacgggtgtcatgagtaggcgctacctgtgtatggattttcgcggtaatatcttcggtagtcattactttgacccagaaaactgcagatttcagcaccagaccttggaaaacgggtacgacgtgtaccattccccccagtaccacttccttgtgtcactcggccgggcaaaacgggcgtttctgccggggatgaaccctcctccttacagccagttcctgtcgagacgcaacgaaatcccccttatacatttcaacaccccaattcctcggcgacataccagatccgccgaggatgattccgaacgagatcctttgaatgtcttgaagccacgggcacgtatgaccccagcacctgcttcgtgctcacaagagctgccttcagccgaagataactcgccaatggcatcggaccctcttggagtagtgcgcggaggtagagtgaacacccacgccggtggaactggaccggagggatgtagaccctttgcaaagttcatt

SEQ ID NO: 5564 - DNA, 753 bp, Artificial Sequence
  Description of Artificial Sequence: Synthetic coding sequence
atgctcggtgctaggttgcgtttatgggtatgtgcactctgctctgtttgcagcatgtccgtcctgcgtgcatacccaaacgcgtcaccgcttctgggctccagctggggaggactgatccacctgtatacggctaccgcgcgtaattcataccacttgcaaattcataagaatggccatgtcgatggggccccacatcagacaatctattccgctctgatgattagatcggaggacgccggtttcgtagttataactggagtcatgtctagaagatacctgtgtatggacttcagaggtaacatcttcggctcccactattttgatcccgagaattgcagattccagcatcagaccctcgagaatggctatgacgtctaccactccccgcaataccatttcttagtctccctgggcagggcaaagcgggcttttcttcctggcatgaaccccccaccctactctcagttcctgagtagacgcaacgaaatccctctgattcattttaatactcccattcccagacgccacacccgcagcgccgaggacgactctgagagagatccacttaacgtactgaaaccacgggcgagaatgaccccagctcccgcaagctgctctcaggagctgccctctgcggaagataatagcccgatggctagcgatcccctgggcgtcgtgcgcggcgggcgtgtaaacacccatgctggaggtacagggccagaaggctgcaggccatttgcgaagtttatt

SEQ ID NO: 5565 - DNA, 753 bp, Artificial Sequence
  Description of Artificial Sequence: Synthetic coding sequence
atgctcggggccagactcagattgtgggtctgcgcactctgttctgtttgcagtatgagcgtcttaagagcgtatcccaatgccagcccactgttaggttcatcatgggggggactgatccatttgtacacagccactgccagaaattcttaccatctgcaaattcacaagaatgggcacgtggatggtgcaccccatcagacgatatactctgctctcatgattaggtctgaggatgccggcttcgtcgtgatcacaggcgtgatgtccagacggtacctatgcatggacttccggggaaatatattcggaagccattatttcgaccctgagaattgcagattccagcaccagacgctagagaatggatatgacgtgtaccattccccgcagtaccacttcttggtctccctggggcgggccaaacgggcattcctacctgggatgaaccctcccccttatagccagttcctcagtagaagaaatgagatcccattaattcattttaatacccccattccaaggcgtcacactcgttctgctgaagacgattccgagcgcgatcctctcaacgtcttaaagccccgggcaaggatgactccagccccggcctcctgctctcaggagctgccctctgctgaggataactcccccatggccagcgacccgctcggcgtcgttcgcggagggagggttaatacccatgcgggcgggacgggccctgaaggatgccgaccatttgctaagtttatc

SEQ ID NO: 5566 - DNA, 753 bp, Artificial Sequence
  Description of Artificial Sequence: Synthetic coding sequence
atgcttggagctagactgcgcctctgggtgtgtgccctttgtagtgtctgctcaatgtccgtgctgagggcatatcccaacgcgtcgccattgttaggctcgtcatggggcggactgatccacctgtatacagccactgccagaaacagctaccatttgcagattcataagaatggacacgtcgacggtgcgccccatcagactatttactctgcccttatgatccggtcggaggatgccggcttcgttgttattacaggagtgatgagccgcaggtacctttgtatggacttccgggggaacattttcggctctcactacttcgatcctgagaattgtcgatttcagcaccagaccttggaaaacggatacgacgtgtatcactcgcctcagtaccactttctcgtatcgcttggtcgggcgaaacgcgcctttctaccaggcatgaaccccccaccctattctcaatttctgagtcgccgaaacgaaatcccccttatccattttaatacgcctattccaagaaggcacactcgcagcgccgaggatgatagtgagagagaccctcttaatgttctcaagcctcgggctcggatgacgcctgcgccagcgtcatgctcacaggaactcccctccgccgaggataatagccctatggcgtctgatcctcttggtgtcgtccggggagggagagtgaatactcatgctggtggcaccggacctgagggttgccggccgtttgcaaagttcatc

SEQ ID NO: 5567 - DNA, 753 bp, Artificial Sequence
  Description of Artificial Sequence: Synthetic coding sequence
atgctcggagcaagactgagactatgggtgtgtgctctgtgttctgtgtgcagcatgtctgtgctgcgggcctatcctaacgcctctcccctgctcggatcttcttggggaggcctcatacacttgtataccgctaccgcccgcaatagctatcatttacagatacacaaaaatgggcacgtcgacggagctcctcatcagaccatttattcagcccttatgataaggtccgaagatgcgggatttgtcgtgattacgggggtgatgagtcggaggtatctctgcatggatttccgggggaatatttttggctcacactattttgacccagaaaattgcaggttccagcatcagacactcgagaatggctatgatgtgtaccactcaccacaataccatttcttggtctcactgggaagagcaaaaagagcatttcttccaggtatgaaccctcccccttacagccagttcctgtctagaagaaatgaaattcctctgattcacttcaatacccctatccccagacgccatacccgtagtgccgaggatgattccgaacgcgatccgctcaacgtcttaaaaccgcgggccagaatgacaccagctccggcctcttgtagtcaagagttgccttcagctgaggataactcccccatggcaagtgaccctctcggcgtggtacgaggcgggagggtgaacacccacgcaggtggcacagggcctgagggatgccgtccgttcgcgaagttcatt

SEQ ID NO: 5568 - DNA, 753 bp, Artificial Sequence
  Description of Artificial Sequence: Synthetic coding sequence
atgctcggtgcgcggttgcggttatgggtctgtgcactgtgcagtgtctgctccatgtctgttctccgtgcttatcccaacgcgtctcctttattaggatcatcttgggggggcctgattcatttgtatacagccactgcccgaaactcttatcatctccagatccataagaacggacacgtagacggtgcaccgcaccagaccatatattcggccttgatgatccggagcgaagacgccggcttcgtggtgatcacaggagttatgtcccgacggtacctctgcatggacttcagagggaatatctttggcagtcactactttgaccctgaaaactgtcggtttcagcaccagacgctggagaatgggtatgacgtgtaccacagcccacagtatcatttcctcgtgtcgctgggcagagctaaacgggcatttctccccggcatgaacccaccgccctattcccagttcctgtctaggaggaacgagatccccctgattcatttcaacacacccatccctaggcgacacacaagatcagcagaagatgatagcgagagagaccctcttaacgttctgaagccaagggcacgcatgaccccagcccctgctagttgcagccaagagctacccagtgcagaagacaactcccctatggcctcagaccctctcggagtcgtgaggggcggtcgggtgaacacacatgcaggtgggactgggcccgagggatgcagacctttcgctaagtttata

SEQ ID NO: 5569 - DNA, 753 bp, Artificial Sequence
  Description of Artificial Sequence: Synthetic coding sequence
atgctcggagcgcggctcaggctgtgggtctgcgcactgtgctcagtctgttccatgtccgtgctgagagcatacccgaatgcatcccccttgctcgggtcgtcatggggagggttgatccatctgtacaccgccactgctcggaactcctatcacctgcaaatccataagaacggccatgtggatggagctccgcaccagaccatctacagcgcactgatgatcaggtccgaggatgcaggcttcgtcgtcatcaccggagttatgtcacgcaggtacctgtgtatggactttcggggtaacattttcggctcgcattactttgacccggaaaattgccgattccagcaccagaccctggaaaatggatacgacgtctaccattcccctcagtaccattttctcgtgtcccttggccgcgcgaagcgggcctttcttcccggcatgaatccaccgccgtacagccagttcctcagcagacgcaacgagatcccgctcatccacttcaacactccaatcccacggagacataccaggtccgcagaggacgattcggagcgggacccgcttaacgtgctgaagcctcgggcgcgcatgactccggccccggcaagctgctcccaagaactgccgtcggccgaagataacagccctatggcaagcgacccgctgggtgtggtgcgcggaggtcgggtgaatactcatgccggaggcacgggccccgagggatgcagaccattcgcgaagtttatc

SEQ ID NO: 5570 - DNA, 753 bp, Artificial Sequence
  Description of Artificial Sequence: Synthetic coding sequence
atgcttggagcccgacttagactctgggtgtgcgccttgtgcagtgtatgctccatgagtgtcttgagagcttacccgaacgcgtcacctctcctcggctctagctggggggggctcattcacctctatacagccacagcccgcaactcctaccatctgcagattcataaaaatggccacgtggatggagcgccgcaccaaacaatttatagcgctttgatgattagatccgaggacgccggattcgtggtaatcactggcgtaatgtctcggaggtatctttgtatggattttcgtggcaatatatttggctcccactatttcgacccagaaaactgtcgctttcaacaccaaacgcttgagaacgggtacgacgtttaccactctcctcagtaccattttttggtaagtttaggccgagccaagcgggctttcctgcccggcatgaacccccctccctactctcagtttctgtcaagacgcaatgaaatacccctaattcattttaacacgccaattcctagaagacacacccgctcagcagaagacgatagcgagagagaccctctcaacgtgctgaaacctcgcgctaggatgacacctgcccctgcaagctgttcgcaggagctgcccagtgccgaagataacagccccatggcttctgaccctctgggtgtggtgaggggaggccgcgtaaacactcacgcgggaggtaccggaccggaaggctgccggccctttgcgaagtttatt

SEQ ID NO: 5571 - DNA, 753 bp, Artificial Sequence
  Description of Artificial Sequence: Synthetic coding sequence
atgcttggcgcgcgcctgcgcctctgggtttgtgctctgtgcagcgtttgctctatgtccgttttgcgcgcataccctaacgcgagcccgctgttgggcagcagttggggtggccttattcatctatatacggccactgcacgaaacagctatcacctgcagattcacaaaaacggccacgttgacggtgcacctcatcagaccatttatagcgcactaatgattcgctccgaggatgccggctttgttgtgatcacgggtgttatgagccgccgatatctgtgcatggattttcgcggtaacatctttggctcacactactttgatcctgaaaactgccgcttccagcaccagaccctggaaaacggctatgatgtgtatcacagcccacagtaccattttctggtgagcctgggcagggcgaaacgtgcattcctgccaggtatgaatccgccaccatactcccaatttcttagccgtagaaatgaaatcccgctgatccacttcaatacaccgatcccgcgcaggcatacccggagcgcggaggatgattccgagcgcgatccgctgaacgtgttaaaaccacgtgcccgcatgaccccagcgcctgctagctgttcccaagagctgcctagcgcagaggacaatagcccaatggcctcggaccccctcggcgtggttagaggtgggcgggtgaacacccacgcaggcgggactgggccggaggggtgtcggccgttcgctaagtttatc

SEQ ID NO: 5572 - DNA, 753 bp, Artificial Sequence
  Description of Artificial Sequence: Synthetic coding sequence
atgttgggagcacggcttagactttgggtgtgtgcactgtgtagcgtttgttcgatgtcggtcctgagagcataccccaatgcctcacctctgctgggaagctcctggggtggattgattcacctttacaccgcaactgcaaggaattcgtaccaccttcaaattcataagaatggacatgtggatggagcaccacatcaaaccatctactcggcgctcatgattcggtcagaggatgctggtttcgtcgtgattactggtgttatgagccgcaggtacctttgcatggattttcgcggaaacatatttgggagccattactttgatccagagaattgccgctttcagcaccagaccctggagaacggatatgatgtgtaccattcacctcaataccatttccttgtgtcgctcggtcgggcaaaaagggcgtttctgccaggaatgaatccaccaccgtacagtcagtttctgagccgacgcaacgaaataccattgatacactttaacacgcccattccccgtaggcataccagatctgcggaagatgactcagaaagggaccctcttaacgtgctgaaaccaagagctcgcatgactcctgcaccagccagctgttcccaggagctcccatccgcagaggataactcacccatggcatcagatcccctgggtgtcgtgcgtgggggtcgcgtgaacacccatgccggaggcacgggaccagagggctgtagaccctttgctaaattcatt

SEQ ID NO: 5573 - DNA, 753 bp, Artificial Sequence
  Description of Artificial Sequence: Synthetic coding sequence
atgctcggcgcccgattgcgcctgtgggtttgcgccttgtgttcggtgtgctcaatgtccgttcttagagcataccccaatgcatcaccgcttcttggttcctcatggggagggcttatccacctgtacactgcaactgcacggaactcctaccatctgcagatccacaaaaatggacatgtcgatggggcacctcaccagactatctattccgcattgatgatacggtccgaggatgcaggctttgtggtgatcaccggagtgatgtctcgccgatacctttgcatggattttagaggtaacatttttggaagccactatttcgatcccgaaaattgtcggtttcagcatcaaaccctcgaaaatggttacgacgtttaccattcgcctcagtaccactttctcgtgtcgctcgggagggcaaagcgggcctttctgcctggtatgaatcccccgccatactcacaattcctttctcggcgaaatgaaattccgcttattcatttcaacactccaattccacggcgccatactagatcagccgaagatgactcggaacgggaccctctgaacgtgctgaagcctcgagcccgcatgacccctgctccagcgtcgtgctcacaggaactgccatccgcagaggacaactccccaatggcgtccgatcctctgggagtggtgcggggcgggagagtgaacacccacgctggaggtaccggcccagaaggatgtagaccgttcgcgaagttcatt

SEQ ID NO: 5574 - DNA, 753 bp, Artificial Sequence
  Description of Artificial Sequence: Synthetic coding sequence
atgcttggcgcgaggctgcgcctctgggtgtgtgcactctgttcagtgtgctcaatgtcggtgctgcgcgcatacccgaatgcgagcccgctgctcgggtcctcttggggcggcttgatccacctgtacactgccaccgcccgaaactcctaccacctgcagatccacaagaacggacacgtggacggagcgccgcatcaaaccatctactcggcgttgatgatccgctcggaggacgccggatttgttgtgatcacgggcgtcatgtcgcggcgctacttgtgcatggacttccggggtaacatcttcggatcccactacttcgacccagaaaactgccggtttcaacatcagaccctggagaatggatacgacgtctaccattcaccgcaataccacttccttgtctcgcttggacgcgctaaacgggcattccttccgggcatgaatccacctccgtactcacagtttctgtcccgcagaaacgaaatcccactgatccacttcaatactcctatcccgcggcgccacacccggtccgcagaagatgattccgaacgcgatccgctgaatgtgctcaaaccgcgcgccaggatgactccggccccggcttcgtgcagccaggagctgcccagcgccgaggacaattctccgatggcgagcgacccgctgggggtcgtccggggaggaagggtgaacacccatgccggaggaactggtcctgagggatgccgcccgtttgccaaattcatt

SEQ ID NO: 5575 - DNA, 753 bp, Artificial Sequence
  Description of Artificial Sequence: Synthetic coding sequence
atgttaggcgccaggctgcggctgtgggtgtgcgctttgtgttctgtttgcagcatgtcggtgctgagagcctacccaaatgcgagcccattgctgggatcctcttgggggggactgattcatctgtacacagctacggcgaggaatagttaccacctgcagatacataagaatggacacgttgatggtgctccacaccagacgatatacagcgcgcttatgatcaggtccgaagacgctgggttcgtcgtgatcacaggagtcatgagcagaaggtatctgtgtatggatttccgcggaaacatcttcggttctcactacttcgatcccgagaactgcaggttccagcatcaaaccttggaaaatggttacgacgtgtatcactctccacagtatcactttctggtgagtctgggcagggccaagagagcgttccttcccggcatgaaccctccaccttacagccaatttttgtccaggaggaacgagattcccttaatccacttcaacacccccattccgcggagacatacccgcagcgccgaggatgactctgaaagagatccgcttaacgtgctgaaaccccgtgcgcgtatgaccccggctcctgctagttgctctcaggaacttccttcggctgaggacaatagtcccatggcttcagaccctctaggtgtagtccggggcgggagagtcaacactcatgcaggcggcactgggcccgagggctgtaggccttttgctaagttcatt

SEQ ID NO: 5576 - DNA, 753 bp, Artificial Sequence; identical to SEQ ID NO: 5568
  Description of Artificial Sequence: Synthetic coding sequence

SEQ ID NO: 5577 - DNA, 753 bp, Artificial Sequence
  Description of Artificial Sequence: Synthetic coding sequence
atgctgggggctcgtctgagactgtgggtttgcgccctctgctcggtctgcagcatgtccgtccttcgcgcctacccgaacgcctcgccgcttctgggatcgtcatggggcggcctgatccatctgtacacggctactgcaagaaattcgtaccacctgcagatccacaaaaacggccatgtcgacggagcgccacaccagaccatctactctgccctgatgatccgctcagaggacgctggatttgtggtcattaccggggtgatgagcagacgatacctgtgtatggacttccgcggcaatatcttcgggagccactattttgatccggaaaactgccggttccaacatcagactctggagaacggctacgacgtgtaccattcgccacaataccacttcctcgtctcactggggcgggccaagcgcgcctttcttccgggaatgaacccgccaccttactcccagtttctgtctcgacggaatgaaatcccactgatccacttcaacactccaatcccgcgccgccacactcgctcggccgaggacgattcggaacgggaccctctcaacgtactgaagccccgcgctagaatgacccccgcaccggcgtcttgctcccaagaactcccgagcgctgaagataattcaccgatggcatcagatcccctgggtgtggtgaggggtggtcgagtgaatacccatgcagggggcaccggaccagagggctgccgccccttcgccaagttcatc

SEQ ID NO: 5578 - DNA, 753 bp, Artificial Sequence
  Description of Artificial Sequence: Synthetic coding sequence
atgctcggtgcacgactccgtctctgggtgtgcgcactgtgctcggtctgttcgatgtcggtcctccgcgcgtaccccaacgccagcccgttgctgggatcctcctggggtggacttatccacctctacaccgcaaccgcacgcaatagctaccaccttcagattcacaagaatggtcatgtggatggtgcaccgcatcagaccatttactccgcactgatgattcggtcggaagatgcaggttttgtggtgattactggggtgatgtcacgcagatacctttgtatggattttagaggtaacattttcggatcgcactacttcgatccagaaaactgcagatttcaacaccaaacccttgaaaacggatacgatgtgtaccatagcccacaataccattttcttgtgagcctggggagagcaaagagggcattccttccaggaatgaatcctcccccctactcccaatttctgtcgaggcgcaacgagatcccactgatccactttaacacccctatccctcgtcgtcataccagatctgcagaagatgattccgaacgcgatcctctgaacgtcctgaaacctcgcgcccggatgactcctgcacctgcatcatgtagccaagaattgccgtctgctgaagataacagccccatggcgtcggaccccttgggtgttgtcaggggtggccgcgtgaacactcatgcaggagggactggtcctgagggttgtaggccatttgcaaaattcata

SEQ ID NO: 5579 - DNA, 753 bp, Artificial Sequence
  Description of Artificial Sequence: Synthetic coding sequence
atgcttggagcacggcttcgcttgtgggtctgcgctctttgtagcgtctgttccatgtccgtgctgagagcctacccgaacgcctcgccgctccttggctcgagctggggaggtctgatccatctgtacaccgccacggcccgcaactcgtatcacctccagattcacaaaaatgggcacgtggacggcgccccgcaccagactatctactcagccctgatgatccgcagcgaggatgcgggattcgtggtgattactggggttatgtcccgccggtacttgtgtatggactttagaggaaatatctttggttcccactactttgatccagagaattgccggttccagcaccaaaccctcgaaaacggatacgatgtgtaccactcgccgcaataccacttccttgtctccctcgggcgagccaagcgggccttcctgccgggaatgaacccaccgccttacagccagttcctgtcgcggaggaatgaaatcccactgatccacttcaatacccccatccctcggagacacacccgctctgctgaggacgacagcgagagggatccccttaacgtgctcaaacctcgcgcgcgcatgactccggcgccggcttcgtgcagccaggagctgccaagcgcggaagataactcgccgatggcgtcggatccactgggagtggtgaggggaggacgggtgaacactcacgccggtggaacgggacctgaaggttgtcgcccttttgcgaagttcatc

SEQ ID NO: 5580 - DNA, 753 bp, Artificial Sequence
  Description of Artificial Sequence: Synthetic coding sequence
atgttgggagcaagacttcgcctctgggtatgcgcgctgtgttcagtgtgttcaatgtctgttttgagggcttaccctaatgcgagcccgctgctgggttcatcttggggtgggcttatacatctctatactgcaacagctaggaacagttaccatctgcagatccacaagaatgggcacgtggacggggccccccatcagactatctattctgcactgatgatccggagcgaagacgccggattcgtggtgataacgggcgtgatgtctcgccggtacctgtgcatggacttccggggtaatattttcggctctcactacttcgatccggagaactgtcggttccaacaccaaacgttggaaaacgggtacgatgtgtatcactctccccagtaccactttctggtgtcacttggccgtgccaaacgggcattcctgccaggcatgaatccgcctccctactcccaatttttgtcacgcaggaatgagatccctcttatccacttcaatacgccgattcctcgtcggcacacacgatcagccgaagatgacagcgaacgcgaccccctgaacgtgctgaaaccacgcgctagaatgacccctgcccccgccagctgtagccaggagttgccaagcgccgaggacaattcaccaatggcctccgaccctctgggcgtcgtgcggggaggcagagttaacacacacgctggtggaacaggcccagaaggctgccgaccattcgccaaatttatt

SEQ ID NO: 5581 - DNA, 753 bp, Artificial Sequence
  Description of Artificial Sequence: Synthetic coding sequence
atgcttggagcaagacttaggctgtgggtgtgcgccctttgttccgtttgttcaatgtcagtgctgcgcgcgtacccgaatgcatcacctctgctcggttcgagctggggaggacttatccatctgtacaccgcaaccgctaggaatagctaccaccttcagatccataagaacggccacgtggatggagcaccccatcaaactatttacagcgctctgatgatacggtccgaggacgcgggattcgtggtgatcaccggagtgatgagccgtagatacctctgtatggattttcggggaaacattttcggttcgcactactttgaccccgaaaactgcaggtttcagcatcagactctggagaacggatacgatgtgtatcattccccacaatatcatttccttgtctcgctcggccgcgccaagcgggcatttcttcctgggatgaatcctccaccatacagccaatttctgtccagacgaaacgaaattccactcatccatttcaacaccccaattccaagacgtcatacgcggtcggccgaagatgacagcgagagagatcctctcaacgtccttaagcctcgggcgcgcatgaccccagcgcctgcaagctgcagccaagaactgccatcagcggaagataattcaccgatggcatctgacccactcggtgtggtgcggggaggtagagtaaacacccatgcagggggaaccggaccagagggatgtaggccctttgctaagtttatt

SEQ ID NO: 5582 - DNA, 753 bp, Artificial Sequence
  Description of Artificial Sequence: Synthetic coding sequence
atgcttggggctcggctgaggttgtgggtgtgcgccctttgctcggtgtgcagtatgagtgtgctcagggcgtaccccaacgcttcaccactgttaggctctagctgggggggactgatccacctttacaccgctactgccagaaattcgtaccacttacagatccataaaaacggacatgtcgacggagcaccccatcagaccatatattcagcactgatgatccggtccgaggacgccggcttcgtcgtgatcaccggtgtgatgtccagaaggtacctgtgtatggatttcagaggaaacatctttggcagtcactattttgatcctgagaattgccgattccagcatcagaccttggagaatgggtatgacgtgtatcactcccctcagtatcacttcctggtctctctcggtagagcgaagcgcgctttcttgcctggaatgaatccccccccctacagtcaatttctctccaggcgcaacgagatacctcttatccattttaatactcctataccacggcgccacacacgttcagcggaagacgattccgaacgcgaccctttgaacgtccttaagccccgcgcaagaatgacgccagccccagcatcgtgctcccaagagctgccaagcgccgaagataactcacccatggcatccgatcctcttggcgtggtgcgaggcggccgggtgaacacccacgccgggggcacggggcccgagggatgtcggccatttgctaaatttatt

SEQ ID NO: 5583 - DNA, 753 bp, Artificial Sequence
  Description of Artificial Sequence: Synthetic coding sequence
atgctgggagcacggctgcggctctgggtctgcgccctctgtagcgtgtgcagcatgagcgtcctgcgggcatatcctaacgcgtctcctctgctgggctcatcgtggggcggactgattcacctgtacaccgcgactgcccgcaacagctaccatctccagattcacaagaacggccacgtggacggggcgccgcaccagaccatctacagcgcactgatgattaggtcggaagatgcaggatttgtggtgatcacgggagtgatgtcccggcggtatctgtgcatggattttagaggtaacatcttcggatcgcattacttcgaccctgaaaactgccggttccagcaccagaccctggagaacggatacgacgtgtaccacagtccccagtaccacttcttggtgtccttgggaagagccaagcgcgcttttctgccaggaatgaaccctccgccgtacagccaattcctgtccagacgaaatgagatcccactgattcacttcaacaccccaattccaaggcgccacacgagatcagccgaagatgattccgagcgggacccgctcaacgtcctcaaaccccgcgctcgaatgacgcccgcgcctgcttcctgctctcaggaactgccgtccgcagaggacaattcaccaatggcctcggatcccctgggtgtcgtgcgagggggacgcgtgaacactcatgccggaggaactggaccagagggatgtcgccctttcgccaagttcatc

SEQ ID NO: 5584 - DNA, 753 bp, Artificial Sequence
  Description of Artificial Sequence: Synthetic coding sequence
atgcttggagctagattaaggctttgggtttgtgcattatgctcagtatgctcaatgtcagttttaagagcatatcctaatgctagtccacttctaggaagttcatggggaggattaattcatttatatactgcaaccgcaagaaactcttaccatttacaaatccataagaatggtcatgttgatggagctccacatcaaactatttattcagccctaatgattagaagtgaagatgcaggatttgttgttattactggagtaatgtctagaagatatctttgtatggattttagaggaaatatatttggaagtcattattttgatccagaaaactgtagatttcaacatcaaactcttgaaaatggttatgatgtttatcattcacctcaatatcattttcttgtttcacttggaagggctaaaagagctttcttaccaggtatgaatccaccaccttatagtcaatttctatctagaaggaatgaaattccattgattcactttaatactccaatcccaagaagacacactagatcagcagaagacgattcagaaagagatccattaaatgtcttaaaacctagagctagaatgactcctgcaccagcttcatgttcacaggaattgccttctgctgaagataacagtcctatggcatcagatcctttaggagttgttagaggaggtagagttaatacacatgcaggtggtactggaccagaaggatgtagaccttttgctaaattcatt

SEQ ID NO: 5585 - DNA, 753 bp, Artificial Sequence
  Description of Artificial Sequence: Synthetic coding sequence
atgcttggtgcaagactgcgcttgtgggtctgtgcattgtgctcggtgtgtagcatgtcggtcctcagggcatacccaaacgccagccctcttctcggttcgtcttggggaggattgattcacctgtacactgcaaccgcccgaaactcataccatctgcaaattcacaagaatgggcatgtggacggagcacctcatcaaactatctactcagccctcatgatacgttcagaggatgccgggttcgtggtcattactggcgtgatgtcgaggcgctacctctgtatggactttagaggtaatatcttcggtagccactattttgatccagaaaattgtagattccagcatcaaacccttgaaaacggttacgatgtgtaccacagcccacaatatcattttctggtcagcttgggacgcgcaaagcgggcgtttctcccaggcatgaatcctcctccgtactcacaatttctcagccggagaaacgaaatacctcttattcatttcaacactcctatcccaagacgtcataccagatcagccgaagatgattcggaacgggatccattgaacgtactgaagccccgagcccgaatgacgcctgcccctgcgagctgctcgcaagagctgccttcagcggaggataattccccaatggcgtccgacccgcttggagtggtgcgaggtggtagagttaacacccacgcaggaggaaccgggccggaaggctgtcgtccatttgcaaaattcatc

SEQ ID NO: 5586 - DNA, 753 bp, Artificial Sequence
  Description of Artificial Sequence: Synthetic coding sequence
atgctgggggcccggttaaggctgtgggtttgcgctctgtgttcagtgtgcagcatgtctgtcttgagagcctaccctaatgcaagtcccctattaggatctagctggggcggcctgatacacctgtacaccgcaaccgctcggaattcatatcacttgcagatacacaaaaacggccacgtcgacggcgcgccacatcagaccatctattcagcgcttatgatccgctccgaagacgcgggcttcgtggtgatcactggagtgatgtcacgcagatacctgtgtatggacttcagaggtaacattttcggcagtcattacttcgatcctgagaactgccggttccagcatcagaccctggagaatggctacgacgtgtaccacagcccccagtaccatttcctggtgtcacttgggcgagccaaacgggcattcttgccgggtatgaatccccccccgtattcccagttcttgtcgaggcggaatgagattcctctcattcacttcaacacccctattccccggagacacactagatctgctgaggacgactcagaacgggaccccctgaatgttctcaaacccagagctcgcatgaccccagccccagcaagctgttctcaagagctgcccagcgcagaggacaactctcccatggctagtgatcccctgggggtcgtgcggggtggccgggtcaatacacacgccggaggcacaggccctgaaggctgtcgaccgtttgccaagtttatc

SEQ ID NO: 5587 - DNA, 753 bp, Artificial Sequence
  Description of Artificial Sequence: Synthetic coding sequence
atgctgggagcgcggctgagactgtgggtgtgcgcattgtgttcagtgtgttcaatgtctgtgctccgcgcctaccctaatgcatcccccctgctcggttcgagctggggaggactcatccacctctatactgccacggcccggaactcataccatcttcaaattcataagaacggccacgtggacggggctccgcaccagactatctattccgctctgatgatccggagcgaagatgctggttttgtggtgatcactggagtgatgtcacggagatacctctgcatggactttcgcgggaatatcttcggatcacattacttcgatccggagaactgccgcttccagcaccaaacgctcgaaaatggatacgacgtgtaccactccccgcaataccacttcttggtgagcctgggccgcgctaagagagcctttctgccgggtatgaacccgccaccgtactcgcagttcctgtcgcgccgcaacgaaatccctctgatccatttcaacaccccgattccgaggcgccacactcggtccgccgaggacgactcagagagagatccactgaatgttcttaagccacgcgcccgcatgaccccagcaccagcgtcgtgctcacaggaactcccatcggctgaagataactcccccatggcttcagacccactgggtgtggtccggggcgggcgggtcaacactcacgccggtggtactggtccagaaggctgtcgcccttttgccaagtttatc

SEQ ID NO: 5588 - DNA, 753 bp, Artificial Sequence
  Description of Artificial Sequence: Synthetic coding sequence
atgctgggagcccggcttcggctgtgggtctgtgccctctgttccgtgtgctcaatgagcgtcctccgcgcgtatccgaatgcatccccactgcttggcagctcttggggaggactgatacatctctacactgccactgcgaggaactcttaccacctgcaaatacacaaaaatggtcatgtcgatggcgctccacatcagaccatctactctgccctgatgatacgtagcgaggatgcaggtttcgtggtgattaccggcgtgatgtctcggagatacctgtgcatggatttcagaggcaatattttcggaagtcattactttgacccagagaactgccggttccagcaccaaaccctggagaatggatatgatgtgtaccattctccgcaatatcatttccttgtgtcattgggcagggcaaaaagagcgttcctgccaggcatgaatcctcccccctattcccagttcctgtcccggcggaatgaaataccgctgatccacttcaataccccaattcccaggagacacactcggtctgcggaggatgactcagagcgggatcccctaaatgtactgaagcccagggctcggatgactccagcgccagcttcctgcagccaggagctgccctctgccgaagataactcccctatggctagtgacccactgggcgtcgtaagaggtgggagggtgaatacacacgccggagggaccggacccgaaggctgccggcccttcgcaaagttcata

SEQ ID NO: 5589 - DNA, 753 bp, Artificial Sequence
  Description of Artificial Sequence: Synthetic coding sequence
atgctgggcgctcgcctcaggctttgggtttgcgccctctgctctgtgtgctccatgagtgttctacgcgcctatccaaatgcaagcccactcctgggaagtagttggggaggcttgatccatctgtacaccgccaccgcgcggaactcctaccacctccagatccataaaaacggccacgtagacggcgctccccatcagaccatttacagcgcactcatgattaggagcgaggatgccggatttgtggttatcacaggcgtcatgagccgacgatatttgtgcatggattttagaggtaacatttttgggagtcactacttcgatccagagaactgcagattccagcaccagaccttagaaaacggctacgacgtttaccatagtcctcagtaccatttcctcgtttcactcgggagagcaaagagggcctttttgcccgggatgaatccacctccttactcccagttcttgtcaagacgcaatgagatcccacttatccatttcaacacccccatcccccgcaggcacacaaggagtgctgaggatgatagcgagagagaccccttgaacgtactcaaaccacgggctcggatgacacccgcacctgcatcatgttctcaagagcttccgagcgctgaggataatagccctatggcttccgaccccctgggagttgtcaggggaggccgggtaaacacacatgctggcggaacagggccagagggctgtagaccattcgctaagtttatt

SEQ ID NO: 5590 - DNA, 753 bp, Artificial Sequence
  Description of Artificial Sequence: Synthetic coding sequence
atgcttggagctcgtctacgattgtgggtttgtgcgttgtgttccgtctgtagtatgtcggtgctccgagcatatccgaatgcctcaccactgttaggttcgtcttggggtggactgatccatctgtacaccgcaactgctcgtaattcatatcatttgcagatccataaaaatggacacgttgatggagcgccgcatcaaacaatatactcagccctcatgatacgctccgaggatgcgggcttcgtggttattacaggcgtgatgtctagacgctatttatgtatggacttcagaggaaacatttttgggtctcattacttcgacccggaaaactgtagattccaacaccaaacacttgaaaacggatatgatgtgtatcattctcctcaataccatttcctcgtttctctgggaagagctaaacgggcctttctacctggaatgaaccctcctccgtattcgcagtttctcagtagacgaaatgagatcccgttgattcattttaacacaccaatccctcgacgacatactagatcggctgaggatgattcagaacgagatccattgaatgtcttaaaaccgcgagctcgaatgactcctgctccagccagttgttcacaagaactaccgtcagccgaggataatagtccaatggcatcggatcctcttggagtggtgcgtggaggccgcgtcaacacccacgccggaggtacgggtccagagggatgtagaccattcgcaaaattcatc

SEQ ID NO: 5591 - DNA, 753 bp, Artificial Sequence
  Description of Artificial Sequence: Synthetic coding sequence
atgctcggcgcaagacttaggctttgggtgtgtgcgctgtgttcagtttgtagcatgtcagtgcttcgagcttacccgaatgcctcccctctcctcggaagctcttggggtggactgatccatctgtacactgcaactgcgcggaacagctaccatttgcaaattcataagaacgggcatgtcgacggagccccacatcaaaccatttactcggcgctgatgattcggtcagaagatgcagggtttgtggtcatcaccggagtgatgtcgcgacgatacctttgtatggactttaggggcaacatctttggttcccattacttcgatccagagaactgtagatttcagcaccagacccttgaaaatggctacgacgtctaccactcgcctcagtaccactttcttgtctcgcttggaagagcaaagagggccttccttcctggaatgaaccctcccccctactcacaattcctttcgcgtagaaatgagattccactcattcactttaacactccaatcccacgacgccatactcgtagcgcggaagatgattccgagcgcgacccgctgaacgtcctgaaaccacgggcccgaatgactccagcgccagcgtcctgctcgcaagagttgccctccgcagaggataattcacctatggcatccgatcctctgggtgtcgttcggggaggaagagtcaatacccatgcaggaggaactggtccagagggatgtcggccttttgccaagttcatc

SEQ ID NO: 5592 - DNA, 753 bp, Artificial Sequence
  Description of Artificial Sequence: Synthetic coding sequence
atgctgggagcgagactgcggctctgggtctgtgcgctgtgctcggtctgctctatgtcagtcctgagagcctacccaaatgccagcccactcttgggttcgagctggggaggactgatccatctctatactgctaccgctagaaattcctaccacctccagattcacaagaacggacacgtggacggggccccgcaccagactatctattcagccctgatgatccgaagcgaagatgctggattcgtggtgatcaccggagtcatgtcaaggcgctacctctgcatggactttcgggggaacatcttcgggtcgcattacttcgaccccgaaaactgccgcttccagcaccagactctggagaacgggtacgatgtctaccattccccgcagtaccactttctggtttcactgggtcgcgccaagcgggcattcctcccgggtatgaacccgccgccgtacagccaattcttgtcgcgccgcaacgaaattccgttgatccacttcaacactcccatcccgcgccgccacacgagatctgccgaggatgactccgagcgcgatccacttaacgtgcttaaacctcgggcaagaatgaccccggcccctgcctcgtgctcacaggagctgccgtcagctgaagataatagcccgatggcctcggaccctctcggagtggtgcgcggaggaagagtgaatacccacgcaggaggcactgggccggagggatgcagaccgtttgctaagtttatt

SEQ ID NO: 5593 - DNA, 753 bp, Artificial Sequence
  Description of Artificial Sequence: Synthetic coding sequence
atgctaggggcgaggcttaggctctgggtgtgcgccctctgcagtgtgtgctctatgtcggtcctgcgcgcttacccaaacgcctcgccactgctgggcagttcatggggcggactgatacacctgtataccgctaccgctcggaactcctatcacctgcagatccacaaaaacgggcacgtcgatggggcaccccaccaaaccatttacagcgctttgatgattcgcagcgaagacgccggcttcgtggtgattacaggggtgatgtcaagacgctatctgtgcatggatttcaggggcaatatctttgggtcacattactttgaccccgagaattgcagatttcaacaccagacgctcgagaacgggtacgatgtgtaccactccccgcagtaccactttctggtcagcttgggcagagccaagcgggctttcctccctggcatgaatcctcccccttatagccaatttctcagccgccggaacgagattccgctcatccatttcaatacacccatcccacgtcgacacacccggagtgcagaagatgactccgagcgcgatccgctaaacgttctgaagccaagggccaggatgacccccgctccagcgagttgttctcaggagctcccgtcagcggaggacaattcccctatggcatctgaccctctgggtgtagtccgtggaggccgcgtcaacactcacgccggcggaactggtcctgagggctgtcgaccctttgccaagttcatt

SEQ ID NO: 5594 - DNA, 753 bp, Artificial Sequence
  Description of Artificial Sequence: Synthetic coding sequence
atgttaggtgccaggctgagattgtgggtgtgcgccttgtgttcagtctgcagtatgtctgtactgcgcgcctaccccaacgcatctccactgttaggcagctcgtggggaggccttatccacctgtacacggctacggctagaaacagctaccatcttcagattcataaaaacgggcacgttgacggagccccgcatcagacgatttacagcgccctgatgatcaggagtgaagatgcggggtttgtagtgatcacaggcgtgatgtcccggcgatatctctgtatggactttaggggcaatatctttgggagtcactatttcgaccctgagaattgtcgattccagcaccaaaccctagaaaacggatacgacgtgtaccatagtccacagtatcattttctggtaagcttagggagggcaaagagagccttcctacccggcatgaacccgcctccatactctcagtttctatctcgaagaaatgagattccactgatccactttaacacccctatacccagacggcacaccagatccgcagaggacgactcagaaagagaccctctgaacgtcctcaaacctagggccagaatgacgcccgcaccggcctcgtgctcgcaggaattaccaagtgccgaggataattctccgatggcttccgacccgcttggcgtggtacgcggtggacgagtgaatacacatgccggaggcacgggcccggagggctgtaggccatttgccaaattcata

SEQ ID NO: 5595 - DNA, 753 bp, Artificial Sequence
  Description of Artificial Sequence: Synthetic coding sequence
atgctcggggcgcgactcagactgtgggtctgtgccttgtgtagcgtgtgcagtatgagcgtattaagagcttaccccaacgcatctcctctgctaggctcgtcctggggcggtcttatccacctctataccgcaacagcccgaaacagctatcatctacaaatccacaagaatggccatgtggacggggcaccgcaccaaacaatctacagcgccctcatgatccgaagcgaggatgctggtttcgtcgtaatcacgggggtgatgagtcgaagatacctgtgcatggattttcgaggcaacatcttcgggtcacactatttcgacccagagaactgtcgattccagcatcagacgctggaaaacggatatgatgtgtaccacagcccccagtaccatttcttggtgtctctggggagagccaaacgagcttttctacctggaatgaacccgccaccgtattcccagttcctgtctaggagaaacgaaattcctttaatccactttaatacccccataccaagaagacatacacgatcagcagaggacgattccgaaagggatcccttaaacgtgttgaaacccagggccaggatgacacctgctcctgccagctgttcccaggagctccccagcgctgaagataactctccaatggccagtgaccccctgggcgttgtgcggggggggagagtgaacactcacgcggggggaacgggtcctgaaggatgtaggccttttgccaagtttatc

SEQ ID NO: 5596 - DNA, 753 bp, Artificial Sequence
  Description of Artificial Sequence: Synthetic coding sequence
atgttgggcgctcgccttagactgtgggtgtgtgcactttgctccgtatgttcaatgagtgtgttacgggcttaccctaatgcgtctcctctcctcgggtccagctggggcgggctaatacacctttataccgctactgccagaaattcctaccacctacaaatacataaaaacgggcacgtggatggggcgccccatcaaacgatctacagcgccctgatgataaggtctgaagatgccgggtttgtggtgatcacaggggtgatgtctcgaaggtacctgtgcatggactttcgagggaatatcttcggaagccattacttcgatccggagaactgtaggttccaacatcagactttagagaacgggtatgatgtctatcactccccacagtatcatttccttgtgtccttgggcagggccaagagagccttcctgcccggtatgaacccccctccatattctcagttcctgtcacgccgtaacgaaattcccctgatccactttaacacacccataccccgtcgtcatacgcgatccgctgaggacgactctgaacgcgacccactcaatgtactcaagcctagagcccgcatgaccccggcacctgcctcctgcagtcaggagctgccctccgccgaagataactcccccatggccagcgatccactgggggtggttcgaggagggagagtgaacacacacgctgggggtacaggaccagagggctgtcgcccgtttgccaagttcatc

SEQ ID NO: 5597 - DNA, 753 bp, Artificial Sequence
  Description of Artificial Sequence: Synthetic coding sequence
atgctgggagctcgcctccggctgtgggtgtgtgctttgtgctcggtgtgcagcatgtcggtgctccgggcataccccaacgcctcaccgttgctcggcagcagttggggaggactgatccatctttacactgccaccgctcggaactcgtaccatctccagatccataagaatggacatgtggacggagcaccgcaccaaaccatctattcggccctgatgatcagaagcgaagatgcaggcttcgtggtgatcactggggtgatgtcccgccgctatctgtgcatggatttccggggcaacatttttggttcgcactatttcgaccctgagaactgtcgctttcagcatcagactctggaaaacggctacgatgtgtaccactcgccacaataccacttccttgtctcccttggaagagccaaacgcgccttcctgccgggtatgaacccaccgccatactcgcagttcttgtctcggcgcaatgagatcccactgattcatttcaacactccaatcccaaggaggcacactcgatctgcagaggacgactcagagcgcgatcctttgaacgtgctgaagcctagagccaggatgactcctgcgcccgcgtcctgctcccaagagttgccttccgcagaagataactcacccatggcctccgacccactcggagtggtgcgcggtggcagggtgaacacgcacgccggaggaaccgggccggagggatgccggcctttcgccaaattcatc

SEQ ID NO: 5598 - DNA, 753 bp, Artificial Sequence
  Description of Artificial Sequence: Synthetic coding sequence
atgttaggagcaagacttagactgtgggtgtgcgctctttgttctgtctgctccatgtctgtgctacgcgcctaccctaacgcctcacccctgttgggctcatcctggggggggctcattcatctgtacaccgctacagctcgaaactcctatcatctgcagattcataagaacggacatgtcgacggcgccccacaccagactatatactctgctttgatgattcgcagcgaggatgctggcttcgtcgtgattaccggagtaatgagccggcgttatttgtgcatggacttccgcggaaacatatttggatcccattactttgacccggaaaactgtcgatttcaacatcagacacttgaaaatggctacgatgtctaccatagcccacagtaccattttttggttagcctgggcagagctaaacgcgcttttcttccaggtatgaacccccccccctatagtcagttcctgtccaggcgcaacgaaattccactcatccacttcaacactccgattcctcgtagacataccaggagtgcggaggacgattccgaacgcgaccccttgaatgtccttaaacctcgggcaagaatgacacccgccccagctagctgctcccaggagctgccgtccgccgaagacaattctcccatggcgtctgaccccctgggggtcgtgcgcggcggtcgggtcaacacccacgccggaggaacagggccagaggggtgccgacccttcgctaaatttata

SEQ ID NO: 5599 - DNA, 753 bp, Artificial Sequence
  Description of Artificial Sequence: Synthetic coding sequence
atgctgggggcacgcttgaggctttgggtgtgcgcgctgtgtagtgtgtgctccatgtctgttctcagagcctatcccaacgcaagccccctgttaggttcctcttggggggggttgattcacctgtacaccgcaaccgcccgcaactcttaccatctacagattcacaaaaacggccacgtcgatggtgcaccacaccaaactatttactccgccttgatgattcgcagtgaagacgctggttttgtagtcatcacaggggtgatgagtaggcggtatctctgcatggactttagaggcaatatctttggaagtcactattttgaccctgagaattgcaggtttcaacatcagaccttggagaatggctatgacgtctatcactcaccccagtaccattttctggtcagcctgggacgggccaaacgggcttttctgcctggtatgaatcctccaccgtatagccagttcctctctaggcgcaatgaaatacctctgattcatttcaatactcctattccacgaaggcacacaaggtccgctgaagacgattccgaacgggatccactcaacgtgctgaagccaagggcaaggatgacgcctgccccggcatcttgttctcaggaactgccttcagctgaagacaactcccctatggcaagtgaccctctcggtgtcgtacgaggcggcagggtgaacacacacgctggaggcacgggaccggagggctgtagaccattcgctaaatttatt

SEQ ID NO: 5600 - DNA, 753 bp, Artificial Sequence
  Description of Artificial Sequence: Synthetic coding sequence
atgttaggagcgcgcttgcgcctttgggtatgtgctttgtgctcggtttgtagcatgtctgtgcttagagcttaccctaatgcttcgcctctgttgggaagttcttggggtggactgattcatctgtacactgcgaccgctcggaattcgtatcatcttcagatccacaaaaatgggcatgtggatggcgcgcctcatcaaacaatttattcggcactgatgattcgctcagaagatgcagggtttgtggtgatcactggcgtcatgtcacgtcgctatctgtgcatggattttagggggaatatctttggctctcattatttcgatccagaaaattgccggtttcaacatcaaacgttagaaaacggctatgatgtctatcacagcccgcaataccatttcctcgtttcattaggccgtgcgaagcgcgcgttcttaccagggatgaatccaccgccgtattctcaatttctgtctcgtcggaacgagatcccgttgattcattttaacacaccgattccgcgtcggcatacacgatcagcggaagacgattctgaaagggatcctcttaatgtcctgaagcctcgggcaagaatgacgccggcacccgcttcttgctctcaagaattgcctagcgcggaagataattcaccgatggctagcgacccactgggagttgttcgaggcggccgcgttaacacacacgcaggaggtacaggcccagagggctgcagaccatttgccaagtttatc

SEQ ID NO: 5601 - DNA, 753 bp, Artificial Sequence
  Description of Artificial Sequence: Synthetic coding sequence
atgctcggagcccgcctcagactgtgggtctgtgccctgtgttcagtgtgcagcatgtcggtgctgcgggcctacccaaacgcgtcgccactgcttggatcgtcgtggggtggcctgatccatttgtacacggcgactgcaagaaactcctaccacctgcagatccacaaaaacggccacgtcgacggcgctcctcaccagactatctactcggcactgatgattcgctctgaggacgccggattcgtggtgattaccggcgtgatgagccgccgctacttgtgtatggacttcaggggcaacatctttggatctcactactttgacccagagaattgccggtttcagcatcagaccctcgaaaacggctatgacgtgtaccattccccgcaataccacttccttgtcagcctggggcgcgccaaacgcgcgttccttccggggatgaaccctccgccgtactcacaattcctgtcgcgccggaacgaaattccgctcatccatttcaataccccgatccctcgtaggcacacccggtccgccgaagatgactccgaacgcgatccgctgaatgtcctgaagccccgcgcgcgcatgacccccgcgcctgcctcctgctcccaggaactgccgtcggcggaggacaactcaccgatggctagcgatccgctgggagtggtgcgcgggggccgcgtaaatactcacgcaggcgggactggtccagaaggatgccgcccgtttgccaaattcatc

SEQ ID NO: 5602 - DNA, 753 bp, Artificial Sequence
  Description of Artificial Sequence: Synthetic coding sequence
atgttgggtgcgagactccgcctgtgggtgtgcgctttgtgttcggtgtgctcaatgtccgtgctgcgcgcatacccgaacgcctcaccgctgctcgggagctcctggggaggcctcattcacctgtacaccgccaccgctaggaatagctaccacctgcaaatccacaaaaacggccacgtcgatggcgccccacatcaaactatctactccgcccttatgatccgctcggaagatgcaggatttgtggtgatcacgggagttatgtcgagacggtacctgtgtatggacttcagaggcaacatcttcggatcccattacttcgatcctgagaattgccggtttcagcatcagaccctggaaaatggatacgacgtgtaccatagcccgcaataccacttcctcgtgtccctggggagagccaaaagggcgtttcttccggggatgaatccgccgccatactcacagtttctctcccgccgcaacgagatccctctgatccacttcaacaccccgatcccgcgcaggcacacccgcagcgccgaagatgactcagagcgggaccctctgaatgtgctgaaacctcgcgcgcgtatgacccctgcgccagcatcgtgttcgcaggagctcccatcggctgaggacaacagcccaatggccagcgacccgctcggagtggtcagaggaggacgcgtcaatacccacgcaggtgggactggccccgaagggtgcagaccattcgccaaattcatc

SEQ ID NO: 5603 - DNA, 753 bp, Artificial Sequence
  Description of Artificial Sequence: Synthetic coding sequence
atgctcggagcacgactacggctatgggtgtgtgcattgtgctctgtctgtagcatgtcggtgctgagagcatatccaaacgcttctccactgctgggtagcagctggggaggactgattcacttgtatacagctaccgcaagaaacagttaccacctgcagattcacaagaatgggcacgttgatggcgccccacaccagacgatctacagtgcactgatgattcgaagtgaggacgccgggttcgtcgtgataaccggcgtgatgagtagacgctacctgtgcatggacttccgcgggaacattttcggaagccactactttgaccccgagaactgtaggttccagcaccagaccctggagaacggatacgacgtataccattctcctcagtatcactttcttgtatctctgggacgtgccaagagggcattcttacccgggatgaaccccccaccgtacagtcaattcctaagccgtagaaatgaaattcccctaattcatttcaacacccccattccacggcgccacacacgaagtgctgaggacgattcagagcgcgatcccctgaacgtcctgaagcctagagcccggatgacaccagcacccgcaagttgtagccaggagttacctagcgcagaagataattctcccatggcatccgatccattgggcgtggtgcgggggggcagggtgaacacacacgcgggtggcacaggacctgagggctgccgcccattcgctaagtttatt

SEQ ID NO: 5604 - DNA, 753 bp, Artificial Sequence
  Description of Artificial Sequence: Synthetic coding sequence
atgctcggcgcaaggctgaggttatgggtgtgtgctctgtgcagcgtctgcagcatgtcagttcttagggcttaccccaacgcgagccctctcctgggaagctcctggggaggactcatccacctgtacactgcgactgcacggaattcataccacttgcaaatccataagaacggccatgtggacggagcacctcatcaaaccatttacagcgccctcatgatcaggagcgaagacgctggctttgtcgtcattaccggagttatgtcccggaggtatctgtgcatggattttcgtggaaacatctttggatctcattactttgatcctgagaactgcagatttcagcaccagactctggaaaacggttatgacgtctaccattccccccagtatcatttcctggtttcgctaggtagggctaaaagagcttttctgcccggtatgaatccacccccgtactcacaattcttgagccgcagaaatgagatcccactgatccatttcaacaccccaatccctaggaggcacactaggtctgctgaagacgactctgagagggacccgctgaacgtgcttaaacctagggctcgtatgacccccgcccctgcttcatgttcacaagaattgccctcagctgaagacaactctccaatggcttcggatcctctgggcgtagtgagaggcgggagagtgaacacccacgccgggggaacgggcccagagggctgcaggccgtttgcaaagttcata

SEQ ID NO: 5605 - DNA, 753 bp, Artificial Sequence
  Description of Artificial Sequence: Synthetic coding sequence
atgctgggcgctagactccgcctctgggtgtgtgctctgtgctctgtgtgtagcatgtccgtgctgcgagcatatcctaacgcctcaccgcttctcggttcgtcgtggggcgggcttatccatctctacactgcgaccgctcgcaactcataccatctgcagatccacaaaaacggacatgtggatggagccccacaccaaaccatctactccgcactgatgatccgctccgaggacgccggatttgtggttataaccggagtcatgtcacggcggtacctgtgcatggatttccgaggaaacattttcggatcacactacttcgacccggagaattgcagattccaacaccaaactctggaaaacgggtacgatgtgtaccactcgccacagtaccatttcctcgtctccctcggcagagcgaagagggcgtttctgcccgggatgaatccaccaccttactcccagttcttgtcgcggaggaacgaaatcccgcttatccacttcaatactcccatcccgcgcaggcacactagaagcgccgaggacgactccgagcgggaccctctgaacgtgcttaagccacgagcccgtatgacccctgcgccggcgtcgtgctcccaagaactgccgtcggcagaagataattcccctatggcaagcgacccgctgggggtggtgcggggtggacgcgttaacactcatgccggaggaacgggtccagaaggatgccgtccgtttgctaagttcatc

SEQ ID NO: 5606 - DNA, 753 bp, Artificial Sequence
  Description of Artificial Sequence: Synthetic coding sequence
atgctgggggcccgcctgcgactttgggtatgtgcactctgcagcgtgtgttctatgtctgtcctgcgggcctatcctaacgcctctcctctgctcgggtcctcatggggcgggctcatccacctgtacacggcgaccgccagaaatagctaccatctccagatccacaagaacggtcatgtcgacggtgcccctcatcaaactatctactccgctttgatgataaggtccgaagacgcgggatttgtggtcatcactggtgtcatgagcaggcgatatctgtgtatggactttaggggtaacatctttggatcccactacttcgatccggagaactgccgcttccagcaccagactctcgaaaatggctatgatgtgtatcactccccccagtatcatttcctggtgtcactgggtagagcgaaacgggcttttctcccgggcatgaatccccctccctatagccaattcctgagcagacgcaacgagatcccacttattcacttcaatacaccaatacccaggagacatacccggagcgcggaagatgatagcgagcgggatcctttgaacgttcttaagccccgcgcccgaatgacgcctgcccctgcatcctgtagccaggagctgccatcagctgaggacaatagtcctatggcgagcgacccgctgggagtcgtgcggggtggccgggtcaacacacatgctggaggaactggaccggaggggtgtagacccttcgccaagtttata

SEQ ID NO: 5607 - DNA, 753 bp, Artificial Sequence
  Description of Artificial Sequence: Synthetic coding sequence
atgttgggcgcgcgactaagactttgggtctgtgccctatgctccgtctgctcaatgtctgtgctaagagcttacccgaacgcaagtcctctgctcggcagcagctggggaggcctcatacacctttacacagcaaccgcgagaaatagctaccacttgcagatacacaaaaatgggcacgtcgatggggccccgcatcaaactatctactccgcgctgatgattaggagcgaagatgctggctttgtggtgataactggggtgatgagcaggcgatatctctgtatggattttcgagggaatatcttcgggagtcactatttcgatcctgaaaactgcagattccagcatcagaccttggaaaacggctacgacgtgtaccactccccacagtatcatttccttgtctcactagggcgtgctaagcgggccttcctgccagggatgaaccctcctccatattctcagtttctgtctagacggaacgaaatccccctgatccattttaacaccccaatccctcgacggcacactcggtccgcagaggacgactcagagcgcgacccactcaatgttctcaaacccagggctcgaatgacccccgcacccgcttcctgtagccaggagttgccatctgcagaagataactcaccgatggcgtccgatccccttggagtggtacgcggaggccgggtgaacacacatgctggcggcactggtcccgaagggtgtcggccatttgctaaatttata

SEQ ID NO: 5608 - DNA, 753 bp, Artificial Sequence
  Description of Artificial Sequence: Synthetic coding sequence
atgcttggtgccagactgcggctttgggtctgtgcactgtgctccgtgtgttcaatgtcggtgctgcgcgcctaccctaatgcctcacccctcttgggttcgagctggggtggactcattcacctgtacactgccacggcgcgtaactcgtaccacctgcagatacataagaacgggcacgtggacggggcaccacatcagaccatctactcagcccttatgattcgttccgaagatgcaggatttgttgtgattaccggcgtcatgtcccgtcgctacttgtgcatggactttcgcggcaatatcttcgggtcccattactttgatccggaaaactgccgttttcaacatcaaactttggagaatggctacgacgtctaccactcgcctcaataccattttcttgtgtccctgggcagagctaagcgagcattcctcccgggaatgaatccccctccgtacagccagttcctttcccggcggaacgagatcccccttattcactttaacacgccaatccctcggaggcataccaggtccgcagaagatgattctgaacgtgacccccttaatgtcctcaagccaagagcaaggatgaccccagcacctgcctcatgttcgcaagagctgccctcggctgaagataattctccaatggctagcgatcccctcggagtggtgagaggaggtcgggtcaacactcacgcaggaggtaccggaccagagggctgccgcccgttcgccaagtttatc

SEQ ID NO: 5609 - DNA, 753 bp, Artificial Sequence
  Description of Artificial Sequence: Synthetic coding sequence
atgctcggggcgcgattacggctgtgggtgtgcgccttgtgcagcgtttgttcgatgtcagtgctaagggcataccccaacgcatctcctctgctcggctcttcatggggtggcctgatacatctctatactgctacggcaagaaacagctatcacctccagattcataagaacgggcatgtcgatggtgctccacaccagactatctattccgccctcatgatcaggtctgaggatgcaggtttcgttgtgataactggcgttatgtcacgtcgctacctgtgcatggatttcaggggcaacatcttcggcagccattacttcgatccagaaaattgcaggttccaacaccaaaccctggagaatggatatgacgtctaccatagcccccagtaccactttttggtgtccctgggccgtgcgaaacgcgccttcttgccagggatgaaccccccaccctactcacagttcctgtcacggcggaatgagatacccctaattcatttcaacaccccaattcccagaaggcatactcgctcggccgaggatgattctgaacgcgacccactcaatgttttaaaaccaagagcccgcatgacccccgcaccggcatcttgtagccaggagctaccctccgccgaagacaacagcccaatggcaagtgaccctctcggcgtggttcggggggggcgagttaatacgcatgcagggggcactggaccggagggttgccggccattcgccaagttcatc

SEQ ID NO: 5610 - DNA, 753 bp, Artificial Sequence
  Description of Artificial Sequence: Synthetic coding sequence
atgcttggtgcacgcctgaggctgtgggtttgcgctctgtgctccgtgtgctctatgtccgtgctgcgcgcgtacccaaacgccagccctctcctgggaagcagctggggggggcttatccacctctacaccgccacagctcggaactcctaccaccttcagatccacaagaatggtcacgtggacggagcaccccatcagaccatatactctgcactgatgatcagatccgaagacgcaggctttgtcgtgattacaggagtaatgagtagacgctacttgtgcatggattttcgcggcaacattttcggttcacactatttcgaccccgagaattgccgctttcagcatcagacgctcgagaatggatacgacgtttaccattcacctcaataccactttctggtgagcctgggacgggcaaagcgagcgttcttgcctggaatgaatcccccaccctattctcagtttttgagtagacggaatgagatccccctgatccatttcaataccccaattcctcggcgccacacccggtctgccgaggatgacagcgagcgagatcccctgaacgtgcttaagccgcgggctaggatgaccccggcccccgcttcctgctcccaggaacttccctccgcagaggacaattctcctatggccagcgatccactgggagtggtgaggggcggacgggtgaacactcacgcggggggcactggtcccgaaggctgtaggccctttgcaaagttcatt

SEQ ID NO: 5611 - DNA, 753 bp, Artificial Sequence
  Description of Artificial Sequence: Synthetic coding sequence
atgcttggagcgcgacttcgcctttgggtgtgcgcactctgctcagtctgtagcatgtctgtgcttagagcataccccaacgcctcaccactgcttgggtcatcgtggggtgggctgattcatttgtataccgcaactgcacgcaattcgtaccaccttcagatccacaaaaatggtcacgttgacggagcccctcatcaaactatttactcggcacttatgattcggtcggaagatgcaggttttgtggtgataactggtgtcatgtcaaggcgctacctgtgtatggatttcagaggtaacattttcgggagccactattttgatccagagaactgcagatttcaacatcagaccctggagaacggatacgatgtgtaccattccccacagtaccacttccttgtgtcccttggtagggcaaaaagagcattccttcccggaatgaatccccctccgtattcgcaatttctttctcgtagaaacgagattccactgatccatttcaatacccccattcctcgccgccataccagatccgcagaggatgattccgaacgcgacccactcaacgtccttaagcccagagcacggatgaccccagctccggcaagctgctcccaggaacttccttcggcggaggacaactcccctatggcctcggatcccttgggcgtggtccgaggaggtcgcgtgaacacccatgcaggaggcacgggtcctgagggctgtaggcctttcgccaagttcatc

SEQ ID NO: 5612 - DNA, 753 bp, Artificial Sequence
  Description of Artificial Sequence: Synthetic coding sequence
atgctcggtgctcgcctcagactctgggtctgtgccctgtgttcagtgtgctcgatgagcgtcctgcgcgcctacccgaacgcttcccctctgctcggatcgtcctggggcggactgatccatctgtacaccgcaaccgcgaggaattcgtaccacctccagatccacaaaaacggccacgtggatggagcgccacaccagacgatttactcggcccttatgatccgatccgaggacgccgggttcgtggtgatcactggggtgatgtctcggcggtacctgtgcatggattttagaggaaacatctttggctctcactacttcgacccggagaactgtcggtttcaacaccagactctggagaatgggtacgacgtgtaccattcccctcagtaccacttcctggtgtctctgggaagagctaagagggcctttctgcctggcatgaacccgccgccttattcgcagttcctgtcacgccggaacgaaatcccactgatccactttaacaccccgatcccacggcgccatactagaagcgccgaagatgatagcgaacgcgacccgctgaatgtccttaagccacgggcacgaatgacgccggcaccggcttcatgctcgcaagagcttccttccgctgaggacaacagcccgatggcgtccgatcccctgggtgttgtgcggggaggaagggtcaatactcatgcgggaggaactggtccggagggatgcaggcccttcgccaagtttatc

SEQ ID NO: 5613 - DNA, 753 bp, Artificial Sequence
  Description of Artificial Sequence: Synthetic coding sequence
atgttgggcgctagactcagattgtgggtctgcgctctgtgctcggtgtgctctatgagcgtgcttcgggcctacccgaacgccagcccgctcctggggtcctcgtggggagggctgatccacctctacaccgcgactgctcgcaattcctaccacctccagattcataaaaatggacacgtggacggagccccgcatcagaccatctacagtgcgcttatgatccggtccgaggacgcgggcttcgtggtgatcactggtgtgatgtcacgccgatatctgtgcatggacttcaggggcaacatttttggcagccactactttgaccccgaaaactgtcggttccaacaccaaaccctggaaaacggatacgatgtctaccactcaccgcaataccatttcctggttagcctcggaagggcaaagcgcgccttcctccctgggatgaacccacctccttactcacagttcctgagccgtcgcaatgaaatcccactgatccacttcaatactcccatcccgcggcgccatacgcggtcggccgaggacgattccgaaagggacccactgaacgtcctgaagccgcgcgccagaatgaccccagccccagcatcctgctcgcaggagcttccgtccgcagaggataactcgcctatggcgtcggatcccctgggagtggtgcgcggcggaagagtcaacacccatgccggaggaactggtccggaaggatgtcggccgtttgcaaagttcatc

SEQ ID NO: 5614 - DNA, 753 bp, Artificial Sequence
  Description of Artificial Sequence: Synthetic coding sequence
atgcttggcgctcggctgagattgtgggtctgtgctctctgctcggtctgcagcatgagtgtgctgcgcgcttatccgaacgccagccctttactggggagcagctggggcggtctcattcatctctatacagcgacggcgcgcaacagctatcacttacagatccataagaatggacacgtcgacggcgcgccccatcaaacgatctattccgcactgatgattcgtagcgaggatgccggcttcgtcgtgatcacaggcgtcatgtcgcggcggtatctttgcatggatttccgaggtaatatctttgggtcacattactttgacccggaaaattgtcgatttcagcatcaaacgctggaaaatggctatgatgtgtatcattcgccgcagtatcatttcttagtgtcccttgggcgagccaagcgggcttttttgccagggatgaatccaccaccctattcccagtttctatccagacgaaacgagataccacttattcattttaatacaccgattccgcggcgccacacaagaagcgcagaggatgattcggagcgtgatccgcttaacgttctcaagccgcgtgcacgtatgacccctgcccccgcgagctgttctcaagagctaccttccgcggaggataacagcccaatggcgtccgatccactcggcgtcgtccggggtggtcgggtcaacacgcacgctggaggtactggtccggaaggatgcagacccttcgctaagtttatc

SEQ ID NO: 5615 - DNA, 753 bp, Artificial Sequence
  Description of Artificial Sequence: Synthetic coding sequence
atgctgggagcccgtctccggctgtgggtgtgcgctctttgttccgtgtgctccatgtcggtgctcagagcctatccaaacgccagccctctcctcggctcctcgtggggggggctgatccatctctatacagccacggcccgcaacagttaccacctgcagatacataagaacggacacgttgatggggccccacaccagactatttactctgcccttatgatccgtagtgaggacgcggggttcgtggtgatcactggagttatgagtcgaagatatttgtgcatggactttagaggtaatatatttggatctcactattttgatcctgaaaactgtcgctttcagcaccagactctcgagaacggatatgatgtctatcattcacctcagtaccactttctggtttcattggggagagcaaagagggcatttctgccgggcatgaacccaccaccatatagccagttcttaagtcgccgcaatgagatccctctgatccatttcaacaccccaatcccacgcagacatacacgttccgctgaagatgatagtgaacgtgaccccctgaacgtgctaaagccccgggccaggatgacacccgcacccgctagctgcagccaggagctgccaagcgccgaggataattccccgatggcatccgatcctctgggcgtggtgagagggggccgggtcaatacccacgcaggagggacgggacccgagggctgccgcccattcgccaaattcatt

SEQ ID NO: 5616 - DNA, 753 bp, Artificial Sequence
  Description of Artificial Sequence: Synthetic coding sequence
atgctgggggccaggctaaggttatgggtgtgcgctctctgtagtgtgtgttcaatgtccgtcctccgggcctatcccaatgcatctccgctattgggatcctcttggggagggcttatacatttatatacagcaacagctaggaattcctatcatctgcagattcacaaaaatggacatgtcgatggagctcctcatcagacaatttattccgctctcatgattcggtccgaagatgcagggttcgtggtcatcacaggagtaatgtccaggcggtacctatgcatggattttaggggaaatatatttggatctcactatttcgatccagaaaattgtcggtttcagcaccagacactggaaaacggatatgatgtgtaccacagtcctcagtatcactttctggtctctctcggaagagccaagagggcttttctgccaggaatgaatcccccaccgtattcccagtttctgtcacggagaaatgagattcctttgatacatttcaatacacctattcccaggcgacacactagatccgccgaagatgatagtgaacgggatcctcttaacgtcctcaaaccacgggctcgaatgacgccagctcctgcctcctgctctcaggaactaccctccgctgaagacaactcacctatggcctcagatcctttaggggtagtgaggggagggcgagttaatactcatgccgggggaactgggcctgaggggtgccgcccctttgctaaatttatt

SEQ ID NO: 5617 - DNA, 753 bp, Artificial Sequence
  Description of Artificial Sequence: Synthetic coding sequence
atgttgggcgccaggctgcggctgtgggtgtgcgcgctatgcagtgtgtgtagtatgtccgttctgcgcgcttacccaaacgcgtctccattactgggtagctcctggggtgggctgatccacctctacaccgcgacggcgcgcaactcttaccacctccagatccacaagaatggccacgtggatggagctccgcatcaaactatatatagtgccctgatgatccgcagtgaagatgccggttttgtggtgatcaccggcgtgatgtcaagaaggtacctgtgcatggattttaggggaaatattttcggaagccattacttcgaccctgaaaattgccgattccagcaccaaactctagagaacgggtatgacgtgtaccactcgccacagtatcatttcctggttagtttaggcagggccaaaagggcatttctgcccggcatgaatcccccaccttacagccaatttctgtcacgtagaaatgaaatccctcttatacacttcaatacacccattcctcgcagacatactcgctccgcggaagatgacagtgaacgcgaccccttgaatgtgctcaagccaagggctagaatgaccccagcacctgcttcctgttcccaagagctgccttctgctgaagacaactccccaatggcctccgacccacttggcgtcgtaaggggaggacgtgtgaatacccatgccggcggtacggggccagagggttgtcggccttttgctaagttcatc

SEQ ID NO: 5618 - DNA, 753 bp, Artificial Sequence
  Description of Artificial Sequence: Synthetic coding sequence
atgttgggcgcgcgcctccgcctctgggtgtgcgctctgtgctccgtgtgctcgatgtcggtgctcagagcctacccgaacgctagcccactccttgggtcctcatggggaggtctgatccatctctatactgcgaccgctcgcaactcataccaccttcagatccataagaacggacacgtggacggagcgccacaccagacgatctattcagccctcatgatcagaagcgaggacgccggattcgtggtgattaccggtgtgatgtcccgccgctacctgtgcatggatttcagaggaaatatcttcggctcacattacttcgacccggagaactgtcgctttcaacaccagactctcgagaatgggtacgatgtctaccactcaccacaataccatttcctggtgtcgcttggacgcgccaagagagcgtttctgcccggcatgaatcctccgccatattcgcagtttctgtcgcgcagaaacgaaattccgctgatccacttcaacactcctatccctaggagacacactcggtccgctgaggacgacagtgagcgggaccctctcaacgtgctgaaaccacgcgcccgcatgacccccgcgcccgcatcgtgttcacaggaactgcccagcgctgaggacaatagcccgatggcgtcggacccgcttggcgtggtgcgcggaggcagagtcaatacccatgcgggaggaaccggtcctgaaggatgcaggccattcgccaagttcatt

SEQ ID NO: 5619 - DNA, 753 bp, Artificial Sequence
  Description of Artificial Sequence: Synthetic coding sequence
atgctcggagcacggctgcgcctgtgggtgtgcgccctgtgctccgtgtgctccatgtcagtgctgcgggcttacccaaacgcctcgcctctgcttggctcgtcttggggaggattgatccacctctacactgcgacggcgcgcaatagctaccatttgcagatccacaaaaacggacacgtggacggagccccacaccagaccatatactccgccctcatgatcaggtcggaggacgctggtttcgtggtaattaccggagtgatgagccgccgctacctgtgcatggactttcggggcaacattttcggatcgcactacttcgacccggaaaactgtcgcttccagcaccaaactcttgaaaatggctacgacgtgtatcactcccctcaataccatttcctcgtgtccctgggacgcgccaagcgcgccttcttgccgggcatgaatccaccaccttactcccagttcctgtctcgccggaacgaaatccctcttatccatttcaatactccgattcctcggcgccatactcggtcagccgaggatgacagcgaacgggatccgctgaacgtcttgaagccgagagcacgcatgactccagcgccggcctcgtgctcgcaggagctgccgtccgccgaagataacagccccatggcgtcagatcctttgggagtggtccgcggaggaagagtgaacacgcatgccggaggcactggaccggaaggctgcagacccttcgcgaagtttatc

SEQ ID NO: 5620 - DNA, 753 bp, Artificial Sequence
  Description of Artificial Sequence: Synthetic coding sequence
atgctcggagcaaggcttcgattgtgggtctgtgcgctgtgctcagtgtgttcgatgtcagtcctccgggcctacccaaacgcatcacccctgctggggtccagctggggaggactgatccacctctacaccgcaaccgcaaggaattcctaccatctccaaattcataagaacggtcatgtcgatggggccccacaccagacgatttactcagcattgatgattcgcagcgaagatgcgggtttcgtggtgattacgggtgtcatgtccagaaggtacctgtgtatggattttagagggaacatttttggatcacattacttcgatccggaaaattgcagattccagcatcagactctcgaaaatggttacgatgtgtaccattccccacaatatcattttcttgtgtccctcggcagagcgaagagagccttccttccagggatgaacccacctccctactctcagtttctgtcgcgcaggaacgaaatccctcttattcatttcaacacccctattcccaggagacatacccgttccgcagaagatgattcggaaagagatccactcaatgtcctgaagcctagggcaagaatgacccctgcccctgcaagctgtagccaggagctgccaagcgctgaggacaattcaccgatggcctccgaccccctgggggtggtgagaggaggacgggtgaacacccacgctggaggaaccggccctgagggatgccgtccttttgcgaagttcatc

SEQ ID NO: 5621 - DNA, 753 bp, Artificial Sequence
  Description of Artificial Sequence: Synthetic coding sequence
atgttaggtgcgcgattacgtttatgggtatgtgcgctatgttcggtatgttcgatgtcggtattacgagcgtatccgaatgcgtcgccgttattaggttcgtcgtggggtggtctaatacatttatatacggcgacggcgcgaaattcgtatcatctacaaatacataaaaatggtcatgtagatggtgcgccgcatcaaacgatatattcggcgttaatgatacgttcggaagatgcgggttttgtagtaataacgggtgtaatgtcgcgtcgatatttatgtatggattttcgtggtaatatatttggttcgcattattttgatccggaaaattgtcgatttcaacatcaaacgctagaaaatggttatgatgtttatcattcgccgcaatatcattttctagtatcgttaggtcgtgcgaaacgtgcgtttctaccgggtatgaatccgccgccgtattcgcaatttttatcgcgacgtaatgaaataccgttaatacattttaatacgccgataccgcgacgtcatacgcgttcggcggaagatgattcggaacgtgatccgctaaatgtattaaaaccgcgagcgcgaatgacgccggcgccggcgtcgtgttcgcaagaattaccgtcggcggaagataattcgccgatggcgtcggatccgttaggtgttgtacgtggtggtcgagttaatacgcatgcgggtggtacgggtccggaaggttgtcgtccgtttgcgaaatttata

SEQ ID NO: 5622 - DNA, 753 bp, Artificial Sequence
  Description of Artificial Sequence: Synthetic coding sequence
atgctgggagcgcgcctgcgtctgtgggtgtgcgcactttgttcagtgtgctcgatgtcggtcttgcgcgcttaccctaacgcgagcccattgctgggctcgtcatggggcggtttaattcatctgtacacggcaacggcgcgcaatagttaccatctgcagatccacaagaacggtcatgtggatggtgctccccatcagacaatctattccgcgcttatgatacggtcagaggacgctggcttcgttgttatcacaggcgtcatgagccgccgctacctgtgtatggactttcgcggtaacatcttcggttctcattacttcgatccggagaattgccgattccagcaccagaccctggagaacggatacgatgtttaccattcaccccagtaccattttctggtgtcactgggccgcgccaaacgggccttcctgccaggaatgaatccaccaccatacagccagttcctttcacgcaggaatgaaatccccttaatacatttcaacactcctataccccgtagacatacccgttccgccgaggatgatagcgagcgtgacccgctaaatgtgctgaagccgagagcgcgaatgacgcccgcgccagcttcctgcagtcaggaactgccgagcgccgaggataattcgcctatggcctcggatccactgggcgtggtgcgcggaggcagagtcaacactcacgccggtggcacaggccccgagggctgccgtccgttcgcgaagttcata

SEQ ID NO: 5623 - DNA, 753 bp, Artificial Sequence
  Description of Artificial Sequence: Synthetic coding sequence
atgttgggtgcacgtctccgcctgtgggtctgcgcactctgctctgtctgctccatgagcgtcctgagggcttacccaaacgcttcccctttgctgggcagtagttggggcggactgatccacttgtatactgcaacagccagaaactcctaccacctccaaatccataagaacggccacgttgacggcgccccccaccagaccatttacagcgcacttatgatccgctccgaagacgcaggattcgtggtgattaccggcgtaatgtccaggaggtatctttgtatggatttccgtggaaatatctttggatcccactacttcgatcctgaaaactgcagatttcagcaccaaactttggaaaatggatatgacgtgtatcattcaccccagtaccacttcctggttagtcttggtagagccaaacgcgcattcctgccaggaatgaacccaccaccctactctcagttcttgtcacgccgcaacgaaattccacttatacactttaacacccctatcccaagacgtcacacaaggtcagccgaagatgacagtgagcgcgaccccctgaatgttttgaaaccacgtgcacgtatgacaccagccccagcctcatgtagtcaagagctgccttcagcagaagataatagccccatggcctccgaccctctcggagtcgtcaggggaggtagggtgaacacccatgccggtggaaccggtcccgagggctgtcgccctttcgccaagtttata

SEQ ID NO: 5624 - DNA, 753 bp, Artificial Sequence
  Description of Artificial Sequence: Synthetic coding sequence
atgctgggtgcaagacttaggttgtgggtttgtgccctctgctccgtgtgctcgatgtccgttctgagagcataccctaacgcctcgccactcctgggttcgagctggggaggtctgattcacctttacacggctaccgcgcgaaattcataccacctccagattcacaaaaatggacatgtggatggtgctcctcaccagaccatttactccgccttgatgataaggtctgaagatgcaggcttcgttgtgataactggagtgatgtcccgccgttacctgtgtatggactttagagggaacatttttgggtcacattacttcgatccagaaaactgccgcttccaacatcagacgctggaaaacggatacgatgtgtaccatagccctcagtatcattttcttgtgtcgcttggacgtgcgaaacgggcttttctgcctgggatgaatccacccccatactcccaatttctgtcgcggagaaacgagattcctcttattcactttaacactcccatcccgcggcgtcatacccggagcgcggaggacgattcagaaagggatcccctgaacgtgcttaagcctcgcgcccgtatgacccccgctcctgcctcatgcagccaagagctcccatccgcagaagataactccccgatggcgtcggacccactcggtgtcgtgcgaggaggtagagtgaatacccatgcaggtggaaccgggccggagggctgtcggccattcgcaaagttcatc

SEQ ID NO: 5625 - DNA, 753 bp, Artificial Sequence
  Description of Artificial Sequence: Synthetic coding sequence
atgttgggcgcaagactcaggctctgggtgtgtgcgctgtgttctgtttgttctatgagcgtgcttagggcctacccgaacgcttcaccactgctgggttccagttggggtggactgatccacctctacaccgcgacagcccgcaattcttaccatctccagatacataagaacggccacgttgatggcgcgccgcaccaaaccatatacagtgcgcttatgatccgctcagaggacgccggcttcgtggtcatcaccggagttatgagccgcaggtacctttgcatggattttcgcggcaacattttcggaagtcactacttcgatcctgaaaattgccgctttcagcatcaaacactggaaaacggatatgacgtgtaccattccccccaataccacttcttggtctctcttggcagggccaaaagagccttcctcccaggtatgaatccgccaccctactctcagttccttagccgcagaaacgaaatcccgctcattcatttcaacacgccaataccacgccgccacacccgctccgccgaggacgatagcgagagagatcccctcaacgtgctgaaacccagggcacgcatgaccccagctcctgccagctgttcacaggaactcccttctgccgaggataattcacccatggcctctgacccacttggagttgttaggggtggccgcgtgaacacccacgctggaggaacaggtcccgagggatgcagacctttcgctaagttcatt

SEQ ID NO: 5626 - DNA, 753 bp, Artificial Sequence
  Description of Artificial Sequence: Synthetic coding sequence
atgctgggtgctaggcttcggctctgggtgtgtgctctgtgctcggtctgttccatgtcggtcctgcgcgcctaccccaatgccagcccgttgcttggctcatcctggggaggactcatccacctctacactgcgactgccagaaactcctaccatctgcagatccacaaaaacggtcacgtggacggagcccctcaccagacgatctactcagcactgatgatcaggagcgaggacgccggcttcgtcgtgatcaccggagtgatgtcacgccgctacttgtgcatggacttccgcggaaacattttcggatctcattacttcgaccccgagaattgccgcttccagcaccagaccctggaaaatggatacgatgtgtaccattcgccacagtatcatttcctggtgtccttgggccgggcgaaacgggctttcctgccgggaatgaacccacctccgtacagccagttcctgtcgagacgaaatgaaatccccctgatccactttaataccccaatcccaagacggcatacccggtccgcagaggatgactccgaacgcgatccactgaatgtgctgaagccgcgggcacgcatgaccccggctccggcatcgtgctcacaggaactgccctcagccgaggacaacagtccgatggcatcagacccacttggtgtggtgagaggaggccgagtgaacactcacgctgggggcactggaccggaagggtgccgcccgttcgctaagttcatc

SEQ ID NO: 5627 - DNA, 753 bp, Artificial Sequence
  Description of Artificial Sequence: Synthetic coding sequence
atgcttggagctcgtctgagactttgggtctgcgccttgtgcagcgtctgcagcatgtcggtattgagggcttatccgaatgcttccccacttcttgggtctagctggggtggattaatacacctgtacaccgctaccgcgagaaacagctaccatttacaaatccacaagaatggtcatgtggacggtgcgcctcatcaaaccatttatagcgctctgatgattcggtcagaggatgcagggtttgttgtcattacaggggtaatgtccaggcggtacctttgtatggacttcagaggaaacatctttggatctcactatttcgacccagaaaattgtagattccaacaccagacactggaaaatgggtacgatgtctatcattcacctcagtaccacttcttagtgagcttaggacgagctaaaagagcctttctccctggaatgaacccacctccgtattctcaattcttaagtaggagaaacgagattcccttgatacattttaacacacctattcctcgcagacatactcgtagcgctgaagatgatagcgaacgagatcctctcaatgttctcaaaccaagggcacggatgactccggctccggcatcgtgttcacaggaactaccatccgcagaggataactccccaatggcctcagatcccttaggtgttgttcgggggggtagggttaacactcatgccggaggtacaggtccggaaggttgtcgtcctttcgctaaattcatt

SEQ ID NO: 5628 - DNA, 753 bp, Artificial Sequence
  Description of Artificial Sequence: Synthetic coding sequence
atgcttggggcacgcctgaggctctgggtctgtgcactgtgcagcgtgtgctcaatgtccgtgcttcgcgcttatcctaatgccagtcccttgcttggaagttcctggggcggccttattcatctgtataccgcaactgctcggaattcctaccacctgcagattcacaagaacggtcatgtcgatggagccccacatcagactatatattcagctctgatgataaggtctgaggacgctggcttcgtggtgattacgggcgttatgtctagaaggtacttgtgtatggactttagggggaatattttcgggagccactattttgaccccgagaattgcagatttcagcaccagacccttgagaacgggtacgacgtctaccactccccacagtaccattttctggtgtcactggggcgggcgaaacgggccttcctgccaggcatgaaccctcctccctatagtcagttcttatctaggcgtaacgagatccctttaatccactttaataccccaatacctagacgtcacacccggtccgcagaagacgatagcgagagagacccgctgaatgtgctgaaaccaagggctcgtatgactcccgcgccagcatcttgctcacaagaactacctagtgctgaagataattcacctatggcgagcgatcccctaggcgttgttcggggaggacgggtcaatacccatgccggcggtactggaccagagggatgccgcccattcgcaaagtttatt

SEQ ID NO: 5629 - DNA, 753 bp, Artificial Sequence
  Description of Artificial Sequence: Synthetic coding sequence
atgctgggagcccgcctcaggttgtgggtctgcgccctctgctctgtgtgcagtatgtccgtgcttcgggcatacccgaatgcgtcgccactgctcggtagcagctggggcggcctcattcatctgtacaccgcgactgcacgcaattcgtatcaccttcagatccacaagaacggacacgtcgacggcgcgccgcatcagactatatacagcgccctgatgatcaggtccgaggatgcagggttcgtggtcatcactggtgtaatgtcccgccgttacctgtgcatggatttcagaggcaacatctttgggagccattacttcgatcctgaaaactgccggttccaacatcagaccttggagaacggatacgacgtataccattccccgcaataccactttttggtgtctctcggaagggccaagcgtgctttcctgccggggatgaacccccctccgtactcacagttcctgtcacgacgaaacgaaatcccgctgatccacttcaatacgccaatcccgcgccgccacactagatcggccgaagatgactccgaacgggacccactgaacgtgctgaagccgcgcgcccgcatgacccctgccccagctagctgttcacaagaacttccttcggcggaggacaactccccgatggcatcagacccgctgggagtggtgcggggaggaagggttaatacccacgctggcggaactggacctgaggggtgtcggccctttgcgaaattcatt

SEQ ID NO: 5630 - DNA, 753 bp, Artificial Sequence
  Description of Artificial Sequence: Synthetic coding sequence
atgctaggcgccaggctcaggctgtgggtttgtgctctgtgcagcgtctgctccatgtctgtgctccgggcttatcccaatgccagtcctctgctggggtctagctggggtgggttaattcacttgtatacagccaccgcccgcaattcttatcacttgcagatccacaagaacggccatgtcgatggggcccctcaccaaaccatatactccgccctaatgatcagaagcgaagacgcaggcttcgttgttataactggagtcatgtccagacggtatctttgtatggacttcaggggcaatatctttggcagccactacttcgacccagaaaactgcaggtttcagcatcagactctggaaaacgggtacgatgtatatcattctcctcagtatcacttcctggttagtctaggcagagctaagagggcatttctcccaggcatgaatcctcctccatactctcagttcctaagtagaaggaacgaaatcccactaattcactttaatactccaatccctaggaggcatactcgtagcgccgaagatgattctgaacgggatcccctgaacgtcctgaagccccgcgccaggatgacaccagcccctgccagttgtagtcaggaactcccctccgcagaagataactccccaatggcctctgaccctttaggcgttgtgcggggaggaagagttaacactcacgccggcggcaccggccccgaaggatgccggccctttgctaaatttatc

SEQ ID NO: 5631 - DNA, 753 bp, Artificial Sequence
  Description of Artificial Sequence: Synthetic coding sequence
atgttgggcgccagactccgcttgtgggtgtgcgccctttgtagcgtgtgctccatgtcagtgcttcgggcctaccctaacgcctcaccgctactgggctctagttggggcggcctgatccatctctacacagcaacggcccggaatagttaccacttgcaaatacacaagaacggccacgttgatggcgcaccacatcaaaccatctattctgccctgatgatccggtcagaggacgctgggttcgtggtgatcaccggcgtcatgagcaggagatatctgtgcatggattttcgaggtaacatctttggcagccactatttcgatcccgaaaactgcagatttcagcaccagacactcgaaaacggatacgatgtttatcactccccccagtatcacttcctggtttccctggggagagcgaaaagggccttccttccagggatgaacccccctccttacagccagttcctgtccaggaggaacgaaatcccgctgatccactttaatacaccaatacctcggagacacactcgctctgctgaagatgactcggagcgggaccctctgaacgtactcaagccgagagcgcgcatgacaccagcccccgcgagctgctcccaggagttaccctccgctgaggacaattcacctatggcatcggaccctcttggtgtggtgcgcggtgggagagtgaatacccatgccggagggacgggacccgagggttgccgcccgttcgccaagttcatc

SEQ ID NO: 5632 - DNA, 753 bp, Artificial Sequence
  Description of Artificial Sequence: Synthetic coding sequence
atgctgggagcacgcctccgcctttgggtgtgtgctctctgttcagtctgctcgatgtcggtgctgcgagcataccctaatgcgagccctctccttgggtcgagctggggcggactcatccatctttacaccgccaccgcacgcaactcctaccaccttcagattcacaagaacggtcatgtggacggagcaccccatcagaccatttactcggctttgatgattagaagcgaagatgcgggcttcgtggtgattaccggagttatgtctaggagatacctgtgtatggattttcgcggtaacatctttggctcccattactttgatcccgagaactgtaggtttcaacaccagaccctggaaaacgggtatgatgtgtaccactcaccacaatatcatttcctggtttctcttggaagagccaagcgtgcgttcctgcccgggatgaatcctccgccgtactcccaatttctgtccagacggaacgaaatcccactgatacatttcaacacccctatcccacggagacacactcggtccgcagaggacgattcggaacgcgatccactcaatgtgctgaagccaagggcaagaatgaccccagcacctgcaagctgtagccaagagctgccctcagcagaagataactcccccatggccagcgaccctcttggagtggtgaggggtggaagagtcaatacccacgcaggtggaactggacccgagggatgtcgcccattcgcaaagtttatc

SEQ ID NO: 5633 - DNA, 753 bp, Artificial Sequence
  Description of Artificial Sequence: Synthetic coding sequence
atgctgggagccagactgcgcctttgggtgtgcgcactctgcagcgtgtgttccatgagcgttcttagagcatacccaaacgcctcacccttgcttggtagctcgtggggtggacttatccacctgtacactgcgaccgcaagaaacagctatcatcttcagatccataagaatggacatgttgacggagcaccacatcaaactatttacagcgcactcatgattcgctccgaagatgctggctttgtggtgattaccggagtgatgtcgcgcagatacctgtgtatggattttagaggaaacatcttcgggtcccattactttgatcccgaaaactgccggttccaacatcaaactcttgaaaacgggtacgatgtgtaccactccccacagtatcatttcctcgtcagcttgggacgggcaaagcgggcattcctgccagggatgaatccgcctccatactcccagtttctgtcgcgtcgtaacgaaatacctcttattcacttcaatacccccattcctagacgtcacaccagatcggctgaggatgactccgaacgcgatcccctgaatgtgctcaagccccgagccagaatgacgccggcccctgcatcgtgttcccaagaactgccgtcagccgaggacaattcacctatggccagcgacccgttgggcgtcgttaggggtggacgggtgaacactcatgcaggcggaaccggaccggagggatgtcggccatttgcaaagtttatc

SEQ ID NO: 5634 - DNA, 753 bp, Artificial Sequence
  Description of Artificial Sequence: Synthetic coding sequence
atgctgggagcacgcctgcggctttgggtgtgtgcactttgctcggtctgcagcatgtcggtcttgcgtgcttacccaaacgcaagccctctcctgggttctagctggggtgggcttatccacctgtataccgcaaccgcacgaaactcctaccatctccaaatccacaaaaatgggcatgtcgacggcgcccctcaccaaaccatttactcagcgcttatgattaggtcagaggatgccggcttcgtggtgatcactggtgttatgagcaggcgctacctttgtatggacttcagaggcaatatcttcggttcgcactactttgaccccgagaactgtaggttccaacaccagacccttgaaaatggatacgatgtgtaccactccccgcagtaccattttcttgttagtctggggagggccaagagagcctttctgcctggtatgaatcctcctccgtactcgcagtttctcagccgacgaaatgagattcctcttattcacttcaatacgccaattccacgccggcatacccgctcggcagaggatgactctgaaagagatcctcttaatgtcctgaagcctagggcacgtatgacgccagccccagcatcatgttcacaggaactcccctccgccgaggacaatagccctatggcatctgatccactgggtgtcgtgagagggggaagagtgaacacccatgcgggtggtaccgggcctgaaggatgtcggccttttgcaaagtttata

SEQ ID NO: 5635 - DNA, 753 bp, Artificial Sequence
  Description of Artificial Sequence: Synthetic coding sequence
atgctaggggcccgactgcgactctgggtctgcgcgttatgtagcgtttgtagcatgagtgtgttgagagcttatcccaacgcctctcccctattgggcagcagttggggaggcctaattcacctgtacaccgccaccgccagaaattcctatcacttacaaatccacaagaacgggcacgttgatggtgctcctcaccagactatttactcggccctaatgatcaggtccgaggacgccggctttgtggttatcacgggtgtcatgagcagacgctatctgtgcatggatttcagggggaatatcttcggcagtcactatttcgacccggaaaactgcagattccagcaccagaccctagagaacgggtatgatgtgtatcatagtccccagtatcatttccttgtatccctggggagggccaaacgggcattcctgcccggaatgaatcctcctccctactcccagtttttatcccggaggaacgaaataccattgattcacttcaacacacccatcccccgtcgtcatactaggagcgctgaggacgatagtgaacgcgatcctctgaacgtgcttaagccgcgcgcacggatgacgcctgctcctgcctcctgcagtcaggagctcccatcggccgaggataattctcctatggccagcgacccacttggggtagttcgcggcggtagggtaaatactcatgccggtggaacaggccccgaaggttgtagacccttcgctaaatttatt

SEQ ID NO: 5636 - DNA, 753 bp, Artificial Sequence
  Description of Artificial Sequence: Synthetic coding sequence
atgcttggtgcaaggcttcgcttgtgggtgtgtgcactttgttccgtgtgttccatgtccgttctgagagcatatcccaacgcgtcaccactgcttggatcatcgtggggcggtctgattcatctgtacacggccaccgcacgcaattcgtaccatctccagatacacaagaacgggcacgtggatggtgcccctcatcaaactatctactcggccttgatgatacggtccgaagatgcaggatttgtggtgataactggtgtcatgtcgcgtaggtacctgtgcatggacttccgcggcaacatcttcggttcgcactatttcgacccagaaaactgtagatttcagcaccagacccttgagaacggttacgacgtctaccattcgcctcaataccattttcttgtctcactcggaagggcaaagagagcctttctgccggggatgaaccccccaccttactcccagtttctttccaggcgcaacgaaatcccattgatccactttaacacccctattcctagacggcacactagatcggcagaagatgacagcgaaagggacccgctgaacgtactcaaacctagagcccggatgactcctgctcccgcttcatgctcccaagaactgccatccgcagaagataattccccgatggcgtctgatcctcttggggtggttaggggagggcgagtgaacacccacgctggtggtaccggaccagagggttgcagaccgtttgccaagtttatt

SEQ ID NO: 5637 - DNA, 753 bp, Artificial Sequence
  Description of Artificial Sequence: Synthetic coding sequence
atgctgggcgctagactcaggctttgggtgtgcgccctctgttcggtctgttcgatgtccgtgttgcgggcctacccgaacgcgagtccgctgctgggaagctcgtggggcgggttgatccacctgtacaccgcaaccgccaggaacagctaccatctccaaatccacaaaaacggacacgtggacggggccccacaccagaccatctactcagctctcatgatccgctcggaggacgcgggcttcgtcgtaatcaccggcgtgatgtcccgccggtacctgtgcatggattttcgcgggaacatctttggctcacactactttgatccagaaaattgccgctttcaacaccagactctggaaaacggatacgacgtctaccactctccccagtaccatttcttggtgtcattgggacgagctaagcgtgcattcctccccggtatgaacccgccgccatactcgcagttcctctcccggcgcaacgagatccctctgatccacttcaacactccaatcccgcggcgccacacccgcagcgcggaggacgattccgagcgggaccccctgaatgtcctgaagccccgggcaagaatgaccccagccccggcctcctgttcacaggaactgccatcggcggaggacaactccccgatggcatcagacccactgggggtggtgcgcggcggcagagtgaacacgcacgctgggggaactgggcctgagggatgcagaccttttgcaaaattcatc

SEQ ID NO: 5638 - DNA, 753 bp, Artificial Sequence
  Description of Artificial Sequence: Synthetic coding sequence
atgcttggtgcacgcctgcggctttgggtgtgcgcactttgcagcgtctgctcaatgtcagtcctgcgcgcatacccgaacgcatcacctctccttggctcatcctggggaggactcattcatttgtacactgcgacggcaaggaactcataccatctgcaaattcacaaaaacgggcacgtggatggcgctccacaccagaccatttactcggcacttatgataagaagcgaggatgcaggatttgtggtgattaccggagtcatgtcccggaggtacctttgcatggatttccggggaaacattttcggctcgcactactttgatcccgaaaactgtaggttccagcaccagaccctggaaaatggatacgatgtctatcatagccctcaataccattttctcgtgtcactgggtcgggcaaagcgagcattcctgccggggatgaacccacccccttactcacagtttctttcgagacggaatgagataccactgatccatttcaacacccctatccctaggcgccatactagatcggccgaggatgactcggagcgggaccctcttaatgtgctgaagcctagagctaggatgactcctgctccagcatcatgttcacaggaacttcccagcgcggaagataactccccgatggcgtccgatcctctcggagttgtgcgcggtggtagagtgaatacccacgccggaggaaccggtcctgagggatgcagaccttttgcgaaattcatc

SEQ ID NO: 5639 - DNA, 753 bp, Artificial Sequence
  Description of Artificial Sequence: Synthetic coding sequence
atgcttggggcacggctgaggttatgggtctgcgctctgtgtagcgtgtgttctatgtcggtgctccgagcgtaccccaatgccagcccgctgttgggttcctcctggggtggcttgatacatctctataccgctaccgcccggaacagctaccacttgcagattcataagaacggccacgttgatggcgctccacatcagactatatactcggcattgatgataagatcagaggatgccggttttgtcgttattactggcgtgatgtcaaggaggtatctctgtatggactttagggggaacatttttgggtcccattattttgatccagagaactgtaggtttcagcaccagaccctggagaacgggtacgatgtctaccactcaccccagtatcacttcctggtcagcctcggtcgagcaaagcgggcctttctcccaggcatgaatccacctccttactcgcaattcttgtcccggaggaacgagattcccttgatacacttcaatacccctattccgaggcgtcatacccgaagtgcagaggacgatagcgagcgagaccctctgaatgtgcttaagccgcgcgcccggatgacgcctgcacctgcatcgtgtagtcaagaacttcccagtgctgaggacaacagtcccatggcttcggaccctctcggcgtggtgagggggggaagggttaacacacacgccggcgggacaggaccggagggctgtcgtccattcgcaaagttcatt

SEQ ID NO: 5640 - DNA, 753 bp, Artificial Sequence
  Description of Artificial Sequence: Synthetic coding sequence
atgctgggcgcccggctgagactgtgggtatgtgcactctgtagcgtttgttctatgtcggtcctccgcgcataccccaatgcttcaccattgttagggagcagctggggcgggctcatccacttatacacggcgaccgcacggaactcttatcacctgcaaattcataaaaatgggcatgtggacggtgcccctcaccagactatctacagcgccctcatgatccgatctgaagatgctggcttcgtagtgatcacgggcgtgatgtcccgaagatacctttgtatggatttccggggtaacatatttggaagccattatttcgaccctgagaattgccgatttcagcatcagaccttagagaacggatatgatgtttaccattccccacagtatcactttttggtctccctgggacgagctaaaagagcatttctcccaggtatgaacccccctccatactcccaattcctgtccaggagaaatgaaattccactgattcatttcaatacccccatccccaggaggcatacaaggtccgccgaggatgacagtgagcgtgatcctttgaatgtcttgaaaccccgggcgcgaatgaccccagcacccgccagctgtagtcaggaactaccctctgccgaggataatagccccatggcaagcgaccctcttggggtagtgcgcggtgggagagttaacacacatgcaggtggaaccggacctgaaggatgtaggcccttcgccaagttcatt

SEQ ID NO: 5641 - protein, 4 aa, Homo sapiens
  MOD_RES (2)..(3): Any amino acid
RXXR

SEQ ID NO: 5642 - protein, 4 aa, Homo sapiens
  MOD_RES (2)..(2): Any amino acid
  MOD_RES (3)..(3): Lys or Arg
RXXR

SEQ ID NO: 5643 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 5644 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 5645 - protein, 6 aa, Homo sapiens
LVPRGS

SEQ ID NO: 5646 - protein, 4 aa, Homo sapiens
LVPR

SEQ ID NO: 5647 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 5648 - protein, 4 aa, Homo sapiens
IEGR

SEQ ID NO: 5649 - protein, 4 aa, Homo sapiens
IDGR

SEQ ID NO: 5650 - protein, 4 aa, Homo sapiens
AEGR

SEQ ID NO: 5651 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 5652 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 5653 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 5654 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 5655 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 5656 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 5657 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 5658 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 5659 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 5660 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 5661 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 5662 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 5663 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 5664 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 5665 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 5666 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 5667 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 5668 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 5669 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 5670 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 5671 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 5672 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 5673 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag

SEQ ID NO: 5674 - DNA, 3891 bp, Clostridium botulinum
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagaatattattaatacttctatattgaatttaagatatgaaagtaatcatttaatagacttatctaggtatgcatcaaaaataaatattggtagtaaagtaaattttgatccaatagataaaaatcaaattcaattatttaatttagaaagtagtaaaattgaggtaattttaaaaaatgctattgtatataatagtatgtatgaaaattttagtactagcttttggataagaattcctaagtattttaacagtataagtctaaataatgaatatacaataataaattgtatggaaaataattcaggatggaaagtatcacttaattatggtgaaataatctggactttacaggatactcaggaaataaaacaaagagtagtttttaaatacagtcaaatgattaatatatcagattatataaacagatggatttttgtaactatcactaataatagattaaataactctaaaatttatataaatggaagattaatagatcaaaaaccaatttcaaatttaggtaatattcatgctagtaataatataatgtttaaattagatggttgtagagatacacatagatatatttggataaaatattttaatctttttgataaggaattaaatgaaaaagaaatcaaagatttatatgataatcaatcaaattcaggtattttaaaagacttttggggtgattatttacaatatgataaaccatactatatgttaaatttatatgatccaaataaatatgtcgatgtaaataatgtaggtattagaggttatatgtatcttaaagggcctagaggtagcgtaatgactacaaacatttatttaaattcaagtttgtatagggggacaaaatttattataaaaaaatatgcttctggaaataaagataatattgttagaaataatgatcgtgtatatattaatgtagtagttaaaaataaagaatataggttagctactaatgcatcacaggcaggcgtagaaaaaatactaagtgcattagaaatacctgatgtaggaaatctaagtcaagtagtagtaatgaagtcaaaaaatgatcaaggaataacaaataaatgcaaaatgaatttacaagataataatgggaatgatataggctttataggatttcatcagtttaataatatagctaaactagtagcaagtaattggtataatagacaaatagaaagatctagtaggactttgggttgctcatgggaatttattcctgtagatgatggatggggagaaaggccactgtaa

SEQ ID NO: 5675 - DNA, 1403 bp, Artificial Sequence
  Description of Artificial Sequence: Synthetic botulinum toxin light chain of serotype A based on wild-type clostridium botulinum sequence
gaattcccatggttcagttcgttaacaaacagttcaactacaaagacccggttaacggtgttgacatcgcttacatcaaaatcccgaacgttggtcagatgcagccggttaaagcattcaaaatccacaacaaaatctgggttatcccggaacgtgacactttcactaacccggaagaaggtgacctgaacccgccgccggaagctaaacaggttccggtttcttactacgactctacttacctgtctactgacaacgaaaaggacaactacctgaaaggtgttactaaactgtttgaacgtatctactctactgacctgggtcgcatgctgctcacttctatcgttcgtggtatcccgttctggggtggttctactatcgacactgaactgaaagttatcgacactaactgcatcaacgttatccagccggacggttcttaccgttctgaagaactgaacctggttatcatcggtccgtctgctgacatcatccagtttgaatgcaaatctttcggtcacgaagttctgaacctgactcgtaacggttacggttctactcagtacatccgtttctctccggacttcactttcggtttcgaagaatctctggaagttgacactaacccgctgctgggtgctggtaaattcgctactgacccggctgttactctggctcacgaactgatccacgctggtcaccgtctgtacggtatcgctatcaacccgaaccgtgttttcaaagttaacactaacgcttactacgaaatgtctggtctggaagtttcttttgaagaactgcgtactttcggtggtcacgacgctaaattcatcgactctctgcaggaaaacgagttccgtctgtactactacaacaaattcaaagacatcgcttctactctgaacaaagctaaatctatcgttggtaccactgcttctctgcagtacatgaagaacgttttcaaagaaaagtacctgctgtctgaagacacttctggtaaattctctgttgacaaactgaaattcgacaaactgtacaaaatgctgactgaaatctacactgaagacaacttcgttaaattcttcaaagttctgaaccgtaaaacttacctgaacttcgacaaagctgttttcaaaatcaacatcgttccgaaagttaactacactatctacgacggtttcaacctgcgtaacactaacctggctgctaacttcaacggtcagaacactgaaatcaacaacatgaacttcactaaactgaagaacttcactggtctgtttgagttctacaaactgctgtgcgttcgtggtatcatcacttctaaaactaaatctctggacaaaggttacaacaaactggttccgcgtggttctcatcatcatcatcatcattaatgagaatcc

SEQ ID NO: 5676 - DNA, 3876 bp, Clostridium botulinum
atgccagttacaataaataattttaattataatgatcctattgataataataatattattatgatggaacctccatttgcgagaggtatggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttgataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttaatattaatgcatgaacttatacatgttttacatggattatatggcattaaagtaaatgatttaccaatcgtaccaaatgaaaaaaaattttttatgcaatctacagatgctatacaggcagaagaactatatacttttgggggacaagatcccagcatcataagtccttctacggataaaagtatctatgataaagttttgcaaaattttagagggatagttgatagacttaacaaggttttagtttgcatatcagatcctaacattaatattaatatatataaaaataaatttaaagataaatataaattcgttgaagattctgagggaaaatatagtatagatgtagaaagtttcgataaattatataaaagcttaatgtttggttttacagaaactaatatagcagaaaattataaaataaaaactagagcttcttattttagtgattccttaccaccagtaaaaataaaaaatttattagataatgaaatctatactatagaggaagggtttaatatatctgataaaaatatggaaaaagaatatagaggtcagaataaagctataaataaacaagcttatgaagaaatcagcaaggagcatttggctgtatataagatacaaatgtgtaaaagtgttaaagctccaggaatatgtattgatgttgataatgaggatttgttctttatagctgataaaaatagtttttcagatgatttatctaaaaacgaaagaatagcatataatacacagaataattatatagaaaatgatttctctataaatgaattaattttagatactgatttaataagtaaaatagaattaccaagtgaaaatacagaatcacttactgattttaatgtatatgttccagtatataaaaaacaacccgctataaaaaaaatttttacagatgaaaataccatctttcaatatttatactctcagacatttcctctagatataagagatataagtttaacatcttcatttgatgatgcattattattttctaacaaagtttattcatttttttctatggattatattaaaactgctaataaagtggtagaagcaggattatttgcaggttgggtgaaacagatagtagatgattttgtaatcgaagctaataaaagcagtactatggataaaattgcagatatatctctaattgttccttatataggattagctttaaatgtaggaaatgaaacagctaaaggaaattttgaaaatgcttttgagattgcaggagccagtattctactagaatttataccagaacttttaatacctgtagttggagcttttttattagaatcatatattgacaataaaaataaaattattgaaacaataaatagtgctttaactaaaagagatgaaaaatggattgatatgtacggattaatagtagcgcaatggctctcaacagttaatactcaattttatacaataaaagagggaatgtataaggctttaaattatcaagcacaagcattggaagaaataataaaatacaaatataatatatattctgagaaagaaaggtcaaatattaacatcgattttaatgatgtaaattctaaacttaatgagggtattaaccaagctatagataatataaataattttataaatgaatgttctgtatcatatttaatgaaaaaaatgattccattagctgtagaaaaattactagacttcgataatactctcagaaaaaatttattaaattatatagatgaaaataaattatatttgattggaagtgcagaatatgaaaaatcaaaagtagataaatacttgaaaaccagtataccatttgatctttcaacgtatactaataatacaatactaatagaaatatttaataaatataatagcgatattttaaataatattatcttaaatttaagatatagggataataagttaatagatttatcaggatatggggcaaaggtagaggtatatgatggggtcaagcttaatgataaaaatcaatttaaattaactagttcagcaaatagtaagattagagtgattcaaaatcagaatatcatatttaatagtatgttccttgattttagcgttagtttttggataagaatacctaaatataagaatgatggtatacaaaattatattcataatgaatatacaataattaattgtatgaaaaataattctggatggaaaatatctattaggggtaatatgataatatggactttaattgatataaatggaaaaatcaaatcagtattttttgaatatagcataaaagaagatatatcagagtatataaatagatggttttttgtaactattactaataattcggataacgctaaaatttatattaatggtaagctagaatcacatatagatattagagatataagagaagttattgctaatgatgaaataatatttaaattagatggtaatatagatagaacacagttcatttggatgaaatatttcagtatttttaatacggaattaagtcaatcaaatattgaagaaatatataaaattcaatcatatagcgaatatttaaaagatttttggggaaatcctttaatgtacaataaagaatattatatgtttaatgcggggaataaaaattcatatattaaactaaagaaagattcatctgtaggtgaaattttaacacgtagcaaatataatcaaaattccaaatatataaattatagagatttatatattggagaaaaatttattataagaagaaagtcaaattctcaatctataaatgatgatatagttagaaaagaagattatatatatctagatttttttaatttaaatcaagagtggagagtatatatgtataaatattttaagaaagaggaagaaaaattgtttttagctcctataagtgattctgatgagttttacaatactatacaaataaaagaatatgatgaacagccaacatatagttgtcagttgctttttaaaaaagatgaagaaagtactgatgagataggattgattggtattcatcgtttctacgaatctggaattgtatttaaagagtataaagattatttttgtataagtaaatggtacttaaaagaggtaaaaaggaaaccatataattcaaaattgggatgtaattggcagtttattcctaaagatgaagggtggactgaataa

SEQ ID NO: 5677 - DNA, 1323 bp, Artificial Sequence
  Description of Artificial Sequence: Synthetic botulinum toxin light chain of serotype B based on wild-type clostridium botulinum sequence
atgccagttactattaacaacttcaactacaacgacccaattgacaacaacaacattattatgatggagccaccattcgctagaggtactggtagatactacaaggctttcaagattactgacagaatttggattattccagagagatacactttcggttacaagccagaggacttcaacaagtcttctggtattttcaacagagacgtttgtgagtactacgacccagactacttgaacactaacgacaagaagaacattttcttgcaaactatgattaagttgttcaacagaattaagtctaagccattgggtgagaagttgttggagatgattattaacggtattccatacttgggtgacagaagagttccattggaggagttcaacactaacattgcttctgttactgttaacaagttgatttctaacccaggtgaggttgagagaaagaagggtattttcgctaacttgattattttcggtccaggtccagttttgaacgagaacgagactattgacattggtattcaaaaccacttcgcttctagagagggtttcggtggtattatgcaaatgaagttctgtccagagtacgtttctgttttcaacaacgttcaagagaacaagggtgcttctattttcaacagaagaggttacttctctgacccagctttgattttgatgcacgagttgattcacgttttgcacggtttgtacggtattaaggttgacgacttgccaattgttccaaacgagaagaagttcttcatgcaatctactgacgctattcaagctgaggagttgtacactttcggtggtcaagacccatctattattactccatctactgacaagtctatttacgacaaggttttgcaaaacttcagaggtattgttgacagattgaacaaggttttggtttgtatttctgacccaaacattaacattaacatttacaagaacaagttcaaggacaagtacaagttcgttgaggactctgagggtaagtactctattgacgttgagtctttcgacaagttgtacaagtctttgatgttcggtttcactgagactaacattgctgagaactacaagattaagactagagcttcttacttctctgactctttgccaccagttaagattaagaacttgttggacaacgagatttacactattgaggagggtttcaacatttctgacaaggacatggagaaggagtacagaggtcaaaacaaggctattaacaagcaagcttacgaggagatttctaaggagcacttggctgtttacaagattcaaatgtgtaagtctgttaag

SEQ ID NO: 5678 - DNA, 3876 bp, Clostridium botulinum
atgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacttttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacttttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaataatattaatgattcaaaaattttgagcctacaaaacagaaaaaatactttagtggatacatcaggatataatgcagaagtgagtgaagaaggcgatgttcagcttaatccaatatttccatttgactttaaattaggtagttcaggggaggatagaggtaaagttatagtaacccagaatgaaaatattgtatataattctatgtatgaaagttttagcattagtttttggattagaataaataaatgggtaagtaatttacctggatatactataattgatagtgttaaaaataactcaggttggagtataggtattattagtaattttttagtatttactttaaaacaaaatgaagatagtgaacaaagtataaattttagttatgatatatcaaataatgctcctggatacaataaatggttttttgtaactgttactaacaatatgatgggaaatatgaagatttatataaatggaaaattaatagatactataaaagttaaagaactaactggaattaattttagcaaaactataacatttgaaataaataaaattccagataccggtttgattacttcagattctgataacatcaatatgtggataagagatttttatatatttgctaaagaattagatggtaaagatattaatatattatttaatagcttgcaatatactaatgttgtaaaagattattggggaaatgatttaagatataataaagaatattatatggttaatatagattatttaaatagatatatgtatgcgaactcacgacaaattgtttttaatacacgtagaaataataatgacttcaatgaaggatataaaattataataaaaagaatcagaggaaatacaaatgatactagagtacgaggaggagatattttatattttgatatgacaattaataacaaagcatataatttgtttatgaagaatgaaactatgtatgcagataatcatagtactgaagatatatatgctataggtttaagagaacaaacaaaggatataaatgataatattatatttcaaatacaaccaatgaataatacttattattacgcatctcaaatatttaaatcaaattttaatggagaaaatatttctggaatatgttcaataggtacttatcgttttagacttggaggtgattggtatagacacaattatttggtgcctactgtgaagcaaggaaattatgcttcattattagaatcaacatcaactcattggggttttgtacctgtaagtgaataa

SEQ ID NO: 5679 - DNA, 1332 bp, Artificial Sequence
  Description of Artificial Sequence: Synthetic botulinum toxin light chain of serotype C1 based on wild-type clostridium botulinum sequence
atgccaatcaccatcaacaacttcaactactcagaccctgtcgacaacaagaacattctgtacctggacactcacctgaacaccctagctaacgagcctgagaaggcctttcggatcaccggaaacatctgggtcatccctgatcgtttctcccgtaactccaaccccaacctgaacaagcctcctcgggtcaccagccctaagagtggttactacgaccctaactacctgagtaccgactctgacaaggacaccttcctgaaggagatcatcaagctgttcaagcgtatcaactcccgtgagatcggagaggagctcatctacagactttcgaccgatatccccttccctggtaacaacaatactccaatcaacaccttcgacttcgacgtcgacttcaactccgtcgacgtcaagactcggcagggtaacaactgggttaagactggtagcatcaacccttccgtcatcatcactggacctcgtgagaacatcatcgacccagagacttccacgttcaagctgactaacaacaccttcgcggctcaagaaggattcggtgctctgtcaatcatctccatctcacctcgtttcatgctgacctactcgaacgcaaccaacgacgtcggagagggtaggttctctaagtctgagttctgcatggacccaatcctgatcctgatgcatgagctgaaccatgcaatgcacaacctgtacggaatcgctatcccaaacgaccagaccatctcctccgtgacctccaacatcttctactcccagtacaacgtgaagctggagtacgcagagatctacgctttcggaggtccaactatcgaccttatccctaagtccgctaggaagtacttcgaggagaaggctttggattactacagatccatcgctaagagactgaacagtatcaccaccgcaaacccttccagcttcaacaagtacatcggtgagtacaagcagaagctgatcagaaagtaccgtttcgtcgtcgagtcttcaggtgaggtcacagtaaaccgtaacaagttcgtcgagctgtacaacgagcttacccagatcttcacagagttcaactacgctaagatctacaacgtccagaacaggaagatctacctgtccaacgtgtacactccggtgacggcgaacatcctggacgacaacgtctacgacatccagaacggattcaacatccctaagtccaacctgaacgtactattcatgggtcaaaacctgtctcgaaacccagcactgcgtaaggtcaaccctgagaacatgctgtacctgttcaccaagttctgccacaaggcaatcgacggtaga

SEQ ID NO: 5680 - DNA, 1296 bp, Clostridium botulinum
atgccaataataaaagaacccattgactttatcaataaacctgaatctgaagcccaaaaatggggcaaagaagaagaaaaacgttggtttacgaaattaaataatcttgaagaagtagccgtaaatcaacttaaaactaaggaagataaaacaaaaatagataatttttctacagatattttattttcttcattaactgcaatagaaattatgaaagaagacgaaaatcaaaatctttttgatgttgaaagaattagagaagcacttttaaaaaatactttagatagagaagttataggctatgtaaattttacacctaaagagcttggaattaatttttctataagagatgtagaattaaatagagatatatcagatgaaattttagataaagttagacagcaaataataaatcaagaatatactaaattttcatttgtatcattagggttaaatgacaacagcatcgatgagagtataccagttattgtgaaaactagagttccaacaacgtttaattatggtgttcttaataataaagaaacagtatcattattattaaatcaaggtttttctataattcctgagtcagctattataactactataaaaggaaaagactatatattaatagaaggaagtcttagtcaagagcttgatttctataataaaggatcagaagcttggggagaaaaaaattatggtgattatgtttcaaaactttcccaggaacaattaggtgctttagaaggatatctgcattcagattataaagctattaatagttatttaagaaataatagagttccaaataatgacgagcttaataaaaaaattgaattaataagttctgctctatctgtaaagccaatacccgaaacattaatagcatatagaagagtagatggtattccattcgatttaccttctgatttttcctttgataaaaaagaaaatggtgaaataatagctgataaacaaaaattaaacgagtttatagataaatggactggaaaagaaattaaaaatttatcattttctagtacttctcttaaatccaccccattatcatttagtaaatctcgttttatatttagattgcgtttaagtgaagggaccattggagcatttatttatgggttttctggatttcaagatgaacaagaaattcttttgaataagaattctactttcaagatatttagaataactccaataacttcaataattaatagagttactaaaatgactcaggtagtaattgatgctgaagttatacaaaataaagagatttag

SEQ ID NO: 5681 - DNA, 2166 bp, Clostridium botulinum
atgttagtttcaaaaattgagaactccgtaaaagattcaaataaaaattatttcacaataaacggtttaatggggtattattttgaaaatgacttttttaatttaagtataatatcaccaactttagatggaaatttaacttttagtaaagaggatattaattcaatcttaggtaataagagcattaagtctgcaagatggattggtttaataaagcctagtataactggagaatatgttttatcaacaaatagtcctaattgtagaattgaactaaatggtgaaatatttaacctatctttaaacacatctaatactgttaatttaattaaaggaaacgtttatgacatcagaatagaacaattaatgtcagagaatcagttattaaaaaattatgaaggaattaagctttactgggaaacttcggatattataaaagaaataattccttcagaagtattgttaaaacccaattatagtaatacaaatgagaaatctaaatttattcctaataatacactgttctctaatgctaaattaaaggctaatgcaaatagagatactgatagagatggtatacctgatgaatgggaaattaatggatatacggttatgaatcaaaaagctgtagcatgggatgataaatttgcagctaatggttataaaaaatatgtatctaatccttttaaaccttgtactgcaaatgacccatatacagactttgaaaaagtttcaggacaaatagatccatctgtaagtatggtagcaagagatccaatgatatctgcttatcctatagttggagtccaaatggaaagattagttgtttctaaatcagaaacaattactggagattcaactaagagtatgtctaaatcaactagtcatagtagtactaatattaatactgttggcgcagaagtttcaggtagtttacaacttgctggaggtatattccctgtatttagcatgtctgcttcagcaaattattctcacacatggcaaaatacaagtacagttgatgatacaactggagaaagtttctctcaaggattaagtataaatactggtgaatccgcttatataaatcctaatattagatattataatactggtactgctccagtgtataatgttactcccactactaccatagtaattgataaacaatctgtagccactattaagggacaagaaagcttaattggggactatctaaatcctggtggaacctatcctattataggagaacctcctatggctttaaatactatggatcaatttagtagtcgtttaattccgataaattacaatcaattaaaaagcattgataatggtggaactgtaatgttatcgacatcccagtttactggaaactttgccaaatataattccaacggtaatttagtaactgatggaaacaattggggaccttatttaggtactataaaaagtacaacagcttcattaactttatctttctctggtcaaactactcaagttgctgttgttgctcctaattttagtgatcctgaagataaaactcctaaattaactttggaacaagctctagttaaagctttcgcacttgaaaagaaaaatggtaaattttattttcatggtttagaaattagtaaaaatgaaaaaatacaagtatttttagatagtaatacaaataatgattttgaaaatcaattaaaaaatacagctgataaagatattatgcattgtataataaaacgtaatatgaatattttagtaaaagtaattacttttaaagaaaatatatcctcaatcaatatcataaatgatactaattttggtgttcaatctatgacaggtctttctaatagatctaaaggacaagatggtatctatagagctgctacaacagctttttcttttaaatctaaagaactaaaatatccagaaggtcgttatagaatgcgttttgtaattcaatcttatgaaccgtttacctgtaactttaaactctttaataacctaatatattctagttcatttgataaaggatattatgatgaatttttttacttttattataatggcagtaaatctttttttaatatttcttgtgatattataaattctattaataggctttcgggggttttcttaatagaattagataaattaataatatag

SEQ ID NO: 5682 - DNA, 4087 bp, Clostridium botulinum
tatgcaaaagattacagttaatatctgattattagacctgatgataacattttcatataatgataaatatttttctctatcacttagagatggagatataattggatgatatgcaatgacaataacaaggtgctaaaggtgcacacttgtggatattagaaagttaggagatgttagtattatgacatggccagtaaaagattttaattatagtgatcctgttaatgacaatgatatattatatttaagaataccacaaaataagttaattactacacctgtaaaagcttttatgattactcaaaatatttgggtaataccagaaagattttcatcagatactaatccaagtttaagtaaaccgcccagacctacttcaaagtatcaaagttattatgatcctagttatttatctactgatgaacaaaaagatacatttttaaaagggattataaaattatttaaaagaattaatgaaagagatataggaaaaaaattaataaattatttagtagttggttcaccttttatgggagattcaagtacgcctgaagatacatttgattttacacgtcatactactaatattgcagttgaaaagtttgaaaatggtagttggaaagtaacaaatattataacaccaagtgtattgatatttggaccacttcctaatatattagactatacagcatcccttacattgcaaggacaacaatcaaatccatcatttgaagggtttggaacattatctatactaaaagtagcacctgaatttttgttaacatttagtgatgtaacatctaatcaaagttcagctgtattaggcaaatctatattttgtatggatccagtaatagctttaatgcatgagttaacacattctttgcatcaattatatggaataaatataccatctgataaaaggattcgtccacaagttagcgagggatttttctctcaagatggacccaacgtacaatttgaggaattatatacatttggaggattagatgttgaaataatacctcaaattgaaagatcacaattaagagaaaaagcattaggtcactataaagatatagcgaaaagacttaataatattaataaaactattccttctagttggattagtaatatagataaatataaaaaaatattttctgaaaagtataattttgataaagataatacaggaaattttgttgtaaatattgataaattcaatagcttatattcagacttgactaatgttatgtcagaagttgtttattcttcgcaatataatgttaaaaacaggactcattatttttcaaggcattatctacctgtatttgcaaatatattagatgataatatttatactataagagatggttttaatttaacaaataaaggttttaatatagaaaattcgggtcagaatatagaaaggaatcctgcactacaaaagcttagttcagaaagtgtagtagatttatttacaaaagtatgtttaagattaacaaaaaatagtagagatgattcaacatgtattaaagttaaaaataatagattaccttatgtagctgataaagatagcatttcacaagaaatatttgaaaataaaattattacagatgagactaatgtacaaaattattcagataatttttcattagatgaatctattttagatgggcaagttcctattaatcctgaaatagtagatccactattacccaatgttaatatggaacctttaaatcttccaggtgaagaaatagtattttatgatgatattactaaatatgttgattatttaaattcttattattatttggaatctcaaaaattaagtaataatgttgaaaatattactcttacaacttcagttgaagaagcattaggttatagcaataagatatacacatttttacctagcttagctgaaaaagtgaataaaggtgttcaagcaggtttattcttaaattgggcgaatgaagtagttgaggattttactacaaatattatgaagaaagatacattggataaaatatcagatgtatcagtaataattccatatataggacctgccttaaatataggaaattcagcattaaggggaaattttaagcaagcatttgcaacagctggtgtagcttttttattagagggatttccagagtttactatacctgcactcggtgtatttaccttttatagttctattcaagaaagagagaaaattattaaaactatagaaaattgtttggaacaaagagttaagagatggaaagattcatatcaatggatggtatcaaattggttgtcaagaattactactcaatttaatcatataaattatcaaatgtatgattctttaagttatcaggcagatgcaatcaaagctaaaatagatttagaatataaaaaatactcaggaagtgataaagaaaatataaaaagtcaagttgaaaatttaaaaaatagtttagatgtaaaaatttcggaagcaatgaataatataaataaatttatacgagaatgttctgtaacatacttatttaaaaatatgctccctaaagtaattgacgaattaaataagtttgatttaagaactaaaacagaattaattaatcttatagatagtcataatattattctagttggtgaagtagatagattaaaagcaaaagtaaatgagagttttgaaaatacaatgccttttaatattttttcatatactaataattctttattaaaagatataattaatgaatatttcaatagtattaatgattcaaaaattttgagcttacaaaacaaaaaaaatgctttagtggatacatcaggatataatgcagaagtgagggtaggagataatgttcaacttaatacgatatatacaaatgactttaaattaagtagttcaggagataaaattatagtaaatttaaataataatattttatatagcgctatttatgagaactctagtgttagtttttggattaagatatctaaagatttaactaattctcataatgaatatacaataattaacagtatagaacaaaattctgggtggaaattatgtattaggaatggcaatatagaatggattttacaagatgttaatagaaagtataaaagtttaatttttgattatagtgaatcattaagtcatacaggatatacaaataaatggttttttgttactataactaataatataatggggtatatgaaactttatataaatggagaattaaagcagagtcaaaaaattgaagatttagatgaggttaagttagataaaaccatagtatttggaatagatgagaatatagatgagaatcagatgctttggattagagattttaatattttttctaaagaattaagtaatgaagatattaatattgtatatgagggacaaatattaagaaatgttattaaagattattggggaaatcctttgaagtttgatacagaatattatattattaatgataattatatagataggtatattgcacctgaaagtaatgtacttgtacttgttcggtatccagatagatctaaattatatactggaaatcctattactattaaatcagtatctgataagaatccttatagtagaattttaaatggagataatataattcttcatatgttatataatagtaggaaatatatgataataagagatactgatacaatatatgcaacacaaggaggagagtgttcacaaaattgtgtatatgcattaaaattacagagtaatttaggtaattatggtataggtatatttagtataaaaaatattgtatctaaaaataaatattgtagtcaaattttctctagttttagggaaaatacaatgcttctagcagatatatataaaccttggagattttcttttaaaaatgcatacacgccagttgcagtaactaattatgaaacaaaactattatcaacttcatctttttggaaatttatttctagggatccaggatgggtagagtaatacaataaaaatttaatataaactattaaattatattacaagttttagaaatttatcgtataaaatgttgaattc

SEQ ID NO: 5683 - DNA, 1323 bp, Artificial Sequence
  Description of Artificial Sequence: Synthetic botulinum toxin light chain of serotype D based on wild-type clostridium botulinum sequence
atgacctggccagtcaaggacttcaactactccgacccagtcaacgacaacgacatcttgtacttgagaatcccacaaaacaagttgatcaccaccccagtcaaggctttcatgatcacccagaacacctgggttatcccagagagattctcctccgacaccaacccatccctgtccaagccaccaagaccaacctccaagtaccagtcttactacgacccatcttacttgtctaccgacgagcaaaaggacaccttcttgaagggtattatcaagctgttcaagagaatcaacgagagagacatcggtaagaagttgatcaactacttggtcgttggttccccattcatgggtgactcctctaccccagaggacaccttcgacttcaccagacacaccaccaacattgccgtcgagaagttcgagaacggttcctggaaggtcaccaacatcatcaccccatctgttttgatcttcggtccattgccaaacatcttggactacaccgcctccctgaccttgcaaggtcagcaatccaacccatccttcgagggtttcggtaccctgtctattttgaaggtcgctccagagttcttgttgaccttctccgacgtcacctccaaccaatcctccgccgtcttgggtaagtccatcttctgtatggacccagtcatcgctttgatgcacgagttgacccactccctgcaccagttgtacggtattaacatcccatctgacaagagaatcagaccacaggtctctgagggtttcttctcccaagacggtccaaacgttcagttcgaggagttgtacaccttcggtggtttggacgtcgagattatccaaattgagagatcccaattgagagagaaggctttgggtcactacaaggacatcgccaagagactgaacaacatcaacaagaccattccatcttcctggatctccaacattgacaagtacaagaagattttctccgagaagtacaacttcgacaaggacaacaccggtaacttcgtcgttaacatcgacaagttcaactctttgtactccgacttgaccaacgttatgtctgaggttgtctactcctcccaatacaacgtcaagaacagaacccactacttctccagacactacttgccagttttcgctaacatcttggacgacaacatttacaccatcagagacggtttcaacttgaccaacaagggtttcaacatcgagaactccggtcaaaacatcgagagaaacccagccctgcaaaagctgtcctccgagtctgtcgtcgacttgttcaccaaggtctgtttgagattgaccaag

SEQ ID NO: 5684 - DNA, 3759 bp, Clostridium botulinum
atgccaaaaattaatagttttaattataatgatcctgttaatgatagaacaattttatatattaaaccaggcggttgtcaagaattttataaatcatttaatattatgaaaaatatttggataattccagagagaaatgtaattggtacaaccccccaagattttcatccgcctacttcattaaaaaatggagatagtagttattatgaccctaattatttacaaagtgatgaagaaaaggatagatttttaaaaatagtcacaaaaatatttaatagaataaataataatctttcaggagggattttattagaagaactgtcaaaagctaatccatatttagggaatgataatactccagataatcaattccatattggtgatgcatcagcagttgagattaaattctcaaatggtagccaagacatactattacctaatgttattataatgggagcagagcctgatttatttgaaactaacagttccaatatttctctaagaaataattatatgccaagcaatcacggttttggatcaatagctatagtaacattctcacctgaatattcttttagatttaatgataatagtatgaatgaatttattcaagatcctgctcttacattaatgcatgaattaatacattcattacatggactatatggggctaaagggattactacaaagtatactataacacaaaaacaaaatcccctaataacaaatataagaggtacaaatattgaagaattcttaacttttggaggtactgatttaaacattattactagtgctcagtccaatgatatctatactaatcttctagctgattataaaaaaatagcgtctaaacttagcaaagtacaagtatctaatccactacttaatccttataaagatgtttttgaagcaaagtatggattagataaagatgctagcggaatttattcggtaaatataaacaaatttaatgatatttttaaaaaattatacagctttacggaatttgatttagcaactaaatttcaagttaaatgtaggcaaacttatattggacagtataaatacttcaaactttcaaacttgttaaatgattctatttataatatatcagaaggctataatataaataatttaaaggtaaattttagaggacagaatgcaaatttaaatcctagaattattacaccaattacaggtagaggactagtaaaaaaaatcattagattttgtaaaaatattgtttctgtaaaaggcataaggaaatcaatatgtatcgaaataaataatggtgagttattttttgtggcttccgagaatagttataatgatgataatataaatactcctaaagaaattgacgatacagtaacttcaaataataattatgaaaatgatttagatcaggttattttaaattttaatagtgaatcagcacctggactttcagatgaaaaattaaatttaactatccaaaatgatgcttatataccaaaatatgattctaatggaacaagtgatatagaacaacatgatgttaatgaacttaatgtatttttctatttagatgcacagaaagtgcccgaaggtgaaaataatgtcaatctcacctcttcaattgatacagcattattagaacaacctaaaatatatacatttttttcatcagaatttattaataatgtcaataaacctgtgcaagcagcattatttgtaagctggatacaacaagtgttagtagattttactactgaagctaaccaaaaaagtactgttgataaaattgcagatatttctatagttgttccatatataggtcttgctttaaatataggaaatgaagcacaaaaaggaaattttaaagatgcacttgaattattaggagcaggtattttattagaatttgaacccgagcttttaattcctacaattttagtattcacgataaaatcttttttaggttcatctgataataaaaataaagttattaaagcaataaataatgcattgaaagaaagagatgaaaaatggaaagaagtatatagttttatagtatcgaattggatgactaaaattaatacacaatttaataaaagaaaagaacaaatgtatcaagctttacaaaatcaagtaaatgcaattaaaacaataatagaatctaagtataatagttatactttagaggaaaaaaatgagcttacaaataaatatgatattaagcaaatagaaaatgaacttaatcaaaaggtttctatagcaatgaataatatagacaggttcttaactgaaagttctatatcctatttaatgaaattaataaatgaagtaaaaattaataaattaagagaatatgatgagaatgtcaaaacgtatttattgaattatattatacaacatggatcaatcttgggagagagtcagcaagaactaaattctatggtaactgataccctaaataatagtattccttttaagctttcttcttatacagatgataaaattttaatttcatattttaataaattctttaagagaattaaaagtagttcagttttaaatatgagatataaaaatgataaatacgtagatacttcaggatatgattcaaatataaatattaatggagatgtatataaatatccaactaataaaaatcaatttggaatatataatgataaacttagtgaagttaatatatctcaaaatgattacattatatatgataataaatataaaaattttagtattagtttttgggtaagaattcctaactatgataataagatagtaaatgttaataatgaatacactataataaattgtatgagagataataattcaggatggaaagtatctcttaatcataatgaaataatttggacattgcaagataatgcaggaattaatcaaaaattagcatttaactatggtaacgcaaatggtatttctgattatataaataagtggatttttgtaactataactaatgatagattaggagattctaaactttatattaatggaaatttaatagatcaaaaatcaattttaaatttaggtaatattcatgttagtgacaatatattatttaaaatagttaattgtagttatacaagatatattggtattagatattttaatatttttgataaagaattagatgaaacagaaattcaaactttatatagcaatgaacctaatacaaatattttgaaggatttttggggaaattatttgctttatgacaaagaatactatttattaaatgtgttaaaaccaaataactttattgataggagaaaagattctactttaagcattaataatataagaagcactattcttttagctaatagattatatagtggaataaaagttaaaatacaaagagttaataatagtagtactaacgataatcttgttagaaagaatgatcaggtatatattaattttgtagccagcaaaactcacttatttccattatatgctgatacagctaccacaaataaagagaaaacaataaaaatatcatcatctggcaatagatttaatcaagtagtagttatgaattcagtaggaaataattgtacaatgaattttaaaaataataatggaaataatattgggttgttaggtttcaaggcagatactgtagttgctagtacttggtattatacacatatgagagatcatacaaacagcaatggatgtttttggaactttatttctgaagaacatggatggcaagaaaaataa

SEQ ID NO: 5685 - DNA, 1266 bp, Artificial Sequence
  Description of Artificial Sequence: Synthetic botulinum toxin light chain of serotype E based on wild-type clostridium botulinum sequence
atgccaaagattaactccttcaactacaacgaccctgtcaacgacagaaccatcttgtacatcaagccaggcggttgccaggagttctacaagtccttcaacatcatgaagaacatctggatcatccccgagagaaacgtcattggtaccaccccccaagacttccacccccctacttccttgaagaacggagactccagttactacgaccctaactacttgcaaagtgacgaggagaaggacagattcttgaagatcgtcacaaagatcttcaacagaatcaacaacaacctttcaggaggcatcttgttggaggagctgtccaaggctaacccatacttgggcaacgacaacactccagataaccagttccacattggtgacgcatccgcagttgagattaagttctccaacggtagccaggacatcctattgcctaacgttatcatcatgggagcagagcctgacttgtttgagaccaactcctccaacatctctctacgtaacaactacatgccaagcaatcacggtttcggatccatcgctatcgtcaccttctcccctgaatattccttcaggttcaacgacaacagcatgaacgagttcattcaggatcctgctctcacgctgatgcacgaattgatccactccttacatggactatatggcgctaagggcattactaccaagtacactatcacacagaagcagaaccccctaataaccaacatccggggtaccaacatcgaggagttcttgactttcggaggtactgacttgaacatcattactagtgctcagtccaacgacatctacactaaccttctggctgactacaagaagatcgcgtctaagcttagcaaggtccaagtctctaacccactgcttaacccttacaaggacgtcttcgaagcaaagtatggattggacaaggatgctagcggaatttactcggtcaacatcaacaagttcaacgacatcttcaagaagctctacagcttcacggagttcgacttggccaccaagttccaggttaagtgtaggcagacttacatcggacagtacaagtacttcaagctgtccaacctgttgaacgactctatctacaacatctcagaaggctacaacatcaacaacttgaaggtcaacttcagaggacagaatgcaaacttgaaccctagaatcattaccccaatcaccggtagaggactggtcaagaagatcatccgtttctgcaagaacattgtctctgtcaagggcatcagg

SEQ ID NO: 5686 - DNA, 4234 bp, Clostridium botulinum
gcaagtaaatttattattagtaatgatatatttatttcaaattgtttaacgcatgctcataacaataagtatatatgtttatctatgaaagatgagaactataattggatgatatgtaacaatgaaagcaacatacctaaaaaggcatatttgtggatattgaaagaagtataggggggatttttatgccagttgcaataaatagttttaattataatgaccctgttaatgatgatacaattttatacatgcagataccatatgaagaaaaaagtaaaaaatattataaagcttttgagattatgcgtaatgtttggataattcctgagagaaatacaataggaacgaatcctagtgattttgatccaccggcttcattaaagaacggaagcagtgcttattatgatcctaattatttaaccactgatgctgaaaaagatagatatttaaaaacaacgataaaattatttaagagaattaatagtaatcctgcagggaaagttttgttacaagaaatatcatatgctaaaccatatttaggaaatgaccacacgccaattgatgaattctctccagttactagaactacaagtgttaatataaaattatcaactaatgttgaaagttcaatgttattgaatcttcttgtattgggagcaggacctgatatatttgaaagttgttgttaccccgttagaaaactaatagatccagatgtagtttatgatccaagtaattatggttttggatcaattaatatcgtgacattttcacctgagtatgaatatacttttaatgatattagtggagggcataatagtagtacagaatcatttattgcagatcctgcaatttcactagctcatgaattgatacatgcactgcatggattatacggggctaggggagttacttatgaagagactatagaagtaaagcaagcacctcttatgatagccgaaaaacccataaggctagaagaatttttaacctttggaggtcaggatttaaatattattactagtgctatgaaggaaaaaatatataacaatcttttagctaactatgaaaaaatagctactagacttagtgaagttaatagtgctcctcctgaatatgatattaatgaatataaagattattttcaatggaagtatgggctagataaaaatgctgatggaagttatactgtaaatgaaaataaatttaatgaaatttataaaaaattatatagttttacagagagtgacttagcaaataaatttaaagtaaaatgtagaaatacttattttattaaatatgaatttttaaaagttccaaatttgttagatgatgatatttatactgtatcagaggggtttaatataggtaatttagcagtaaacaatcgcggacaaagtataaagttaaatcctaaaattattgattccattccagataaaggtctagtagaaaagatcgttaaattttgtaagagcgttattcctagaaaaggtacaaaggcgccaccgcgactatgcattagagtaaataatagtgagttattttttgtagcttcagaaagtagctataatgaaaatgatattaatacacctaaagaaattgacgatacaacaaatctaaataataattatagaaataatttagatgaagttattttagattataatagtcagacaatacctcaaatatcaaatcgaacattaaatacacttgtacaagacaatagttatgtgccaagatatgattctaatggaacaagtgaaatagaggaatatgatgttgttgactttaatgtatttttctatttacatgcacaaaaagtgccagaaggtgaaaccaatataagtttaacttcttcaattgatacagcattattagaagaatccaaagatatatttttttcttcagagtttatcgatactatcaataaacctgtaaatgcagcactatttatagattggataagcaaagtaataagagattttaccactgaagctacacaaaaaagtactgttgataagattgcagacatatctttaattgtaccctatgtaggtcttgctttgaatataattattgaggcagaaaaaggaaattttgaggaggcatttgaattattaggagtgggtattttattagaatttgtgccagaacttacaattcctgtaattttagtgtttacgataaaatcctatatagattcatatgagaataaaaataaagcaattaaagcaataaataattcattaatcgaaagagaagcaaagtggaaagaaatatatagttggatagtatcaaattggcttactagaattaatactcaatttaataaaagaaaagagcaaatgtatcaggctttacaaaatcaagtagatgcaataaaaacagcaatagaatataaatataataattatacttcagatgagaaaaatagacttgaatctgaatataatatcaataatatagaagaagaattgaataaaaaagtttctttagcaatgaaaaatatagaaagatttatgacagaaagttctatatcttatttaatgaaattaataaatgaagccaaagttggtaaattaaaaaaatatgataaccatgttaagagcgatttattaaactatattctcgaccatagatcaatcttaggagagcagacaaatgaattaagtgatttggtgactagtactttgaatagtagtattccatttgaactttcttcatatactaatgataaaattctaattatatattttaatagattatataaaaaaattaaagatagttctattttagatatgcgatatgaaaataataaatttatagatatctctggatatggttcaaatataagcattaatggaaacgtatatatttattcaacaaatagaaatcaatttggaatatataatagtaggcttagtgaagttaatatagctcaaaataatgatattatatacaatagtagatatcaaaattttagtattagtttctgggtaaggattcctaaacactacaaacctatgaatcataatcgggaatacactataataaattgtatggggaataataattcgggatggaaaatatcacttagaactgttagagattgtgaaataatttggactttacaagatacttctggaaataaggaaaatttaatttttaggtatgaagaacttaataggatatctaattatataaataaatggatttttgtaactattactaataatagattaggcaattctagaatttacatcaatggaaatttaatagttgaaaaatcaatttcgaatttaggtgatattcatgttagtgataatatattatttaaaattgttggttgtgatgatgaaacgtatgttggtataagatattttaaagtttttaatacggaattagataaaacagaaattgagactttatatagtaatgagccagatccaagtatcttaaaaaactattggggaaattatttgctatataataaaaaatattatttattcaatttactaagaaaagataagtatattactctgaattcaggcattttaaatattaatcaacaaagaggtgttactgaaggctctgtttttttgaactataaattatatgaaggagtagaagtcattataagaaaaaatggtcctatagatatatctaatacagataattttgttagaaaaaacgatctagcatacattaatgtagtagatcgtggtgtagaatatcggttatatgctgatacaaaatcagagaaagagaaaataataagaacatctaatctaaacgatagcttaggtcaaattatagttatggattcaataggaaataattgcacaatgaattttcaaaacaataatgggagcaatataggattactaggttttcattcaaataatttggttgctagtagttggtattataacaatatacgaagaaatactagcagtaatggatgcttttggagttctatttctaaagagaatggatggaaagaatgataggccacagtaattaatctcaaactacatgagtctgtcaagaatttttgtataaacattcataaaaaattttaaaattaatatatttaagaatagctagatatgagtattgctatgttaatatctagctattttaatttatcccatattattataataagaaaaaatactatttctattgtaagtacaagtttattggtatctcataaatgatacaagatatc

SEQ ID NO: 5687 - DNA, 1308 bp, Artificial Sequence
  Description of Artificial Sequence: Synthetic botulinum toxin light chain of serotype F based on wild-type clostridium botulinum sequence
atgccagtcgctatcaactccttcaactacaacgacccagtcaacgacgacaccattttgtacatgcagatcccatacgaggagaagtctaagaagtactacaaggctttcgagatcatgagaaacgtctggattatcgagagaaacaccatcggtaccaacccatccgacttcgacccaccagcctctttgaagaacggttcctccgcttactacgacccaaactacttgaccaccgacgccgagaaggacagatacttgaagaccaccatcaagttgttcaagagaattaactctaacccagccggtaaggtcttgttgcaagagatctcctacgctaagccatacctgggtaacgaccacaccccaattgacgagttctccccagtcaccagaaccacctccgtcaacatcaagtctaccaacgttgagtcctccatgttgttgaacttgttggttctgggtgctggtccagacattttcgagtcttgttgttacccagtcagaaagctgatcgacccagacgttgtttacgacccatctaactacggtttcggttccattaacatcgttaccttctctccagagtacgagtacaccttcaacgacatctccggtggtcacaactcctccaccgagtctttcattgctgacccagccatctccctggctcacgagctgattcacgctttgcacggtttgtacggtgctagaggtgtcacctacgaggagaccattgaggtcaagcaagccccattgatgatcgccgagaagccaatcagattggaggagttcttgaccttcggtggtcaggacttgaacatcatcacctccgctatgaaggagaagatctacaacaacctgctggccaactacgagaagattgccaccagattgtccgaggtcaactctgccccaccagagtacgacatcaacgagtacaaggactacttccaatggaagtacggtttggacaagaacgccgacggttcctacaccgtcaacgagaacaagtccaacgagatttacaagaagttgtactctttcaccgagtccgacctggctaacaagttcaaggttaagtgtagaaacacctacttcatcaagtacgagttcttgaaggttccaaacctgttggacgacgacatctacaccgtttctgagggtttcaacatcggtaacttggctgtcaacaacagaggtcagtccattaagctgaacccaaagatcattgactccccagacaagggtctggttgagaagattgtcaagttctgtaagtccgtcatcccaagaaagggtaccaag

SEQ ID NO: 5688 - DNA, 3937 bp, Clostridium botulinum
  modified_base (20)..(20): a, c, t or g
atgccagttaatataaaaanctttaattataatgaccctattaataatgatgacattattatgatggaaccattcaatgacccagggccaggaacatattataaagcttttaggattatagatcgtatttggatagtaccagaaaggtttacttatggatttcaacctgaccaatttaatgccagtacaggagtttttagtaaagatgtctacgaatattacgatccaacttatttaaaaaccgatgctgaaaaagataaatttttaaaaacaatgattaaattatttaatagaattaattcaaaaccatcaggacagagattactggatatgatagtagatgctataccttatcttggaaatgcatctacaccgcccgacaaatttgcagcaaatgttgcaaatgtatctattaataaaaaaattatccaacctggagctgaagatcaaataaaaggtttaatgacaaatttaataatatttggaccaggaccagttctaagtgataattttactgatagtatgattatgaatggccattccccaatatcagaaggatttggtgcaagaatgatgataagattttgtcctagttgtttaaatgtatttaataatgttcaggaaaataaagatacatctatatttagtagacgcgcgtattttgcagatccagctctaacgttaatgcatgaacttatacatgtgttacatggattatatggaattaagataagtaatttaccaattactccaaatacaaaagaatttttcatgcaacatagcgatcctgtacaagcagaagaactatatacattcggaggacatgatcctagtgttataagtccttctacggatatgaatatttataataaagcgttacaaaattttcaagatatagctaataggcttaatattgtttcaagtgcccaagggagtggaattgatatttccttatataaacaaatatataaaaataaatatgattttgttgaagatcctaatggaaaatatagtgtagataaggataagtttgataaattatataaggccttaatgtttggctttactgaaactaatctagctggtgaatatggaataaaaactaggtattcttattttagtgaatatttgccaccgataaaaactgaaaaattgttagacaatacaatttatactcaaaatgaaggctttaacatagctagtaaaaatctcaaaacggaatttaatggtcagaataaggcggtaaataaagaggcttatgaagaaatcagcctagaacatctcgttatatatagaatagcaatgtgcaagcctgtaatgtacaaaaataccggtaaatctgaacagtgtattattgttaataatgaggatttatttttcatagctaataaagatagtttttcaaaagatttagctaaagcagaaactatagcatataatacacaaaataatactatagaaaataatttttctatagatcagttgattttagataatgatttaagcagtggcatagacttaccaaatgaaaacacagaaccatttacaaattttgacgacatagatatccctgtgtatattaaacaatctgctttaaaaaaaatttttgtggatggagatagcctttttgaatatttacatgctcaaacatttccttctaatatagaaaatctacaactaacgaattcattaaatgatgctttaagaaataataataaagtctatacttttttttctacaaaccttgttgaaaaagctaatacagttgtaggtgcttcactttttgtaaactgggtaaaaggagtaatagatgattttacatctgaatccacacaaaaaagtactatagataaagtttcagatgtatccataattattccctatataggacctgctttgaatgtaggaaatgaaacagctaaagaaaattttaaaaatgcttttgaaataggtggagccgctatcttaatggagtttattccagaacttattgtacctatagttggattttttacattagaatcatatgtaggaaataaagggcatattattatgacgatatccaatgctttaaagaaaagggatcaaaaatggacagatatgtatggtttgatagtatcgcagtggctctcaacggttaatactcaattttatacaataaaagaaagaatgtacaatgctttaaataatcaatcacaagcaatagaaaaaataatagaagatcaatataatagatatagtgaagaagataaaatgaatattaacattgattttaatgatatagattttaaacttaatcaaagtataaatttagcaataaacaatatagatgattttataaaccaatgttctatatcatatctaatgaatagaatgattccattagctgtaaaaaagttaaaagactttgatgataatcttaagagagatttattggagtatatagatacaaatgaactatatttacttgatgaagtaaatattctaaaatcaaaagtaaatagacacctaaaagacagtataccatttgatctttcactatataccaaggacacaattttaatacaagtttttaataattatattagtaatattagtagtaatgctattttaagtttaagttatagaggtgggcgtttaatagattcatctggatatggtgcaactatgaatgtaggttcagatgttatctttaatgatataggaaatggtcaatttaaattaaataattctgaaaatagtaatattacggcacatcaaagtaaattcgttgtatatgatagtatgtttgataattttagcattaacttttgggtaaggactcctaaatataataataatgatatacaaacttatcttcaaaatgagtatacaataattagttgtataaaaaatgactcaggatggaaagtatctattaagggaaatagaataatatggacattaatagatgttaatgcaaaatctaaatcaatatttttcgaatatagtataaaagataatatatcagattatataaataaatggttttccataactattactaatgatagattaggtaacgcaaatatttatataaatggaagtttgaaaaaaagtgaaaaaattttaaacttagatagaattaattctagtaatgatatagacttcaaattaattaattgtacagatactactaaatttgtttggattaaggattttaatatttttggtagagaattaaatgctacagaagtatcttcactatattggattcaatcatctacaaatactttaaaagatttttgggggaatcctttaagatacgatacacaatactatctgtttaatcaaggtatgcaaaatatctatataaagtattttagtaaagcttctatgggggaaactgcaccacgtacaaactttaataatgcagcaataaattatcaaaatttatatcttggtttacgatttattataaaaaaagcatcaaattctcggaatataaataatgataatatagtcagagaaggagattatatatatcttaatattgataatatttctgatgaatcttacagagtatatgttttggtgaattctaaagaaattcaaactcaattatttttagcacccataaatgatgatcctacgttctatgatgtactacaaataaaaaaatattatgaaaaaacaacatataattgtcagatactttgcgaaaaagatactaaaacatttgggctgtttggaattggtaaatttgttaaagattatggatatgtttgggatacctatgataattatttttgcataagtcagtggtatctcagaagaatatctgaaaatataaataaattaaggttgggatgtaattggcaattcattcccgtggatgaaggatggacagaataatataattaaatatttattaaagctactttgataggaaaatcaa

SEQ ID NO: 5689 - DNA, 1317 bp, Artificial Sequence
  Description of Artificial Sequence: Synthetic botulinum toxin light chain of serotype G based on wild-type clostridium botulinum sequence
atgccagtcaacatcaagaacttcaactacaacgacccaattaacaacgacgacatcatgatggagccattcaacgacccaggtccaggtacctactacaaggctttcagaatcattgacagaatttggatcgttccagagagattcacctacggtttccaaccagaccagttcaacgcctccaccggtgtcttctctaaggacgtctacgagtactacgacccaacctacttgaagaccgacgctgagaaggacaagttcttgaagaccatgatcaagttgttcaacagaattaactctaagccatccggtcaaagattgttggacatgattgttgacgctattccatacttgggtaacgcctccaccccaccagacaagttcgctgccaacgtcgctaacgtttctatcaacaagaagattatccaaccaggtgctgaggaccagatcaagggtttgatgaccaacttgattattttcggtccaggtccagtcttgtccgacaacttcaccgactctatgatcatgaacggtcactccccaatttccgagggtttcggtgctagaatgatgatcagattctgtccatcctgtttgaacgttttcaacaacgtccaagagaacaaggacacctctatcttctctagaagagcttacttcgctgacccagctctgaccctgatgcacgagttgatccacgtcttgcacggtctgtacggtattaagatctccaacctgccaattaccccaaacaccaaggagttcttcatgcaacactccgacccagttcaagccgaggagctgtacaccttcggtggtcacgacccatctgtttccccatctaccgacatgaacatttacaacaaggctctgcagaacttccaagacattgctaacagactgaacatcgtctcctctgcccaaggttctggtatcgacatttccttgtacaagcaaatctacaagaacaagtacgacttcgtcgaggacccaaacggtaagtactctgttgacaaggacaagttcgacaagctgtacaaggctttgatgttcggtttcaccgagaccaacttggccggtgagtacggtattaagaccagatactcttacttctctgagtacctgccaccaatcaagaccgagaagttgttggacaacaccatctacacccagaacgagggtttcaacattgcttccaagaacttgaagaacgagttcaacggtcagaacaaggccgtcaacaaggaggcctacgaggagatttccctggagcacttggtcatctacagaatcgctatgtgtaagccagtcatgtac

SEQ ID NO: 5690 - DNA, 4338 bp, Clostridium botulinum
gcttcatatgagtcgtcaagctgtatataaaaataaggttttagcattaaaaaaattagaacctatagtaaataaattaattaatatatagtttttataatttaattatgaataatattcttaagataaaaagtaaatttttaaaaatttaaattttcagtttacaaaaaataacctgattatgttatatgtaattgtaaaaaacatataaaaaatcagaaaaatttaggaggtatattattaatggattaaataataattttttaatttacttttgattaataaatattaaatgtttattttaattaggagatgatacgtatgccaataaccataaataattttagatatagtgatcctgttaataatgatacaattattatgatggagccaccatactgtaagggtctagatatctattataaggctttcaaaataacagatcgtatttggatagtgccggaaaggtatgaatttgggacaaaacctgaagattttaacccaccatcttcattaatagaaggtgcatctgagtattacgatccaaattatttaaggactgattctgataaagatagatttttacaaaccatggtaaaactgtttaacagaattaaaaacaatgtagcaggtgaagccttattagataagataataaatgccataccttaccttggaaattcatattccttactagacaagtttgatacaaactctaattcagtatcttttaatttattagaacaagaccccagtggagcaactacaaaatcagcaatgctgacaaatttaataatatttggacctgggcctgttttaaataaaaatgaggttagaggtattgtattgagggtagataataaaaattacttcccatgtagagatggttttggctcaataatgcaaatggcattttgcccagaatatgtacctacctttgataatgtaatagaaaatattacgtcactcactattggcaaaagcaaatattttcaagatccagcattactattaatgcacgaacttatacatgtactacatggtttatacggaatgcaggtatcaagccatgaaattattccatccaaacaagaaatttatatgcagcatacatatccaataagtgctgaagaactattcacttttggcggacaggatgctaatcttataagtattgatataaaaaacgatttatatgaaaaaactttaaatgattataaagctatagctaacaaacttagtcaagtcactagctgcaatgatcccaacattgatattgatagctacaaacaaatatatcaacaaaaatatcaattcgataaagatagcaatggacaatatattgtaaatgaggataaatttcagatactatataatagcataatgtatggttttacagagattgaattgggaaaaaaatttaatataaaaactagactttcttattttagtatgaatcatgaccctgtaaaaattccaaatttattagatgatacaatttacaatgatacagaaggatttaatatagaaagcaaagatctgaaatctgaatataaaggacaaaatatgagggtaaatacaaatgcttttagaaatgttgatggatcaggcctagtttcaaaacttattggcttatgtaaaaaaattataccaccaacaaatataagagaaaatttatataatagaactgcatcattaacagatttaggaggagaattatgtataaaaattaaaaatgaagatttaacttttatagctgaaaaaaatagcttttcagaagaaccatttcaagatgaaatagttagttataatacaaaaaataaaccattaaattttaattattcgctagataaaattattgtagattataatctacaaagtaaaattacattacctaatgataggacaaccccagttacaaaaggaattccatatgctccagaatataaaagtaatgctgcaagtacaatagaaatacataatattgatgacaatacaatatatcaatatttgtatgctcaaaaatctcctacaactctacaaagaataactatgactaattctgttgatgacgcattaataaattccaccaaaatatattcatattttccatctgtaatcagtaaagttaaccaaggtgcacaaggaattttattcttacagtgggtgagagatataattgatgattttaccaatgaatcttcacaaaaaactactattgataaaatttcagatgtatccactattgttccttatataggacccgcattaaacattgtaaaacaaggctatgagggaaactttataggcgctttagaaactaccggagtggttttattattagaatatattccagaaattactttaccagtaattgcagctttatctatagcagaaagtagcacacaaaaagaaaagataataaaaacaatagataactttttagaaaaaagatatgaaaaatggattgaagtatataaactagtaaaagcaaaatggttaggcacagttaatacgcaattccaaaaaagaagttatcaaatgtatagatctttagaatatcaagtagatgcaataaaaaaaataatagactatgaatataaaatatattcaggacctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgttatattaaaaaagagtacaattttaaatttagatattaataatgatattatatcagatatatctgggtttaattcatctgtaataacatatccagatgctcaattggtgcccggaataaatggcaaagcaatacatttagtaaacaatgaatcttctgaagttatagtgcataaagctatggatattgaatataatgatatgtttaataattttaccgttagcttttggttgagggttcctaaagtatctgctagtcatttagaacaatatggcacaaatgagtattcaataattagctctatgaaaaaacatagtctatcaataggatctggttggagtgtatcacttaaaggtaataacttaatatggactttaaaagattccgcgggagaagttagacaaataacttttagggatttacctgataaatttaatgcttatttagcaaataaatgggtttttataactattactaatgatagattatcttctgctaatttgtatataaatggagtacttatgggaagtgcagaaattactggtttaggagctattagagaggataataatataacattaaaactagatagatgtaataataataatcaatacgtttctattgataaatttaggatattttgcaaagcattaaatccaaaagagattgaaaaattatacacaagttatttatctataacctttttaagagacttctggggaaaccctttacgatatgatacagaatattatttaataccagtagcttctagttctaaagatgttcaattgaaaaatataacagattatatgtatttgacaaatgcgccatcgtatactaacggaaaattgaatatatattatagaaggttatataatggactaaaatttattataaaaagatatacacctaataatgaaatagattcttttgttaaatcaggtgattttattaaattatatgtatcatataacaataatgagcacattgtaggttatccgaaagatggaaatgcctttaataatcttgatagaattctaagagtaggttataatgccccaggtatccctctttataaaaaaatggaagcagtaaaattgcgtgatttaaaaacctattctgtacaacttaaattatatgatgataaaaatgcatctttaggactagtaggtacccataatggtcaaataggcaacgatccaaatagggatatattaattgcaagcaactggtactttaatcatttaaaagataaaattttaggatgtgattggtactttgtacctacagatgaaggatggacaaatgattaaacagattgatatgttcatgattactctatataaaaaattaaataatataacaatctagctatattattt

SEQ ID NO: 5691 - protein, 1296 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKNIINTSILNLRYESNHLIDLSRYASKINIGSKVNFDPIDKNQIQLFNLESSKIEVILKNAIVYNSMYENFSTSFWIRIPKYFNSISLNNEYTIINCMENNSGWKVSLNYGEIIWTLQDTQEIKQRVVFKYSQMINISDYINRWIFVTITNNRLNNSKIYINGRLIDQKPISNLGNIHASNNIMFKLDGCRDTHRYIWIKYFNLFDKELNEKEIKDLYDNQSNSGILKDFWGDYLQYDKPYYMLNLYDPNKYVDVNNVGIRGYMYLKGPRGSVMTTNIYLNSSLYRGTKFIIKKYASGNKDNIVRNNDRVYINVVVKNKEYRLATNASQAGVEKILSALEIPDVGNLSQVVVMKSKNDQGITNKCKMNLQDNNGNDIGFIGFHQFNNIAKLVASNWYNRQIERSSRTLGCSWEFIPVDDGWGERPL

SEQ ID NO: 5692 - protein, 461 aa, Artificial Sequence
  Description of Artificial Sequence: Synthetic botulinum toxin light chain of serotype A based on wild-type clostridium botulinum sequence
MVQFVNKQFNYKDPVNGVDIAYIKIPNVGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKLVPRGSHHHHHH

SEQ ID NO: 5693 - protein, 1291 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYLDFFNLNQEWRVYTYKYFKKEEEKLFLAPISDSDEFYNTIQIKEYDEQPTYSCQLLFKKDEESTDEIGLIGIHRFYESGIVFEEYKDYFCISKWYLKEVKRKPYNLKLGCNWQFIPKDEGWTE

SEQ ID NO: 5694 - protein, 441 aa, Artificial Sequence
  Description of Artificial Sequence: Synthetic botulinum toxin light chain of serotype B based on wild-type clostridium botulinum sequence
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVK

SEQ ID NO: 5695 - protein, 1291 aa, Clostridium botulinum
MPITINNFNYSDPVDNKNILYLDTHLNTLANEPEKAFRITGNIWVIPDRFSRNSNPNLNKPPRVTSPKSGYYDPNYLSTDSDKDPFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNNINDSKILSLQNRKNTLVDTSGYNAEVSEEGDVQLNPIFPFDFKLGSSGEDRGKVIVTQNENIVYNSMYESFSISFWIRINKWVSNLPGYTIIDSVKNNSGWSIGIISNFLVFTLKQNEDSEQSINFSYDISNNAPGYNKWFFVTVTNNMMGNMKIYINGKLIDTIKVKELTGINFSKTITFEINKIPDTGLITSDSDNINMWIRDFYIFAKELDGKDINILFNSLQYTNVVKDYWGNDLRYNKEYYMVNIDYLNRYMYANSRQIVFNTRRNNNDFNEGYKIIIKRIRGNTNDTRVRGGDILYFDMTINNKAYNLFMKNETMYADNHSTEDIYAIGLREQTKDINDNIIFQIQPMNNTYYYASQIFKSNFNGENISGICSIGTYRFRLGGDWYRHNYLVPTVKQGNYASLLESTSTHWGFVPVSE

SEQ ID NO: 5696 - protein, 444 aa, Artificial Sequence
  Description of Artificial Sequence: Synthetic botulinum toxin light chain of serotype C1 based on wild-type clostridium botulinum sequence
MPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGR

SEQ ID NO: 5697 - protein, 431 aa, Clostridium botulinum
MPIIKEPIDFINKPESEAQKWGKEEEKRWFTKLNNLEEVAVNQLKTKEDKTKIDNFSTDILFSSLTAIEIMKEDENQNLFDVERIREALLKNTLDREVIGYVNFTPKELGINFSIRDVELNRDISDEILDKVRQQIINQEYTKFSFVSLGLNDNSIDESIPVIVKTRVPTTFNYGVLNNKETVSLLLNQGFSIIPESAIITTIKGKDYILIEGSLSQELDFYNKGSEAWGEKNYGDYVSKLSQEQLGALEGYLHSDYKAINSYLRNNRVPNNDELNKKIELISSALSVKPIPETLIAYRRVDGIPFDLPSDFSFDKKENGEIIADKQKLNEFIDKWTGKEIKNLSFSSTSLKSTPLSFSKSRFIFRLRLSEGTIGAFIYGFSGFQDEQEILLNKNSTFKIFRITPITSIINRVTKMTQVVIDAEVIQNKEI

SEQ ID NO: 5698 - protein, 721 aa, Clostridium botulinum
MLVSKIENSVKDSNKNYFTINGLMGYYFENDFFNLSIISPTLDGNLTFSKEDINSILGNKSIKSARWIGLIKPSITGEYVLSTNSPNCRIELNGEIFNLSLNTSNTVNLIKGNVYDIRIEQLMSENQLLKNYEGIKLYWETSDIIKEIIPSEVLLKPNYSNTNEKSKFIPNNTLFSNAKLKANANRDTDRDGIPDEWEINGYTVMNQKAVAWDDKFAANGYKKYVSNPFKPCTANDPYTDFEKVSGQIDPSVSMVARDPMISAYPIVGVQMERLVVSKSETITGDSTKSMSKSTSHSSTNINTVGAEVSGSLQLAGGIFPVFSMSASANYSHTWQNTSTVDDTTGESFSQGLSINTGESAYINPNIRYYNTGTAPVYNVTPTTTIVIDKQSVATIKGQESLIGDYLNPGGTYPIIGEPPMALNTMDQFSSRLIPINYNQLKSIDNGGTVMLSTSQFTGNFAKYNSNGNLVTDGNNWGPYLGTIKSTTASLTLSFSGQTTQVAVVAPNFSDPEDKTPKLTLEQALVKAFALEKKNGKFYFHGLEISKNEKIQVFLDSNTNNDFENQLKNTADKDIMHCIIKRNMNILVKVITFKENISSINIINDTNFGVQSMTGLSNRSKGQDGIYRAATTAFSFKSKELKYPEGRYRMRFVIQSYEPFTCNFKLFNNLIYSSSFDKGYYDEFFYFYYNGSKSFFNISCDIINSINRLSGVFLIELDKLII

SEQ ID NO: 5699 - protein, 1276 aa, Clostridium botulinum
MTWPVKDFNYSDPVNDNDILYLRIPQNKLITTPVKAFMITQNIWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIPQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCLRLTKNSRDDSTCIKVKNNRLPYVADKDSISQEIFENKIITDETNVQNYSDNFSLDESILDGQVPINPEIVDPLLPNVNMEPLNLPGEEIVFYDDITKYVDYLNSYYYLESQKLSNNVENITLTTSVEEALGYSNKIYTFLPSLAEKVNKGVQAGLFLNWANEVVEDFTTNIMKKDTLDKISDVSVIIPYIGPALNIGNSALRGNFKQAFATAGVAFLLEGFPEFTIPALGVFTFYSSIQEREKIIKTIENCLEQRVKRWKDSYQWMVSNWLSRITTQFNHINYQMYDSLSYQADAIKAKIDLEYKKYSGSDKENIKSQVENLKNSLDVKISEAMNNINKFIRECSVTYLFKNMLPKVIDELNKFDLRTKTELINLIDSHNIILVGEVDRLKAKVNESFENTMPFNIFSYTNNSLLKDIINEYFNSINDSKILSLQNKKNALVDTSGYNAEVRVGDNVQLNTIYTNDFKLSSSGDKIIVNLNNNILYSAIYENSSVSFWIKISKDLTNSHNEYTIINSIEQNSGWKLCIRNGNIEWILQDVNRKYKSLIFDYSESLSHTGYTNKWFFVTITNNIMGYMKLYINGELKQSQKIEDLDEVKLDKTIVFGIDENIDENQMLWIRDFNIFSKELSNEDINIVYEGQILRNVIKDYWGNPLKFDTEYYIINDNYIDRYIAPESNVLVLVRYPDRSKLYTGNPITIKSVSDKNPYSRILNGDNIILHMLYNSRKYMIIRDTDTIYATQGGECSQNCVYALKLQSNLGNYGIGIFSIKNIVSKNKYCSQIFSSFRENTMLLADIYKPWRFSFKNAYTPVAVTNYETKLLSTSSFWKFISRDPGWVE

SEQ ID NO: 5700 - protein, 441 aa, Artificial Sequence
  Description of Artificial Sequence: Synthetic botulinum toxin light chain of serotype D based on wild-type clostridium botulinum sequence
MTWPVKDFNYSDPVNDNDILYLRIPQNKLITTPVKAFMITQNTWVIPERFSSDTNPSLSKPPRPTSKYQSYYDPSYLSTDEQKDTFLKGIIKLFKRINERDIGKKLINYLVVGSPFMGDSSTPEDTFDFTRHTTNIAVEKFENGSWKVTNIITPSVLIFGPLPNILDYTASLTLQGQQSNPSFEGFGTLSILKVAPEFLLTFSDVTSNQSSAVLGKSIFCMDPVIALMHELTHSLHQLYGINIPSDKRIRPQVSEGFFSQDGPNVQFEELYTFGGLDVEIIQIERSQLREKALGHYKDIAKRLNNINKTIPSSWISNIDKYKKIFSEKYNFDKDNTGNFVVNIDKFNSLYSDLTNVMSEVVYSSQYNVKNRTHYFSRHYLPVFANILDDNIYTIRDGFNLTNKGFNIENSGQNIERNPALQKLSSESVVDLFTKVCLRLTK

SEQ ID NO: 5701 - protein, 1252 aa, Clostridium botulinum
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQDILLPNVIIMGAEPDLFETNSSNISLRNNYMPSNHGFGSIAIVTFSPEYSFRFNDNSMNEFIQDPALTLMHELIHSLHGLYGAKGITTKYTITQKQNPLITNIRGTNIEEFLTFGGTDLNIITSAQSNDIYTNLLADYKKIASKLSKVQVSNPLLNPYKDVFEAKYGLDKDASGIYSVNINKFNDIFKKLYSFTEFDLATKFQVKCRQTYIGQYKYFKLSNLLNDSIYNISEGYNINNLKVNFRGQNANLNPRIITPITGRGLVKKIIRFCKNIVSVKGIRKSICIEINNGELFFVASENSYNDDNINTPKEIDDTVTSNNNYENDLDQVILNFNSESAPGLSDEKLNLTIQNDAYIPKYDSNGTSDIEQHDVNELNVFFYLDAQKVPEGENNVNLTSSIDTALLEQPKIYTFFSSEFINNVNKPVQAALFVSWIQQVLVDFTTEANQKSTVDKIADISIVVPYIGLALNIGNEAQKGNFKDALELLGAGILLEFEPELLIPTILVFTIKSFLGSSDNKNKVIKAINNALKERDEKWKEVYSFIVSNWMTKINTQFNKRKEQMYQALQNQVNAIKTIIESKYNSYTLEEKNELTNKYDIKQIENELNQKVSIAMNNIDRFLTESSISYLMKLINEVKINKLREYDENVKTYLLNYIIQHGSILGESQQELNSMVTDTLNNSIPFKLSSYTDDKILISYFNKFFKRIKSSSVLNMRYKNDKYVDTSGYDSNININGDVYKYPTNKNQFGIYNDKLSEVNISQNDYIIYDNKYKNFSISFWVRIPNYDNKIVNVNNEYTIINCMRDNNSGWKVSLNHNEIIWTLQDNAGINQKLAFNYGNANGISDYINKWIFVTITNDRLGDSKLYINGNLIDQKSILNLGNIHVSDNILFKIVNCSYTRYIGIRYFNIFDKELDETEIQTLYSNEPNTNILKDFWGNYLLYDKEYYLLNVLKPNNFIDRRKDSTLSINNIRSTILLANRLYSGIKVKIQRVNNSSTNDNLVRKNDQVYINFVASKTHLFPLYADTATTNKEKTIKISSSGNRFNQVVVMNSVGNNCTMNFKNNNGNNIGLLGFKADTVVASTWYYTHMRDHTNSNGCFWNFISEEHGWQEK

SEQ ID NO: 5702 - protein, 422 aa, Artificial Sequence
  Description of Artificial Sequence: Synthetic botulinum toxin light chain of serotype E based on wild-type clostridium botulinum sequence
MPKINSFNYNDPVNDRTILYIKPGGCQEFYKSFNIMKNIWIIPERNVIGTTPQDFHPPTSLKNGDSSYYDPNYLQSDEEKDRFLKIVTKIFNRINNNLSGGILLEELSKANPYLGNDNTPDNQFHIGDASAVEIKFSNGSQDILLPNVIIMGAEPDLFETNSSNISLRNNYMPSNHGFGSIAIVTFSPEYSFRFNDNSMNEFIQDPALTLMHELIHSLHGLYGAKGITTKYTITQKQNPLITNIRGTNIEEFLTFGGTDLNIITSAQSNDIYTNLLADYKKIASKLSKVQVSNPLLNPYKDVFEAKYGLDKDASGIYSVNINKFNDIFKKLYSFTEFDLATKFQVKCRQTYIGQYKYFKLSNLLNDSIYNISEGYNINNLKVNFRGQNANLNPRIITPITGRGLVKKIIRFCKNIVSVKGIR

SEQ ID NO: 5703 - protein, 1274 aa, Clostridium botulinum
MPVAINSFNYNDPVNDDTILYMQIPYEEKSKKYYKAFEIMRNVWIIPERNTIGTNPSDFDPPASLKNGSSAYYDPNYLTTDAEKDRYLKTTIKLFKRINSNPAGKVLLQEISYAKPYLGNDHTPIDEFSPVTRTTSVNIKLSTNVESSMLLNLLVLGAGPDIFESCCYPVRKLIDPDVVYDPSNYGFGSINIVTFSPEYEYTFNDISGGHNSSTESFIADPAISLAHELIHALHGLYGARGVTYEETIEVKQAPLMIAEKPIRLEEFLTFGGQDLNIITSAMKEKIYNNLLANYEKIATRLSEVNSAPPEYDINEYKDYFQWKYGLDKNADGSYTVNENKFNEIYKKLYSFTESDLANKFKVKCRNTYFIKYEFLKVPNLLDDDIYTVSEGFNIGNLAVNNRGQSIKLNPKIIDSIPDKGLVEKIVKFCKSVIPRKGTKAPPRLCIRVNNSELFFVASESSYNENDINTPKEIDDTTNLNNNYRNNLDEVILDYNSQTIPQISNRTLNTLVQDNSYVPRYDSNGTSEIEEYDVVDFNVFFYLHAQKVPEGETNISLTSSIDTALLEESKDIFFSSEFIDTINKPVNAALFIDWISKVIRDFTTEATQKSTVDKIADISLIVPYVGLALNIIIEAEKGNFEEAFELLGVGILLEFVPELTIPVILVFTIKSYIDSYENKNKAIKAINNSLIEREAKWKEIYSWIVSNWLTRINTQFNKRKEQMYQALQNQVDAIKTAIEYKYNNYTSDEKNRLESEYNINNIEEELNKKVSLAMKNIERFMTESSISYLMKLINEAKVGKLKKYDNHVKSDLLNYILDHRSILGEQTNELSDLVTSTLNSSIPFELSSYTNDKILIIYFNRLYKKIKDSSILDMRYENNKFIDISGYGSNISINGNVYIYSTNRNQFGIYNSRLSEVNIAQNNDIIYNSRYQNFSISFWVRIPKHYKPMNHNREYTIINCMGNNNSGWKISLRTVRDCEIIWTLQDTSGNKENLIFRYEELNRISNYINKWIFVTITNNRLGNSRIYINGNLIVEKSISNLGDIHVSDNILFKIVGCDDETYVGIRYFKVFNTELDKTEIETLYSNEPDPSILKNYWGNYLLYNKKYYLFNLLRKDKYITLNSGILNINQQRGVTEGSVFLNYKLYEGVEVIIRKNGPIDISNTDNFVRKNDLAYINVVDRGVEYRLYADTKSEKEKIIRTSNLNDSLGQIIVMDSIGNNCTMNFQNNNGSNIGLLGFHSNNLVASSWYYNNIRRNTSSNGCFWSSISKENGWKE

SEQ ID NO: 5704 - protein, 436 aa, Artificial Sequence
  Description of Artificial Sequence: Synthetic botulinum toxin light chain of serotype F based on wild-type clostridium botulinum sequence
MPVAINSFNYNDPVNDDTILYMQIPYEEKSKKYYKAFEIMRNVWIIERNTIGTNPSDFDPPASLKNGSSAYYDPNYLTTDAEKDRYLKTTIKLFKRINSNPAGKVLLQEISYAKPYLGNDHTPIDEFSPVTRTTSVNIKSTNVESSMLLNLLVLGAGPDIFESCCYPVRKLIDPDVVYDPSNYGFGSINIVTFSPEYEYTFNDISGGHNSSTESFIADPAISLAHELIHALHGLYGARGVTYEETIEVKQAPLMIAEKPIRLEEFLTFGGQDLNIITSAMKEKIYNNLLANYEKIATRLSEVNSAPPEYDINEYKDYFQWKYGLDKNADGSYTVNENKSNEIYKKLYSFTESDLANKFKVKCRNTYFIKYEFLKVPNLLDDDIYTVSEGFNIGNLAVNNRGQSIKLNPKIIDSPDKGLVEKIVKFCKSVIPRKGTK

SEQ ID NO: 5705 - protein, 1297 aa, Clostridium botulinum
  MOD_RES (7)..(7): Any amino acid
MPVNIKXFNYNDPINNDDIIMMEPFNDPGPGTYYKAFRIIDRIWIVPERFTYGFQPDQFNASTGVFSKDVYEYYDPTYLKTDAEKDKFLKTMIKLFNRINSKPSGQRLLDMIVDAIPYLGNASTPPDKFAANVANVSINKKIIQPGAEDQIKGLMTNLIIFGPGPVLSDNFTDSMIMNGHSPISEGFGARMMIRFCPSCLNVFNNVQENKDTSIFSRRAYFADPALTLMHELIHVLHGLYGIKISNLPITPNTKEFFMQHSDPVQAEELYTFGGHDPSVISPSTDMNIYNKALQNFQDIANRLNIVSSAQGSGIDISLYKQIYKNKYDFVEDPNGKYSVDKDKFDKLYKALMFGFTETNLAGEYGIKTRYSYFSEYLPPIKTEKLLDNTIYTQNEGFNIASKNLKTEFNGQNKAVNKEAYEEISLEHLVIYRIAMCKPVMYKNTGKSEQCIIVNNEDLFFIANKDSFSKDLAKAETIAYNTQNNTIENNFSIDQLILDNDLSSGIDLPNENTEPFTNFDDIDIPVYIKQSALKKIFVDGDSLFEYLHAQTFPSNIENLQLTNSLNDALRNNNKVYTFFSTNLVEKANTVVGASLFVNWVKGVIDDFTSESTQKSTIDKVSDVSIIIPYIGPALNVGNETAKENFKNAFEIGGAAILMEFIPELIVPIVGFFTLESYVGNKGHIIMTISNALKKRDQKWTDMYGLIVSQWLSTVNTQFYTIKERMYNALNNQSQAIEKIIEDQYNRYSEEDKMNINIDFNDIDFKLNQSINLAINNIDDFINQCSISYLMNRMIPLAVKKLKDFDDNLKRDLLEYIDTNELYLLDEVNILKSKVNRHLKDSIPFDLSLYTKDTILIQVFNNYISNISSNAILSLSYRGGRLIDSSGYGATMNVGSDVIFNDIGNGQFKLNNSENSNITAHQSKFVVYDSMFDNFSINFWVRTPKYNNNDIQTYLQNEYTIISCIKNDSGWKVSIKGNRIIWTLIDVNAKSKSIFFEYSIKDNISDYINKWFSITITNDRLGNANIYINGSLKKSEKILNLDRINSSNDIDFKLINCTDTTKFVWIKDFNIFGRELNATEVSSLYWIQSSTNTLKDFWGNPLRYDTQYYLFNQGMQNIYIKYFSKASMGETAPRTNFNNAAINYQNLYLGLRFIIKKASNSRNINNDNIVREGDYIYLNIDNISDESYRVYVLVNSKEIQTQLFLAPINDDPTFYDVLQIKKYYEKTTYNCQILCEKDTKTFGLFGIGKFVKDYGYVWDTYDNYFCISQWYLRRISENINKLRLGCNWQFIPVDEGWTE

SEQ ID NO: 5706 - protein, 439 aa, Artificial Sequence
  Description of Artificial Sequence: Synthetic botulinum toxin light chain of serotype G based on wild-type clostridium botulinum sequence
MPVNIKNFNYNDPINNDDIMMEPFNDPGPGTYYKAFRIIDRIWIVPERFTYGFQPDQFNASTGVFSKDVYEYYDPTYLKTDAEKDKFLKTMIKLFNRINSKPSGQRLLDMIVDAIPYLGNASTPPDKFAANVANVSINKKIIQPGAEDQIKGLMTNLIIFGPGPVLSDNFTDSMIMNGHSPISEGFGARMMIRFCPSCLNVFNNVQENKDTSIFSRRAYFADPALTLMHELIHVLHGLYGIKISNLPITPNTKEFFMQHSDPVQAEELYTFGGHDPSVSPSTDMNIYNKALQNFQDIANRLNIVSSAQGSGIDISLYKQIYKNKYDFVEDPNGKYSVDKDKFDKLYKALMFGFTETNLAGEYGIKTRYSYFSEYLPPIKTEKLLDNTIYTQNEGFNIASKNLKNEFNGQNKAVNKEAYEEISLEHLVIYRIAMCKPVMY

SEQ ID NO: 5707 - protein, 1315 aa, Clostridium botulinum
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKKIIPPTNIRENLYNRTASLTDLGGELCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 5708 - protein, 1161 aa, Clostridium botulinum
MKINNNFNINSLVDNKDVAIVRGRKTDIFLKVFQVAPNIWVAPERYYGESLNINEDQKSNGGIYDSNFLLTNDEKDEFLQATVKILQRINNNVIGAKLLSLISTAIPFPYEYRAEDYRQTNYLSSKDNQHYYTANLVIFGPGTNIVENNVVYYKKEDSKNGMGTMSEIWFQPFLTYKYDQFYVDPALELIKCLIKSLYYLYGIKPNDDLSIPYRLRSEFNSLEYSELDMVDFLISGGTDYKLLNTNPYWFTDNYFINAPKNFEKYKNDYETKIKNNNDIANSIKLYLEQKFKTNVQDIWELNLSYFSTEFEIMMPEIFNNALNHYHRKEYYVIDYFKNYNINGFINGQIKTILPLSKYYKNIINKPELIVNLINENNSVLMKSNIYGDGLKDTIGNFYAVYKIPYNIGDEYHINSSDSCLDNVDIKEINNIPPINDADIYPYRKNCDPFTPVYNITETKEINTTIPFPVNYLQAQVTNSNDINLSSDFLKVISSKDRSLVYSFLDNTIDYLDSIKYDGPIDTDKKYYLWLKEIFRNYSFDITATQEINTDCGINKVVTWFGKALNILNTSDSFVEEFQNLGPISLINKKENLSMPKIEIDEIPNSMLNLSFKDLSENLFNIFSKNNSYFEKIYYDFLDQWWTQYYSQYFDLICMAKRSVLAQESLIKKIIQKKLSYLIGNSNISSDNLALMNLTTTNTLRDISNESQIAMNNVNNFLNNVAICVFQTNIYPKFISFMEQCINNINKNTREFIQKCTNITENEKLQLINQNIFSSLDFDFLNIENLKSLFNSETGLLIKEETSPYELVLYAFQEPGNNAIGDASGKNTSIEYSKDIGLVYGINRDALYLNGSNQSISFSNDFFENGLTNSFSIYFWLRNLGKDTIKSKLIGSKEDNCGWEIYFQDTGLVFNMIDSNGNEKNIYLSDVSNNSWHYITISVDRLKEQLLIFIDDNLVANESIKEILNIYSSNTISLVDENNPIYVEGLSILNKPTTSQEVLSNYFKVLNNSYIRDSSEERLEYNKTYQLYNYVFSENPIYEIKQNNNIYLTINNTNNLNLQVSKFKLLSINPNKQYVQKLDEVIISVLDNMEKYIDISEDNRLQLIDNKNNAKKMIISNDIFISNCLIISYNGKYICLSMKDENHNWMICNNDMSKYLYLWSFK

SEQ ID NO: 5709 - protein, 1198 aa, Clostridium botulinum
MNINDNLSINSPVDNKNVVVVRARKTDTVFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKSFYASNIVIFGPGANIVENNTVFYKKEDAENGMGTMTEIWFQPFLTYKYDEFYIDPAIELIKCLIKSLYFLYGIKPSDDLVIPYRLRSELENIEYSQLNIVDLLVSGGIDPKFINTDPYWFIDNYFSNAKKVFEDHRNIYETEIEGNNAIGNDIKLRLKQKFRININDIWELNLNYFSKEFSIMMPDRFNNALKHFYRKQYYKIDYPENYSINGFVNGQINAQLSLSDRNQDIINKPEEIINLLNGNNVSLMRSNIYGDGLKSTVDDFYSNYKIPYNRAYEYHFNNSNDSSLDNVNIGVIDNIPEIIDVNPYKENCDKFSPVQKITSTREINTNIPWPINYLQAQNTNNEKFSLSSDFVEVVSSKDKSLVYSFLSNVMFYLDSIKDNSPIDTDKKYYLWLREIFRNYSFDITATQEINTDCGINKVVTWFGKALNILNTSDSFVEEFQNLGPISLINKKENLSMPKIEIDEIPNSMLNLSFKDLSENLFNIFSKNNSYFEKIYYDFLDQWWTQYYSQYFDLICMAKRSVLAQESLIKKIIQKKLSYLIGNSNISSDNLALMNLTTTNTLRDISNESQIAMNNVNNFLNNVAICVFQTNIYPKFISFMEQCINNINKNTREFIQKCTNITENEKLQLINQNIFSSLDFDFLNIENLKSLFNSETGLLIKEETSPYELVLYAFQEPGNNAIGDASGKNTSIEYSKDIGLVYGINSDALYLNGSNQSISFSNDFFENGLTNSFSIYFWLRNLGKDTIKSKLIGSKEDNCGWEIYFQDTGLVFNMIDSNGNEKNIYLSDVSNNSWHYITISVDRLKEQLLIFIDDNLVANGSIKEILNIYSSNTISLVNENNPIYVEGLSILNRSITSEEVVNNYFTYLNNSYIRDISGERLEYNKTYELYNYVFPESSLYEVTENNNIYLSIKNTNNLNIQGAKFKLINIDANKQYVQKWDEGVVCLLGDEEKYVDISSENNRIQLVSSKDTAKRIIFNNDIFRPNCLTFAYNNKYLSLSLRDRNYNWMICNNNDNIPKAAHLWALKGI

SEQ ID NO: 5710 - protein, 1193 aa, Clostridium botulinum
MDINDDLNINSPVDNKNVVIVRARKTNTFFKAFKVAPNIWVAPERYYGEPLHIAEEYKLDGGIYDSNFLSQDSERENFLQAIIILLKRINNTISGKQLLSLISTAIPFPYGYIGGGYSSPNIFTFGKTPRTNKKLNSLVTSTIPFPFGGYRETNYIESQNNKNFYASNIIIFGPGSNIVENNVIYYKKNDAENGMGTMAEIVFQPLLTYKYNKFYIDPAMELTKCLIKSLYFLYGIKPSGNLVVPYRLRTELDNKQFSQLNIIDLLISGGVDLEFINTNPYWFTNSYFPNSIKMFEKYKNIYKTEIEGNNAIGNDIKLRLKQKFQINVQDIWNLNLNYFCQSFNSIIPDRFSNALKHFYRKQYYTMDYTDNYNINGFVNGQINTKLPLSNKNTNIISKPEKVVNLVNENNISLMKSNIYGDGLKGTTEDFYSTYKIPYDEEYEYRFNDSDNFPLNNISIEEVDSIPEIIDINPYKDNSDNLVFTQITSMTEEVTTHTALSINYLQAQITNNENFTLSSDFSKVVSSKDKSLVYSFLDNLMSYLETIKNDRPIHTDKKYYLWLKEVFKNYSFDINLTQEIDSMCGINQVVLWFGKALNILNTSNSFVEEYQDSGAICLISKKDNLREPNIEIDDISDSLLGLSFKDLNNKLYEIYSKNIVYFKKIYFSFLDQWWTQYYSQYFDLICMAKKSILAQETLIKKIIQKKLSYLIGNSNISSDNLALMNLTTTNTLRDISNESQIAMNNVDSFLNSAAICVFEGNIYPKFISFMEQCINNINKNTREFIQKCTNITENEKLQLINQNIFSSLDFDFLNIENLKSLFSSETALLIKEETSPYELVLYAFQEPDNNAIGDASAKNTSIEYSKDIDLVYGINSDALYLNGSNQSISFSNDFFENGLTNSFSIYFWLRNLGKDTIKSKLIGSKGDNCGWEIYFQDTGLVFNMIDSNGNEKNIYLSDVSNNSWHYITISVDRLKEQLLIFIDDNLVANESIKEILNIYSSNIISLLSENNPSYIEGLTILNKPTTSQEVLNNYFKVLNNSYIRDSNEERLEYNKTYQLYNYVFSDKPICEVKQNNNIYLTINNTNNLNLQPSKFKLLSINPNKQYVQKLDEVIISVLGNMEKYIDISEDNRLQLIDNKNGAKKMIISNDMFISNCLTLSCGGKYICLSMKDENHNWMICNNDMSKYLYLWSFK

SEQ ID NO: 5711 - protein, 1193 aa, Clostridium botulinum
MNINDNLSINSPVDNKNVVVVRARKTDTVFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKSFYASNIVIFGPGANIVENNTVFYKKEDAENGMGTMTEIWFQPFLTYKYDEFYIDPAIELIKCLIKSLYFLYGIKPSDDLVIPYRLRSELENIEYSQLNIVDLLVSGGIDPKFINTDPYWFTDNYFSNAKKVFEDHRNIYETEIEGNNAIGNDIKLRLKQKFRININDIWELNLNYFSKEFSIMMPDRFNNALKHFYRKQYYKIDYPENYSINGFVNGQINAQLSLSDRNQDIINKPEEIINLLNGNNVSLMRSNIYGDGLKSTVDDFYSNYKIPYNRAYEYHFNNSNDSSLDNVNIGVIDNIPEIIDVNPYKENCDKFSPVQKITSTREINTNIPWPINYLQAQNTNNEKFSLSSDFVEVVSSKDKSLVYSFLSNVMFYLDSIKDNSPIDTDKKYYLWLREIFRNYSFDITATQEINTNCGINKVVTWFGKALNILNTSDSFVEEFQNLGAISLINKKENLSMPIIESYEIPNDMLGLPLNDLNEKLFNIYSKNTAYFKKIYYNFLDQWWTQYYSQYFDLICMAKRSVLAQETLIKRIIQKKLSYLIGNSNISSDNLALMNLTTTNTLRDISNESQIAMNNVDSFLNNAAICVFESNIYPKFISFMEQCINNINIKTKEFIQKCTNINEDEKLQLINQNVFNSLDFEFLNIQNMKSLFSSETALLIKEETWPYELVLYAFKEPGNNVIGDASGKNTSIEYSKDIGLVYGINSDALYLNGSNQSISFSNDFFENGLTNSFSIYFWLRNLGKDTIKSKLIGSKEDNCGWEIYFQDTGLVFNMIDSNGNEKNIYLSDVSNNSWHYITISVDRLKEQLLIFIDDNLVANESIKEILNIYSSNIISLLSENNPSYIEGLTILNKPTTSQEVLSNYFEVLNNSYIRDSNEERLEYNKTYQLYNYVFSDKPICEVKQNNNIYLTINNTNNLNLQASKFKLLSINPNKQYVQKLDEVIISVLDNMEKYIDISEDNRLQLIDNKNNAKKMIISNDIFISNCLTLSYNGKYICLSMKDENHNWMICNNDMSKYLYLWSFK

SEQ ID NO: 5712 - protein, 1159 aa, Clostridium botulinum
MKINNNFNIDSLIDNRDVAIVRGRKTDTFFKVFQVAPNIWIAPERYYGESLNINEDQKSDGGIYDSNFLSTNDEKDEFLQATVKILQRINNNVIGAKLLSLISTAIPFPYEYKPGDYRQTNYLVSKDNQHYYTANLVIFGPGTNIVENNAIYYKKEDSENGMGTMSEIWFQPFLTYKYGQFYVDPALELIKCLIKSLYYLYGIKPSDDLSIPYRLRSELNSFEYSELDMIDFLISGGTEYKLLDTNPYWFTDNYFIDAPKNFEKYKNDYETKIKNNNDIANSIKLYLEQKFKTNAQDIWELNLSYFSTEFEIMMPEIFNNALNHYYRKEYYVIDYFKNYNINGFINGQIKTILPLSKYNKNIINKPELVVNLINENNTVLMKSNVYGDGLKGTMDNFYAAYKIPYNIGDEYHINYSYLNNVNVEEINNIPPINDADIYPYRKNSDPFIPVYNITETKEINTTTPLSVNYLQAQVTNSNDISLSSDFSKVISSKDRSLVYSFLDNTIDYLDSIKYDEPIDTDKKYYLWLKEIFRNYSFDMTETQEVNTPCGINKVVPWLGKALNILNTGNSFIEEFKSLGPISLINKKENITMPKIEIDEIPNSMLNLSFKDLSENLFNRFSKNNSYFEKIYYDFLDQWWTQYYSQYFDLICMAKKSILAQETLIKKIIQKKLSYLIGNSNISSDNLALMNLTTTNTLRDISNESQIAMNNVDSFLNSAAICVFEGNIYSKFISFMEQCINNINKNTREFIQKCTNITENEKLQLINQNIFSSLDFDFLNIENLKSLFSSETALLIKEETSPYELVLYAFQEPDNNAIGDASAKNTSIEYSKDIDLVYGINSDALYLNGSNQSISFSNDFFENGLTNSFSIYFWLRNLGKDTIKYKLIGSKEDNCGWEIYFQDTGLVFNMIDSNGNEKNIYLSDVSNNSWHYITISVDRLKEQLLIFIDDNLVANESIKEILNIYSSNIISLLSENKPSYIEGLTILNKPTTSQEVLNNYFKVLNNSYIRDSNEERLEYHKTYQLDNYVFSDKPICEVKQNNNIYLTINNTNNLNLQPSKFKLLSINSNKQYVQKFDEVIISILGNMEKYIDISEDNRLQLIDNKNGAKKMIISNDMFISNCLTLSCGGKYICLSMKDENHNWMICNNDMSKYLYLWSFK

SEQ ID NO: 5713 - protein, 1159 aa, Clostridium botulinum
MKINNNFNIDSPVDNKDVAIVRGRKTDTFFKAFQVAPNIWVAPERYYGESLNINEDQKSDGGIYDSNFLLTNDEKDEFLQATIKILQRINNNVIGAKLLSLISTAIPFPYEYKLGDYRQTNYLVSKDNQHYYTANLVIFGPGTNIVENNAVYYKKEDSENGMGTMSEIWFQPFLTYKYDQFYVDPALELIKCLIKSLYYLYGIKPNDDLSIPYRLRSEFNSLEYSELDMVDFLISGGTDYKLLNTNPYWFTDNYFINAPKNFEKYKNDYETKIKNNNDIANSIKLYLEQKFKTNAQDIWELNLSYFSTEFEIMMPEIFNNALNHYHRKEYYVIDYFKNYNINGFINGQIKTILPLSKYNKNIINKPELIVNLINENNSVLMKSNVYGDGLKGTMNNFYAVYKIPYNIGDEYHINYSYLNNVNVEEINNIPPINDADIYPYRKNSDPFIPVYNITETKEINTTTPFSVNYLQVQVTNSNDINLSSDFSKVISSKDRSLVYSFLDNTIDYLDSIKYDEPIDTDKKYYLWLKEIFRNYSFDMTETQEVNIPCGINKVVPWLGKALNILNTGNSFIEEFKSLGPISLINKKENITMPKIEIDEIPNSMLNLSFKDLSENLFNIFFKNNSYFEKIYYDFLDQWWTQYYSQYFDLICMAKRSVLAQESLIKKIIQKKLSYLIGNSNISSDNLALMNLTTTNTLRDISNESQIAMNNVDSFLNSAAICVFESNICPKFISFMEQCINNINKNTREFIQKCTNITENEKLQLINQNIFSSLDFDFLNIENLKSLFNSETALLIKEQTSSYELVLYAFQEPGNNAIGDASGKNTSIEYSKDIGLVYGINSDALYLNGSNQSISFSNDFFENGLTNSFSIYFWLRNLGKDTTKSKLIGSKEDNCGWEIYFQDTGLVFNMIDSNGNEKNIYLSDVSNNSWHYVTISVDRLKEQLLIFIDDNLVVNESIKEILNIYSSNIISLLSNNNTSYIEGLTILNKPTTSQEVLSNYFKVLNNSYIRDSNEERLEYNKTYQLYNYVFSDKPICEVKQNNNIYLTINNTNNLNLQPSKFKLLSINSNKQYVQKFDEVIISILGNMEKYIDISEDNRLQLINNKNSAKKMIISNDIFISNCLTLSCGGKYICLSMKDENYNWMICNNDMSKYLYLWSFK

SEQ ID NO: 5714 - protein, 1161 aa, Clostridium botulinum
MKINNNFNIDSPVDNKDVAIVRGRKTDIFLKVFQVAPNIWVAPERYYGESLNINEDQKSNGGIYDSNFLLTNDEKDEFLQATVKILQRINNNVIGAKLLSLISTAIPFPYEYRAEDYRQTNYLSSKDNQHYYTANLVIFGPGTNIVENNVVYYKKEDSKNGMGTMSEIWFQPFLTYKYDQFYVDPALELIKCLIKSLYYLYGIKPNDDLSIPYRLRSEFNSLEYSELDMVDFLISGGTDYKLLNTNPYWFTDNYFINAPKNFEKYKNDYETKIKNNNDIANSIKLYLEQKFKTNVQDIWELNLSYFSTEFEIMMPEIFNNALNHYHRKEYYVIDYFKNYNINGFINGQIKTILPLSKYNKNIINKPELIVNLINENNSVLMKSNIYGDGLKDTIGNFYAVYKIPYNIGDEYHINSSDSCLDNVDIKEIDNIPPINDADIYPYRKNCDPFTPVYNITETKEINTTIPFPVNYLQAQVTNSNDINLSSDFLKVISSKDRSLVYSFLDNTIDYLDSIKYDGPIDTDKKYYLWLKEIFRNYSFDITATQEINTDCGINKVVTWFGKALNILNTSDSFVEEFQNLGPISLINKKENLSMPKIEIDEIPNSMLNLSFKDLSENLFNIFSKNNSYFEKIYYDFLDQWWTQYYSQYFDLICMAKRSVLAQESLIKKIIQKKLSYLIGNSNISSDNLALMNLTTTNTLRDISNESQIAMNNVNNFLNNVAICVFQTNIYPKFISFMEQCINNINKNTREFIQKCTNITENEKLQLINQNIFSSLDFDFLNIENLKSLFNSETGLLIKEETSPYELVLYAFQEPGNNAIGDASGKNTSIEYSKDIGLVYGINSDALYLNGSNQSISFSNDFFENGLTNSFSIYFWLRNLGKDTIKSKLIGSKEDNCGWEIYFQDTGLVFNMIDSNGNEKNIYLSDVSNNSWHYITISVDRLKEQLLIFIDDNLVANESIKEILNIYSSNTISLVNENNPIYVEGLSILNKPTTSQEVLSNYFKVLNNSYIRDSSEERLEYNKTYQLYNYVFSENPIYEIKQNNNIYLTINNTNNLNLQVSKFKLLSINPNKQYVQKLDEVIISVLDNMEKYIDISEDNRLQLIDNKNNAKKMIISNDIFISNCLIISYNGKYICLSMKDENHNWMICNNDMSKYLYLWSFK

SEQ ID NO: 5715 - protein, 1198 aa, Clostridium botulinum
MNINDNLSINSPVDNKNVVVVRARKTDTVFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKSFYASNIVIFGPGANIVENNTVFYKKEDAENGMGTMTEIWFQPFLTYKYDEFYIDPAIELIKCLIKSLYFLYGIKPSDDLVIPYRLRSELENIEYSQLNIVDLLVSGGIDPKFINTDPYWFIDNYFSNAKKVFEDHRNIYETEIEGNNAIGNDIKLRLKQKFRININDIWELNLNYFSKEFSIMMPDRFNNALKHFYRKQYYKIDYPENYSINGFVNGQINAQLSLSDRNQDIINKPEEIINLLNGNNVSLMRSNIYGDGLKSTVDDFYSNYKIPYNRAYEYHFNNSNDSSLDNVNIGVIDNIPEIIDVNPYKENCDKFSPVQKITSTREINTNIPWPINYLQAQNTNNEKFSLSSDFVEVVSSKDKSLVYSFLSNVMFYLDSIKDNSPIDTDKKYYLWLREIFRNYSFDITATQEINTDCGINKVVTWFGKALNILNTSDSFVEEFQNLGPISLINKKENLSMPKIEIDEIPNSMLNLSFKDLSENLFNIFSKNNSYFEKIYYDFLDQWWTQYYSQYFDLICMAKRSVLAQESLIKKIIQKKLSYLIGNSNISSDNLALMNLTTTNTLRDISNESQIAMNNVNNFLNNVAICVFQTNIYPKFISFMEQCINNINKNTREFIQKCTNITENEKLQLINQNIFSSLDFDFLNIENLKSLFNSETGLLIKEETSPYELVLYAFQEPGNNAIGDASGKNTSIEYSKDIGLVYGINSDALYLNGSNQSISFSNDFFENGLTNSFSIYFWLRNLGKDTIKSKLIGSKEDNCGWEIYFQDTGLVFNMIDSNGNEKNIYLSDVSNNSWHYITISVDRLKEQLLIFIDDNLVANESIKEILNIYSSNTISLVNENNPIYVEGLSILNRSITSEEVVNNYFTYLNNSYIRDISGERLEYNKTYELYNYVFPESSLYEVTENNNIYLSIKNTNNLNIQGAKFKLINIDANKQYVQKWDEGVVCLLGDEEKYVDISSENNRIQLVSSKDTAKRIIFNNDIFRPNCLTFAYNNKYLSLSLRDRNYNWMICNNNDNIPKAAHLWALKGI

SEQ ID NO: 5716 - protein, 1193 aa, Clostridium botulinum; identical to SEQ ID NO: 5710

SEQ ID NO: 5717 - protein, 146 aa, Clostridium botulinum
MSVERTFLPNGNYNIKSIFSGSLYLNPVSKSLTFSNESSANNQKWNVEYMAENRCFKISNVAEPNKYLSYDNFGFISLDSLSNRCYWFPIKIAVNTYIMLSLNKVNELDYAWDIYDTNENILSQPLLLLPNFDIYNSNQMFKLEKI

SEQ ID NO: 5718 - protein, 293 aa, Clostridium botulinum
MEHYSVIQNSLNDKIVTISCKADTNLFFYQVAGNVSLFQQTRNYLERWRLIYDSNKAAYKIKSMDIHNTNLVLTWNAPTHNISTQQDSNADNQYWLLLKDIGNNSFIIASYKNPNLVLYADTVARNLKLSTLNNSNYIKFIIEDYIISDLNNFTCKISPILDRNKVVQQVDMTNLNVNLYTWDYGRNQKWTIRYNEEKAAYQFFNTILSNGVLTWIFSNGNTVRVSSSNDQNNDAQYWLINPVSDTDETYTITNLRDTTKALDLYNSQTANGTAIQVFNYHGDDNQKWNIRNP

SEQ ID NO: 5719 - protein, 279 aa, Clostridium botulinum
MEHYSVIQNSLNDKIVTISCKADTNLFFYQVAGNVSLFQQTRNYLERWRLIYDSNKAAYKIKSMDIHNTNLVLTWNAPTHNISTQQDSNADNQYWLLLKDIGNNSFIIASYKNPNLVLYADTVARNLKLSTLNNSNYIKFIIEDYIISDLNNFTCKISPILDRNKVVQQVDMTNLNVNLYTWDYGRNQKWTIRYNEEKAAYQFFNTILSNGVLTWIFSNGNTVRVSSSNDQNNDAQYWLINPVSDTDETYTITNLRDTTKALDLYNSQTANGTAIQVFN

SEQ ID NO: 5720 - protein, 293 aa, Clostridium botulinum
MEHYSVIQNSLNDKIVTISCKADTNLFFYQVAGNVSLFQQTRNYLERWRLIYDSNKAAYKIKSMDIHNTNLVLTWNAPTHNISTQQDSNADNQYWLLLKDIGNNSFIIASYKNPNLVLYADTVARNLKLSTLNNSNYIKFIIEDYIISDLNNFTCKISPILDLNKVVQQVDVTNLNVNLYTWDYGRNQKWTIRYNEEKAAYQFFNTILSNGVLTWIFSNGNTVRVSSSNDQNNDAQYWLINPVSDTDETYTITNLRDTTKALDLYGGQTANGTAIQVFNYHGDDNQKWNIRNP

SEQ ID NO: 5721 - protein, 626 aa, Clostridium botulinum
MNSSIKKIYNDIQEKVINYSDTIDLADGNYVVRRGDGWILSRQNQILGGSVISNGSTGIVGDLRVNDNAIPYYYPTPSFNEEYIKNNIQTVFTNFTEANQIPIGFEFSKTAPSNKNLYMYLQYTYIRYEIIKVLQHEIIERAVLYVPSLGYVKSIEFNPGEKINKDFYFLTNDKCILNEQFLYKKILETTKNIPTNNIFNSKVSSTQRVLPYSNGLYVINKGDGYIRTNDKDLIGTLLIEAGSSGSIIQPRLRNTTRPLFTTSNDTKFSQQYTEERLKDAFNVQLFNTSTSLFKFVEEAPSDKNICIKAYNTYEKYELIDYQNGSIVNKAEYYLPSLGYCEVTNAPSPESEVVKMQVAEDGFIQNGPEEEIVVGVIDPSENIQEINTAISDNYTYNIPGIVNNNPFYILFTVNTTGIYKINAQNNLPSLKIYEAIGSGNRNFQSGNLCDDDIKAINYITGFDSPNAKSYLVVLLNKDKNYYIRVPQTSSNIENQIQFKREEGDLRNLMNSSVNIIDNLNSTGAHYYTRQSPDVHDYISYEFTIPGNFNNKDTSNIRLYTSYNQGIGTLFRVTETIDGYNLINIQQNLHLLNNTNSIRLLNGAIYILKVEVTELNNYNIRLHIDITN

SEQ ID NO: 5722 - protein, 626 aa, Clostridium botulinum
MNSSIKKIYNDIQEKVINYSDTIDLADGNYVVRRGDGWILSRQNQILGGSVISNGSTGIVGDLRVNDNAIPYYYPTPSFNEEYIKNNIQTVFTNFTEANQIPIGFEFSKTAPSNKNLYMYLQYTYIRYEIIKVLQHEIIERAVLYVPSLGYVKSIEFNPGEKINKDFYFLTNDKCILNEQFLYKKILETTKNIPTNNIFNSKVSSTQRVLPYSNGLYVINKGDGYIRTNDKDLIGTLLIEAGSSGSIIQPRLRNTTRPLFTTSNDTKFSQQYTEERLKDAFNVQLFNTSTSLFKFVEEAPSDKNICIKAYNTYEKYELIDYQNGSIVNKAEYYLPSLGYCEVTNAPSPESEVVKMQVAEDGFIQNGPEEEIVVGVIDPSENIQEINTAISDNYTYNIPGIVNNNPFYILFTVNTTGIYKINTQNNLPPLKIYEAIGSGNRNLQAGNLCNNNIKAINYITGVDDPNTKSYLVVLLNKDKNYYIRVPQTSPNIENQIKFKREEGDLRNLMNSSVNIIDNLNSTGAHYYTRQSPDVGNYISYEFTVPGNFNNKDTSNIRLYTSNNQGIGTLFRVIETIDGYKLIGIRQNLHLLNNTNSIRLLNGAIYILKVEVTELNNYNIRLHIDITN

SEQ ID NO: 5723 - protein, 1197 aa, Clostridium botulinum
MNINDNLSINSPVDNKNVVVVRARKTDTVFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKSFYASNIVIFGPGANIVENNTVFYKKEDAENGMGTMTEIWFQPFLTYKYDEFYIDPAIELIKCLIKSLYFLYGIKPSDDLVIPYRLRSELENIEYSQLNIVDLLVSGGIDPKFINTDPYWFTDNYFSNAKKVFEDHRNIYETQIEGNNAIGNDIKLRLKQKFRININDIWELNLNYFSKEFSIMMPDRFNNALKHFYRKQYYKIDYPENYSINGFVNGQINVQLSLSDRNQDIINKPEEIINLLNGNNVSLMRSNIYGDGLKSTVDDFYSNYKIPYNRAYEYHFNNSNDSSLDNVNIGVIDNIPEIIDVNPYKENCDKFSPVQKITSTREINTNIPWPINYLQAQNTNNEKFSLSSDFVEVVSSKDKSLVYSFLSNVMFYLDSIKDNSPIDTDKKYYLWLREIFRNYSFDITATQEINTDCGINKVVTWFGKALNILNTSDSFVEEFQNLGPISLINKKENLSMPIIEIYGIPNDMLGLPLNDLNEKLFNIYLKNILYFKKVYFNFLDQWWTEYYSQYFDLICMAKQSILAQEKLIKQIIQNKLQDLFKADISMDKLNLMNLATEKTFIDLSNESQIAINNINDFLNKSAICVFDTNIYPKFISFMEQCINSVNSNVTAFIQKCTNITEDEKLQLIKLNTFMNIDFEFFDIQSIKDLITSETDLIKEEKESDYNLFLFTLQEDNNKVIEDISGKNTLVKYSDSISLVYGVNGDALYLKEPDESVSFSNKAFENGLTNSFSICFWLRNLGEDIITSKLIENKADNCGWEIYFENNGLVFSIVDCNGNEENIYLSDVISKNWYYISISIDRLRNQLLIFINDKLIANQSIEQILNIYSSNTISLVNENNPIYIEGLSILNRSITSEEVVNNYFSYLNNSYIRDISGERLEYNKTYELYNYVFPENSLYEVTENNNIYLSIKDTNNLNIQGAKFKLINIDANKQYVQKWDEGVVCLLGDEEKYVDISSENNRIQLVNSKDTAKRIIFNNDIFMPNCLTFAYNNKYLSLSLRDRNYNWMICNNNDNIPKAAHLWALKGI

SEQ ID NO: 5724 - protein, 1197 aa, Clostridium botulinum
MNINDNLSINSPVDNKNVVVVRARKTDTIFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKNFYASNIVIFGPGSNIVENNTVFYKKEDAENGMGTMTEIWFQPFLTYKYDQFYIDPAIELMKCLIKSLYFLYGIKPSDDLVVPYRLRNELENIEYSQLNIVDLLVSGGIDPKFINTDPYWFIDNYFSNAKKVFEDHRNIYKTEVEGNNAIGNDIKLRLKQKFRINTNDIWELNLNYFSKEFSIMMPDRFNNALKHFYRKQYYKIDYPENYSINGFVNGQINAQLFLSDRNQDIINKPEEIINLLNGNNVSLMRSNIYGDGLKSTVDDFYSNYKIPYNRAYEYHFNNSNDSSLDNVNTGVIDNIPEIIDVNPYKENCDKFSPVQKITSTREINTNIPWPINYLQAQNTNNERFSLSSDFVEVVSSKDKSLVYSFLSNVMFYLDSIKDNSPIDTDKEYYLWLREIFRNYSFDITATQEINTNCGINKVVAWFGKALNILNTSDSFVEEFQNLGPSSLINKKENLSMPIIEIDEIPNYMLGLPLNDLNEKLFNIYLKNILYFKKVYFNFLDQWWTEYYSQYFDLICMAKQSILAQEKLIKQIIQNKLQDLSKADISMDKLNLMNLATGKTFIDLSNESQIAIDNINDFLNKSAICFFDTNIYPKFISFMEQCINSVNSNVTTFIQKCTNITEDEKLQLIKLNTFMNIDFEFFDIQNIKDLITSETDLIKEEKESDYNLFLLTLQEDNNKVIEDISGKNTLVKYSDSISLVYGVNGDALYLKEPNESVSFSNKVFENGLTNSFSICFWLRNLGEDIITSKLIENKADNCGWEIYFENNGLVFSIVDCNGNEENIYLSDVISKNWYYISISIDRLRNQLLIFINDKLIANQSIEQILNIYSSSTISLVNENNPIYVEGLSILNRSITSEEVVNNYFSYLNNSYIRDISGERLEYNKIYELYNYVFPENSLYEVTENNNIYLSIKDTNDLNIQGAKFKLINIDTNKQYVQKWDEGVVCLLGDEEKYVDISSENNRIQLVSSRDTAKKIIFNNDIFKPNCLTFAYNNKYLSLSFRDRNYNWMIYNNNDNIPKAAHLWTLKGI

SEQ ID NO: 5725 - protein, 1197 aa, Clostridium botulinum
MNINDNLSINSPVDNKNVVVVRARKTDTVFKAFKVAPNIWVAPERYYGESLSIDEEYKVDGGIYDSNFLSQDSEKDKFLQAIITLLKRINSTNAGEKLLSLISTAIPFPYGYIGGGYYAPNMITFGSAPKSNKKLNSLISSTIPFPYAGYRETNYLSSEDNKSFYASNIVIFGPGANIVENNTVFYKKEDAENGMGTMTEIWFQPFLTYKYDEFYIDPAIELIKCLIKSLYFLYGIKPSDDLVIPYRLRSELENIEYSQLNIVDLLVSGGIDPKFINTDPYWFTDNYFSNAKKVFEDHRNIYETEIEGNNAIGNDIKLRLKQKFRININDIWELNLNYFSKEFSIMMPDRFNNALKHFYRRQYYKIDYPENYSINGFVNGQINAQLSLSDRNQDIINKPEEIINLLNGNNVSLMRSNIYGDGLKSTVDDFYSNYKIPYNRAYEYHFNNSNDSSLDNVNIGVIDNIPEIIDVNPYKENCDKFSPVQKITSTREINTNIPWPINYLQAQNTNNEKFSLSSDFVEVVSSKDKSLVYSFLSNVMFYLDSIKDNSPIDTDKKYYLWLREIFRNYSFDITATQEINTDCGINKVVTWFGKALNILNTSDSFVEEFQNLGPISLINKKENLSMPIIEIYGIPNDMLGLPLNDLNEKLFNIYLKNILYFKKVYFNFLDQWWTEYYSQYFDLICMAKQSILAQEKLIKQIIQNKLQDLFKADISMDKLNLMNLATEKTFIDLSNESQIAINNINDFLNKSAICVFDTNICPKFISFMEQCINSVNSNVTAFMQKCTNITEDEKLQLIKLNTFMNIDFEFFDIQSIKDLITSETDLIKEEKESDYNLFLFTLQEDNNKVIEDISGKNTLVKYSDSISLVYGVNGDALYLKEPDESVSFSNKAFENGLTNSFSICFWLRNLGEDIITSKLIENKADNCGWEIYFENNGLVFSIVDCNGNEENIYLSDVISKNWYYISISIDRLRNQLLIFINDKLIANQSIEQILNIYSSNTISLVNENNPIYIEGLSILNRSITSEEVVNNYFSYLNNSYIRDISGERLEYNKTYELYNYVFPENSLYEVTENNNIYLSIKDTNNLNIQGAKFKLINIDANKQYVQKWDEGVVCLLGDEEKYVDISSENNRIQLVSSKDTAKRIIFNNDIFRPNCLTFAYNNKYLSLSLRDRNYNWMICNNNNNIPKAAHLWALKGI

SEQ ID NO: 5726 - protein, 1197 aa, Clostridium botulinum; identical to SEQ ID NO: 5723

SEQ ID NO: 5727 - protein, 1162 aa, Clostridium botulinum
MKINNNFNINSLVDNRDVAIVRGRKTDALFKVFQVAPNIWIAPERYYGESLNINEDQKSDGGIYDSSFLSTDNEKDEFLQATVKILQRINNNVIGAKLLSLISTAISFPYEYKPGDYRQTNYLTSKYNEHYYTANLVIFGPGSNIIKNNVVYYKKEYAENGMGTMSEIWFQPFLTYKYDQFYVDPALELIKCLIKSLYYLYGIKPSDDLSIPYRLRSELNNSEYSQLDIVDFLISGGTDYKLLNTNPYWITDNYFSDAPKNFEKYKNDYETKIKNNNDIANSIKLYLEQKFKINAQNIWELNLSYFSKEFQIMMPERYNNALNHYYKKEYYGIDYFRNYNINGFEKGQIKTNLPLSKYNKCIINKPELIVNLINQNNTVWMKSNIYGDGLKCTIDNFYSSYKIPYNANYEHPINYSYLDNVNIEEIDKIPPINDADIYPYRKNADTFIPVYNIIKSKEVNTTTPLPVNYLQVQITDSNDINLSSDFLEVISSKGSSVYSFLNNTMDYLESIKYDKPIDTDKKYYKWLKAIFRNYSFDITETQEISNQFGVTKIVPWIGRALNILNTNNSFMEEFKNLGPISLINKKENITMPKIEIDEIPNSMLNLSFKDLSENLFNISFKSNSYFKKIYYDFLDQWWTQYYSQYFDLICMAKKSILAQEKLIKKIIRKKLSYLIGNANISSDNLALMNLTTTNTLRDISNESQIAMNNVDSFLNDAAICVFESNIYPKFISFMEQCINNINKDTKEFIQKCTNITENEKLQLISPNIFSSLDFDFLNIENLKSLLSSETALLIKEETSPYELVLYAFQELSNNVIGDASGKNTSIEYSKDIGLVYGINSDALYLNGSNQSISFSNDFFENGLTNSFSIHFWLRNLGQDTTKSKLIGSKEDNCGWEIYFQNTGLVFNMIDSNGDEKNIYLSDVSNNSWHYITISVDRLKEQLLIFIDDNLVVNESIKEILNIYSSNIISLLSDNNASYIEGLTILNKPTTGEEVLSNYFKNLNNSYIRDSNEERLEYNKTYQLYNYVFSDKPICEVKQNNNIYLTINNTNNLNLQASKFKLLSINPNKQYVQKFDEVIISVLDNMEKYIDISEDNRLQLIDNKNSAKKMIISNDIFISNCLTLSYGDKYVCLSMKDENYNWMICNNESNIPKKAYLWILKEV

SEQ ID NO: 5728 - protein, 304 aa, Clostridium botulinum
EYYHLIYKEVNYMSVERTFLPDGNYNIKSIFSGSLYLNPVSGSLTFSSESSANNQKWNVEYMAKNRCFKISNVAEPNKYLSYDNFGFISLDSLSNKCYWFPIKIAVNTYIMLNLNKVNELDYAWDIYDTNENILSQPLLLLPNFDIYNSNQMLKLEKIMSVERTFLPNGNYNIKSIFSGSLYLNPVSKSLTFSNESSANNQKWNVEYMAENRCFKISNVAEPNKYLSYDNFGFISLDSLSNRCYWFPIKIAVNTYIMLSLNKVNELDYAWDIYDTNENILSQPLLLLPNFDIYNSNQMFKLEKI

SEQ ID NO: 5729 - protein, 293 aa, Clostridium botulinum
MEHYSVIQNSLNDKIVTISCRADTNLFFYQVAGNVSLFQQTRNYLERWRIIYDSNKAAYKIKSMDIHNTNLVLTWNAPTHNISTQQDSNADNQYWLLLKDIGNNSFIIASYKNPNLVLYADTVARNLKLSTLNNSNYIKFIIEDYIISDFNNFTCKISPILDRNKVVQQVATTNLNVNLYTWDYGRNQKWTIRYNEEKAAYQFFNTILSNGVLTWIFSNGNTVRVSSSNDQNNDAQYWLINPVSDTDETYTITNLRDTTKALDLYNSQTANGTAIQVFNSNGGDNQKWNIRNP

SEQ ID NO: 5730 - protein, 292 aa, Clostridium botulinum
MEHYSVIQNSLNDEIVTISCKADTNLFFYQTVGNVSLFQQTRNYLERWRLIYDANKAAYKIKSMDSHNTNLVLTWNAPTHNISAQQDSNADNQYWLLLKDIGSNSFIIASYKNPNLVLYADTVARNLKLSTLNNSSYIKFIIEDYMISDFNNFTCKISPILDSSKVVQQVAMTDLSVNLYTWDYGRNQKWTIKYNKEKSAYQFFNTILSNGVLTWISSNGNTVRVSSIAQNNDAQYWLINPVSNAYETYTITNLHDTTKALDLYNSQTANGTTIQVFNYHGDDNQKWFIRNP

SEQ ID NO: 5731 - protein, 294 aa, Clostridium botulinum
MEHYSTIQNSLNDKIVTISCKANTDLFFYQVPGNGNVSLFQQTRNYLERWRIIYDSNKAAYKIKSMNIYNTNLVLTWNAPTHNISAQQDSNADNQYWLLLKDIGNNSFIIASYKNPNLVLYADTVARNLKLSTLNNSSYIKFIIEDYVISDFKNFTCRISPILAGGKVVQQVSMTNLAVNLYIWNNDLNQKWTIIYNEEKAAYQFFNKILSNGVLTWIFSDGNTVRVSSSAQNNDAQYWLINPVSDNYDRYTITNLRDKTKVLDLYGGQTADGTTIQVFNSNGGDNQIWTMSNP

SEQ ID NO: 5732 - protein, 442 aa, Clostridium botulinum
MNSSIKKIYNHIQEKVINYSDTIDLADGNYVVSRGDGWILSRQNQILGGSVISNGSTGIVGDLRVNDNAIPYYYPTPSFNEEYIKNNIQTVFTNFTEANQIPIGFEFSKTAPSNKNLYMYLQYTYIRYEIIKVLQHEIIERAVLYVPSLGYVKSIEFNLGEKINKDFYFLTNDKCILNEQFLYKKILETTKNIPTNNIFNSKVSSTQRVLPYSNGLYVINKGDGYIRTNDKDLIGTLLIEAGSSGSIIQPRLRNTTRPLFTTSNNTKFSQQYTEERLKDAFNVQLFNTSTSLFKFVEEAPSNKNICIKAYNTYEKYELIDYQNGSIINTAEYYLPSLGYCEVTNAPSPESEVVKTQVAEDGFVQNGPEEEIVVGVIDPSENIQEINTAISDNYTYSIPDIVDNNPFYILFTVNTTGIYKINAQNNLPPLKIYEAIGSSNKNM

SEQ ID NO: 5733 - protein, 442 aa, Clostridium botulinum
MNSSIKKIYNDIQEKVINYSDTIDLADGNYVVRRGDGWILSRQNQILGGSVISNGSTGIVGDLRVNDNAIPYYYPTPSFNEEYIKNNIQTVFTNFTEANQIPIGYEFSKTAPSNKNLYMYLQYTYIRYEIIKVLQHEIIERAVLYVPSLGYVKSIEFNPGEKINKDFYFLTNDKCILNEQFLYKKILETTKNIPTNNIFNSKVSSTQRVLPYSNGLYVINKGDGYIRTNDKDLIGTLLIEAGSSGSIIQPRLRNTTRPLFTTSNDTKFSQQYTEERLKDAFNVQLFNTSTSLFKFVEEAPSDKNICIKAYNTYEKYELIDYQNGSIVNKAEYYLPSLGYCEVTNAPSPESEVVKMQVAEDGFIQNGPEEEIVVGVIDPSENIQEINTAISDNYIYSIPGIVNNNPFYILFTVNTTGIYKINAQNNLPPLKIYEAIGSGNRNM

SEQ ID NO: 5734 - protein, 1196 aa, Clostridium botulinum
MDINDDLNINSPVDNKNVVIVRARKTNTFFKAFKVAPNIWVAPERYYGEPLDIAEEYKLDGGIYDSNFLSQDSERENFLQAIIILLKRINNTISGKQLLSLISTAIPFPYGYIGGGYSSPNIFTFGKTPKSNKKLNSLVTSTIPFPFGGYRETNYIESQNNKNFYASNIVIFGPGSNIVENNVIYYKKNDAENGMGTMAEIVFQPLLTYKYNKFYIDPAMELTKCLIKSLYFLYGIKPSDNLVVPYRLRTELDNKQFSQLNIIDLLISGGVDLEFINTNPYWFTNSYFPNSIKMFEKYKNIYKTEIEGNNAIGNDIKLRLKQKFQINVQDIWNLNLNYFCQSFNSIIPDRFSNALKHFYRKQYYTMDYTDNYNINGFVNGQINTKLPLSNKNTNIISKPEKVVNLVNENNISLMKSNIYGDGLKGTTEDFYSTYKIPYNEEYEYRFNDSDNFPLNNISIEEVDSIPEIIDINPYKDNSDNLVFTQITSMTEEVTTHTALSINYLQAQITNNENFTLSSDFSKVVSSKDKSLVYSFLDNLMSYLETIKNDGPIDTDKKYYLWLKEVFKNYSFDINLTQEIDSMCGINEVVLWFGKALNILNTSNSFVEEYQDSGAISLISKKDNLREPNIEIDDISDSLLGLSFKDLNNKLYEIYSKNIVYFKKIYFSFLDQWWTEYYSQYFELICMAKQSILAQESLVKQIVQNKFTDLSKASIPPDTLKLIRETTEKTFIDLSNESQISMNRVDNFLNKASICVFVEDIYPKFISYMEKYINNINIKTREFIQRCTNINDNEKSILINSYTFKTIDFKFLDIQSIKNFFNSQVEQVMKEILSPYQLLLFASKGPNSNIIEDISGKNTLIQYTESIELVYGVNGESLYLKSPNETIKFSNKFFTNGLTNNFTICFWLRFTGKNDDKTRLIGNKVNNCGWEIYFEDNGLVFEIIDSNGNQESVYLSNIINDNWYYISISVDRLKDQLLIFINDKNVANVSIDQILSIYSTNIISLVNKNNSIYVEELSVLDNPITSEEVIRNYFSYLDNSYIRDSSKSLLEYNKNYQLYNYVFPETSLYEVNDNNKSYLSLKNTDGINISSVKFKLINIDESKVYVQKWDECIICVLDGTEKYLDISPENNRIQLVSSKDNAKKITVNTDLFRPDCITFSYNDKYFSLSLRDGDYNWMICNDNNKVPKGAHLWILES

SEQ ID NO: 5735 - protein, 1196 aa, Clostridium botulinum
MDINDDLNINSPVDNKNVVIVRARKTNTFFKAFKVAPNIWIAPERYYGEPLDIAEEYKLDGGIYDSNFLSQDSERENFLQAIITLLKRINNTISGKQLLSLISTAIPFPYGYVGGGYSSPNIFTFGKTPKSNKKLNSLVTSTIPFPFGGYRETNYIESPNNKDFYASNIVIFGPGSNIVENNVICYKKNDAENGMGTMAEILFQPLLTYKYNKFYIDPAMELTKCLIKSLYFLYGIKPSDGLVVPYRLRTELDNKQFSQLNIIDLLISGGVDLEFINTNPYWFTNSYFSNSIKMFEKYKNIYETEIEGNNAIGNDIKLRLRQKFQNSVQDIWNLNLNYFSKEFNSIIPDRFSNALKHFYRKQYYTMDYTDNYNINGFVNGQINTKLPLSDKNTNIISKPEKVVNLVNENNISLMKSNIYGDGLKGTTEDFYSTYKIPYNEEYEYRFNDSDNFPLNNISIEEVDSIPEIIDINPYKDNSDNLVFTQITSMTEEVTTHTALPINYLQAQITTNENFTLSSDFSKVVSSKDKSLVYSFLDNLMSYLETIKNDGPIDTDKKYYLWLKEVFKNYSFDINLTQEIDSSCGINEVVIWFGKALNILNTSNSFVEEYQNSGPISLISKKDNLSEPNIEIDDIPDSLLGLSFKDLNNKLYEIYSKNIVYFKKIYFNFLDQWWTEYYSQYFELICMAKQSILAQESLVKQIIQNKFTDLSKASIPPDTLKLIKETTEKTFIDLSKESQISMNRVDNFLNKASICVFVEDIYPKFISYMEKYINNINIKTREFIQRCTNINDNEKSILINSYTFKTIDFKFLDIQGIKNFFNSQVEQVMKEMLSPYQLLLFATRGPNSNIIEDISGKNTLIQYTESVELVYGVNGESLYLKSPNETVEFSNNFFTNGLTNNFTICFWLRFTGKDDDKTRLIGNKVNNCGWEIYFEDNGLVFEIIDSNGNQESVYLSNVINNNWYYISISVDRSKDQLLIFINDKNVANVSIEQILNIYSTNVISLVNKNNSIYVEELSVLDKTVTSEEVIRNYFSYLDNSYIRDSSKSLLEYNKNYQLYNYVFPKTSLYEVNDNNKSYLSLKNTDGINIPSVKFKLINIDESKGYVQKWDECIICVSDGTEKYLDISSENNRIQLVSSKDNAKKITVNTDLFRPDCITFSYNDKYFSLSLRDGDYNWMICNDNNKVPKGAHLWILES

SEQ ID NO: 5736 - protein, 146 aa, Clostridium botulinum
MSSERTFLPNGNYKIKSLFSDSLYLTYSSGALSFSNTSSLDNQKWKLEYISSSNGFRFSNVAEPNKYLAYNDYGFIYLSSSSNNSLWNPIKIAINSYIICTLSIVNVTDYAWTIYDNNNNITDQPILNLPNFDINNSNQILKLEKL

SEQ ID NO: 5737 - protein, 146 aa, Clostridium botulinum
MSSERTFLPNGNYKIKSLFSNSLYLTYSSGALSFSNTSSLDNQKWKLEYISSSNGFRFSNVAESNKYLAYNDYGFIYLSSSSNNSLWNPIKIAINSYIICTLSIVNVTDYAWTIYDNNNNITDQPILNLPNFDINNSNQILKLEKL

SEQ ID NO: 5738 - protein, 286 aa, Clostridium botulinum
MSQTNANDLRNNEVFFISPSNNTNKVLDKISQSEVKLWNKLSGANQKWRLIYDTNKQAYKIKVMDNTSLILTWNAPLSSVSVKTDTNGDNQYWYLLQNYISRNVIIRNYMNPNLVLQYNIDDTLMVSTQTSSSNQFFKFSNCIYEALNNRNCKLQTQLNSDRFLSKNLNSQIIVLWQWFDSSRQKWIIEYNETKSAYTLKCQENNRYLTWIQNSNNYVETYQSTDSLIQYWNINYLDNDASKYILYNLQDTNRVLDVYNSQIANGTHVIVDSYHGNTNQQWIINLI

SEQ ID NO: 5739 - protein, 285 aa, Clostridium botulinum
MSQTNANDLRNNEVFFISPSNNTNKVLDKISQSEVKLWNKLSGANQKWRLIYDTNKQAYKIKVMDNTSLILTWNAPLSSVSVKTDTNGDNQYWYLLQNYISRNVIIRNYMNPNLVLQYNIDDTLMVSTQTSSSNQFFKFSNCIYESFNNSTCKIQTSLTIKFIDKNQNSNNVTIWSWNNGDNQKWKILYNESKMAYTLTCIKNNEYLTWFSSIGNNVGTYRTEGNNDQYWFINYLNNDASMYTISNFSNQSKFLDVVNSGLADGTNVQVWDSNGTSAQKWIITRL

SEQ ID NO: 5740 - protein, 286 aa, Clostridium botulinum
MSQTNANDLRNNEVFFISPSNSTNKVLDKISQSEVKLWSKNLGSNQKWRLIYDTNKQAYKIKVMDNTSLILTWDAPLSSVSVKTDTNTNNQYWYLLQDYISRNVILRNYMNPNLVLQYNTDDTLIVSTQTSSNNQFFKFSNCIYEALNNRNCKLQTQLNSDRFLSKNLNSQIIVLWQWFDSSRQKWLIEYNETKSAYTLKCQENNRYLTWIQNSNNYVETYQSTDSLIQYWNINYLDNDASKYILYNLQDTNRVLDVYNSQIANGTNVIVDSYHGNTNQQWIINLI

SEQ ID NO: 5741 - protein, 623 aa, Clostridium botulinum
MSLSIKELYYTKDKSINNVNLADGNYVVNRGDGWILSRQNQNLGGNISNNGCTAIVGDLRIRETATPYYYPTASFNEEYIKNNVQNVFANFTEASEIPIGFEFSKTAPSNKSLYMYLQYTYIRYEIIKVLQNTVTERAVLYVPSLGYVKSIEFNSEEQIDKNFYFTSQDKCILNEKFIYKKIDDTITVKESKNSNNNINFNTSQTILPYPNGLYVINKGDGYMRTNDKDLIGTLLIESSTSGSIIQPRLRNTTRPLFNTSNPTIFSQEYTEARLNDAFNIQLFNTSTTLFKFVEEAPTNKNISMKVYNTYEKYELINYQNGNIDDKAEYYLPSLGKCEVSDAPSPQAPVVETPVDQDGFIQTGPNENIIVGVINPSENIEEISTPIPDDYTYNIPTSIQNNACYVLFKVNTTGVYKITTKNNLPPLIIYEAIGSSNRNMNSNNLSNDNIKAIKYITGLNRSDAKSYLIVSLFKDKNYYIRIPQISSSTTSQLIFKRELGNISDLADSTVNILDNLNTSGTHYYTRQSPDVGNYISYQLTIPGDFNNIASSIFSFRTRNNQGIGTLYRLTESINGYNLITINNYSDLLNNVEPISLLNGATYIFRVKVTELNNYNIIFDAYRNS

SEQ ID NO: 5742 - protein, 623 aa, Clostridium botulinum
MSLSIKELYYAKDKSINNVNLADGNYVVNRGDGWILSRQNQNLGGNISNNGCTAIVGDLRIRETATPYYYPTASFNEEYIRNNVQNVFANFTEASEIPIGFEFSKTAPSNKSLYMYLQYTYIRYEIIKVLQNTVIERAVLYVPSLGYVKSIEFNSGEQIDKNFYFTSEDKCILNEKFIYKKIAETTTAKESNDSNNTTNLNTSQTILPYPNGLYVINKGDGYMRTNDKDLIGTLLIETNTSGSIIQPRLRNTTRPLFNTSNPTLFSQEYTEARLNDAFNIQLFNTSTALFKFVEEAPDNKNISMKAYNTYEKYELINYQDGNIADKAEYYLPSLGKCEVSDAPSPQAPVVETPVDQDGFIQTGPNENIIVGVINPSENIEEISTPIPDDYTYNIPTSIQNNACYVLFTVNTTGVYKINAQNNLPPLIIYESIGSDNMNIQSNTLSNNNIKAINYITGTDSANAESYLIVSLIKNKNYYIRIPQISSSTTNQLIFKRELGNISDLANSTVNILDNLNTSGTHYYTRQSPDVGNYISYQLTIPGDFNNIASSIFSFRTRNNQGIGTLYRLTESINGYNLITIKNYSDLLNNVEPISLLNGATYIFRVKVTELNNYNIIFDAYRNS

SEQ ID NO: 5743 - protein, 1196 aa, Clostridium botulinum
MDINDDLNINSPVDNKNVVIVRARKTNTFFKAFKVAPNIWVAPERYYGEPLDIAEEYKLDGGIYDSNFLSQDSERENFLQAIIILLKRINNTISGKQLLSLISTAIPFPYGYIGGGYSSPNIFTFGKTPKSNKKLNSLVTSTIPFPFGGYRETNYIESQNNKNFYASNIVIFGPGSNIVENNVIYYKKNDAENGMGTMAEIVFQPLLTYKYNKFYIDPAMELTKCLIKSLYFLYGIKPSDNLVVPYRLRTELDNKQFSQLNIIDLLISGGVDLEFINTNPYWFTNSYFPNSIKMFEKYKNIYKTEIEGNNAIGNDIKLRLKQKFQINVQDIWNLNLNYFCQSFNSIIPDRFSNALKHFYRKQYYTMDYTDNYNINGFVNGQINTKLPLSNKNTNIISKPEKVVNLVNENNISLMKSNIYGDGLKGSTEDFYSTYKIPYNEEYEYRFNDSDNFPLNNISIEEVDSIPEIIDINPYKDNSDNLVFTQITSMTEEVTTHTALSINYLQAQITNNENFTLSSDFSKVVSSKDKSLVYSFLDNLMSYLETIKNDGPIDTDKKYYLWLKEVFKNYSFDINLTQEIDSMCGINEVVLWFGKALNILNTSNSFVEEYQDSGAISLISKKDNLREPNIEIDDISDSLLGLSFKDLNNKLYEIYSKNIVYFKKIYFSFLDQWWTEYYSQYFELICMAKQSILAQESLVKQIVQNKFTDLSKASIPPDTLKLIRETTEKTFIDLSNESQISMNRVDNFLNKASICVFVEDIYPKFISYMEKYINNINIKTREFIQRCTNINDNEKSILINSYTFKTIDFKFLDIQSIKNFFNSQVEQVMKEILSPYQLLLFASKGPNSNIIEDISGKNTLIQYTESIELVYGVNGESLYLKSPNETIKFSNKFFTNGLTNNFTICFWLRFTGKNDDKTRLIGNKVNNCGWEIYFEDNGLVFEIIDSNGNQESVYLSNIINDNWYYISISVDRLKDQLLIFINDKNVANVSIDQILSIYSTNIISLVNKNNSIYVEELSVLDNPITSEEVIRNYFSYLDNSYIRDSSKSLLEYNKNYQLYNYVFPETSLYEVNDNNKSYLSLKNTDGINISSVKFKLINIDESKGYVQKWDECIICVLDGTEKYLDISPENNRIQLVSSKDNAKKITVNTDLFRPDCITFSYNDKYFSLSLRDGDYNWMICNDNNKVPKGAHLWILES

SEQ ID NO: 5744 - protein, 1196 aa, Clostridium botulinum
MDINDDLNINSPVDNKNVVIVRARKTNTFFKAFKVAPNIWVAPERYYGEPLDIAEEYKLDGGIYDSNFLSQDSERENFLQAIITLLKRINNTISGKQLLSLISTAIPFPYGYVGGGYSSPNIFTFGKTPKSNKKLNSLVTSTIPFPFGGYRETNYIESQNNKNFYASNIVIFGPGSNIVENNVICYKKNDAENGMGTMAEILFQPLLTYKYNKFYIDPAMELTKCLIKSLYFLYGIKPSDDLVVPYRLRTELDNKQFSQLNIIDLLISGGVDLEFINTNPYWFTNSYFSNSIKMFEKYKNIYETEIEGNNAIGNDIKLRLKQKFQNSVQDIWNLNLNYFSKEFNSIIPDRFSNALKHFYRKQYYTMDYGDNYNINGFVNGQINTKLPLSDKNTNIISKPEKVVNLVNANNISLMKSNIYGDGLKGTTEDFYSTYKIPYNEEYEYRFNDSDNFPLNNISIEEVDSIPEIIDINPYKDNSDDLLFTQITSTTEEVITHTALPVNYLQAQIITNENFTLSSDFSKVVSSKDKSLVYSFLDNLMSYLETIKNDGPIDTDKKYYLWLKEVFKNYSFDINLTQEIDSSCGINEVVIWFGKALNILNTSNSFVEEYQNSGPISLISKKDNLSEPNIEIDDIPDSLLGLSFKDLNNKLYEIYSKNRVYFRKIYFNFLDQWWTEYYSQYFELICMAKQSILAQESVVKQIIQNKFTDLSKASIPPDTLKLIKETTEKTFIDLSNESQISMNRVDNFLNKASICVFVEDIYPKFISYMEKYINNINIKTREFIQRCTNINDNEKSILINSYTFKTIDFKFLNIQAIKNFFNSQVEQVMKEMLSPYQLLLFATRGPNSNIIEDISGKNTLIQYTESVELVYGVNGESLYLKSPNETVEFSNNFFTNGLTNNFTICFWLRFTGKDDDKTRLIGNKVNNCGWEIYFEDNGLVFEIIDSNGNQESVYLSNVINNNWYYISISVDRLKDQLLIFINDKNVANVSIEQILNIYSTNVISLVNKNNSIYVEELSVLDKPVASEEVIRNYFSYLDNSYIRDSSKSLLEYNKNYQLYNYVFPETSLYEVNDNNKSYLSLKNTDGINIPSVKFKLINIDESKGYVQKWDECIICVSDGTEKYLDISPENNRIQLVSSKDNAKKITVNTDLFRPDCITFSYNDKYFSLSLRDGDYNWMICNDNNKVPKGAHLWILKS

SEQ ID NO: 5745 - protein, 146 aa, Clostridium botulinum
MSSERTFLPNGNYKIKSLFSDSLYLTYSSGSLSFLNTSSLDNQKWKLEYISSSNGFRFSNVAEPNKYLAYNDYGFIYLSSSSNNSLWNPIKIAINSYIICTLSIVNVTDYAWTIYDNNNNITDQPILNLPNFDINNSNQILKLEKL

SEQ ID NO: 5746 - protein, 286 aa, Clostridium botulinum
MSQTNANDLRNNEVFFISPSNNTNKVLDKISQSEVKLWNKLSGANQKWRLIYDTNKQAYTIKVMDNTSLILTWDAPLSSVSVKTDTNTNNQYWYLLQDYISRNVILRNYMNPNLVLQYNTDDTLIVSTQTNSNNQFFKFSNCIYEALNNRNCKLQTQLNSDRFLSKNLNSQIIVLWQWFDSSRQKWTIEYNETKSAYTLKCQENNRYLTWIQNSNNYVETYQSTDSLIQYWNINYLDNDASKYILYNLQDTNRVLDVYNSQTANGTHVIVDSYHGNTNQQWIINLI

SEQ ID NO: 5747 - protein, 291 aa, Clostridium botulinum
MGGNNMSQTNANDLRNNEVFFISPSNNTNKVLDKISQSEVKLWNKLSGANQKWRLIYDTNKQAYKIKVMDNTSLILTWNAPLSSVSVKTDTNGDNQYWYLLQNYISRNVIIRNYMNPNLVLQYNIDDTLMVSTQTSSSNQFFKFSNCIYEALNNRNCKLQTQLNSDRFLSKNLNSQIIVLWQWFDSSRQKWIIEYNETKSAYTLKCQENNRYLTWIQNSNNYVETYQSTDSLIQYWNINYLDNDASKYILYNLQDTNRVLDVYNSQIANGTHVIVDSYHGNTNQQWIINLI

SEQ ID NO: 5748 - protein, 623 aa, Clostridium botulinum
MSLSIKELYYTKDKSINNVNLADGNYVVNRGDGWILSRQNQNLGGNISNNGCTAIVGDLRIRETATPYYYPTASFNEEYIRNNVQNVFANFTEASEIPIGFEFSKTAPSNKGLYMYLQYTYIRYEIIKVLRNTVIERAVLYVPSLGYAKSIEFNSGEQIDKNFYFTSEDKCILNEKFIYKKIAETTTAKESNDSNNTTNLNTSQTILPYPNGLYVINKGDGYMRTNDKDLIGTLLIETNTSGSIIQPRLRNTTRPLFNTSNPTLFSQEYTEARLNDAFNIQLFNTSTTLFKFVEEAPDNKNISMKAYNTYEKYELINYQNGNIADKAEYYLPSLGKCEVSDAPSPQAPVVETPVEQDGFIQTGPNENIIVGVINPSENIEEISTPIPDDYTYNIPTSIQNNACYVLFTVNTTGVYKINAQNNLPPLIIYESIGSDNMNIQSNTLSNNNIKAINYITGTDSSNAESYLIVSLIKNKNYYIRIPQISSSTTNQLIFKRELGNISDLANSTVNILDNLNTSGTHYYTRQSPDVGNYISYQLTIPGDFNNIASSIFSFRTRNNQGIGTLYRLTESINGYNLITIKNYSDLLNNVEPISLLNGATYIFRVKVTELNNYNIIFDAYRNS

SEQ ID NO: 5749 - protein, 1163 aa, Clostridium botulinum
MKINGNLNIDSPVDNKNVAIVRSRKSDVFFKAFQVAPNIWIAPERYYGESLKINEDQKSDGGIYDSNFLSTNNEKDEFLQATIKLLQRINNNVVGAKLLSLISTAIPFPYENNTEDYRQTNYLSSKNNEHYYTANLVIFGPGSNIIKNNVIYYKKEYAENGMGTMLEIWFQPFLTHKYDEFYVDPALELIKCLIKSLYYLYGIKPNDNLNIPYRLRNEFNSLEYSELDMIDFLISGGIDYKLLNTNPYWFIDKYFIDTSKNFEKYKNDYEIKIKNNNYIANSIKLYLEQKFKINVKDIWELNLSYFSKEFQIMMPERYNNALNHYYRKEYYVIDYFKNYNINGFKNGQIKTKLPLSKYNKEIINKPELIVNLINQNNTVLMKSNIYGDGLKGTVDNFYSNYIIPYNLNYEHSINYSYLDNVNIEEIEKIPPINDEDIYPYRKNADTFIPVYNITKAKEINTTTPLPVNYLQAQMIDSNDINLSSDFLKVISSKGSLVYSFLNNTMDYLEFIKYDKPIDTDKKYYKWLKAIFRNYSLDITETQEISNQFGDTKIIPWIGRALNILNTNNSFVEEFKNLGPISLINKKENITIPKIKIDEIPSSMLNFSFKDLSENLFNIYCKNNFYLKKIYYNFLDQWWTQYYSQYFDLICMASKSVLAQEKLIKKLIQKQLRYLMENSNISSTNLILINLTTTNTLRDISNQSQIAINNIDKFFNNAAMCVFENNIYPKFTSFMEQCIKNINKSTKEFILKCTNINETEKSHLIMQNSFSNLDFDFLDIQNMKKLFNSYTELLIKEQTSPYELSLYAFQEQDNNVIGDTSGKNTLVEYPKDIGLVYGINNNAIHLTGANQNIKFTNDYFENGLTNNFSIYFWLRNLNQNTIKSKLIGSKEDNCGWEIYFENNGLVFNIIDSNGNEKNIYLSNISNKSWHYIVISINRLKDQLLIFIDNILVANEDIKEILNIYSSDIISLLSDNNNVYIEGLSVLNKTINSNEILTDYFSDLNNSYIRNFDEEILQYNRTYELFNYVFPEIAINKIEQNNNIYLSNNNENSLNFKPLKFKLLNTNPNKQYVQKWDEVIFSVLDGTEKYLDISIDNNRIQLVDNKNNAKTFIINNDIFISNCLTLTYNNVNVYLSIKNQDYNWVICDLNHDIPKKSYLWILKNI

SEQ ID NO: 5750 - protein, 1165 aa, Clostridium botulinum
MKINDDLNINSPVDNKNVVIVRARKTNIFFKAFQVAPNIWVAPERYYGEPLNISDQEKSDGGIYDENFLKENSEKEEFLQAIILLLKRINNNIIGQKLLSLMCTSIPFLHEYKQGDYRQSNYLGSKNSEYLYSANIVIFGPGSNIVKNNTIYYKKNFAENGMGTMAEILFQPFLTYKYNQFYADPALELIKCLIKAIYFLYGIKPNDNLNIPYRLRNEFSNVEYSELNIIDFLISGGIDYKFINTNPYWFIDNYFIDVPKVFEKHKNDYEINIKNNSEIGTSIKLYLEQKFKTNVQDIWELNLSYFSKEFQIMMPEKHNNALKHYYRKEYYKINYSKQYDINGFVNGQIATKLLLSEKNQYIINKPQLIINLINKSNNSLLMKSNIYGDGLNGTTDNFYRNYKIPDNIAYQYHPNNTYLDNVNIEEINNIPQITDADIYPYTNNCDTFIPIYNITQSREINTTVPYSINYLQSQIMNSDDITLSSDFWEVVCSNDKSLVYSYLDNVINYLDSIKNNTPINTDKKYYLWLKEIFRNYSFDITATEEITTECGINKIVSWFGKAFNILNTDNSFKIEFQNSGAIALINKKDNIIIPKIEIDEMPNSMLNLSFEDLNEQLYSIYSKNITYFKKIYYNFLDQWWTEYYSQYFDLICMAKKSILAQENLIKKIIQKKISYLIGASNIPDDILAVMRLTTTNTLRDISVESQIAMNNLNNFLNKAAMCVFQSNIYPKFISFMEQCIKHINKSTKEFIQKCTNINETEKLQLIMQNSFSNLDFDFLDIQNMKNLFNSYTELLIKEQTSPYELSLYAFEEQDNNVIGDASGKNTLVEYPKGIELVYGINNSALYLNGSNQSIIFTNDYFENGLTNSFSIYFWLRNLGQDTIKSKLIGSKEYNCGWEIYFQEIGHVFNMIDSNGNEKNIYLSDVSNNSWHYITISVDRLKEQLLIFIDDNLVVNESIKDILNIYSSNIISLLSDNKASYIEGLTILNKPTTGEEVLRNYFKNLNNSYVRDSNDERLEYNKTYQLYDYVFPDNPICEVKQDNNIYLTINNINNLNMKPCKFKLLSINSNKQYVQKWDEVIISVLYDTEKYVCISNENNRVKIIDNKIMQVKFIISNDIFISNCLTHAHNNKYICLSMKDENYNWMICNNESNIPKKAYLWILKEV

SEQ ID NO: 5751 - protein, 1165 aa, Clostridium botulinum
MKINDDLNINSPVDNKNVVIVRARKTNIFFKAFQVAPNIWVAPERYYGEPLNISDQEKSDGGIYDENFLKENSEKEEFLQAIILLLKRINNNIIGQKLLSLMCTSIPFLHEYKQGDYRQSNYLGSKNSEYLYSANIVIFGPGSNIVKNNTIYYKKNFAENGMGTMAEILFQPLLTYKYNQFYADPALELIKCLIKAIYFLYGIKPNDNLNIPYRLRNEFSNVEYSELNIIDFLISGGIDYKFINTNPYWFIDNYFIDVPKVFEKHKNDYEINIKNNSEIGTSIKLYLEQKFKTNVQDIWELNLSYFSKEFQIMMPEKHNNALKHYYRKEYYKINYSKQYDINGFVNGQIATKLLLSEKNQYIINKPQLIINLINKSNNSLLMKSNIYGDGLNGTTDNFYRNYKIPDNIAYQYHPNNTYLDNVNIEEINNIPQITDADIYPYTNNCDTFIPIYNITQSREINTTVPYSINYLQSQIMNSDDITLSSDFWEVVCSNDKSLVYSYLDNVINYLDSIKNNTPINTDKKYYLWLKEIFRNYSFDITATEEITTECGINKIVSWFGKALNILNTDNSFKIEFQNSGAIALINKKDNIIIPKIEIDEMPNSMLNLSFEDLNEQLYSIYSKNITYFKKIYYNFLDQWWTEYYSQYFDLICMAKKSILAQENLIKKIIQKKISYLIGASNIPDDILAVMRLTTTNTLRDISVESQIAMNNLNNFLNKAAMCVFQSNIYPKFISFMEQCIKHINKSTKEFIQKCTNINETEKLQLIMQNSFSNLDFDFLDIQNMKNLFNSYTELLIKEQTSPYELSLYAFEEQDNNVIGDASGKNTLVEYPKGIELVYGINNSALYLNGSNQSIIFTNDYFENGLTNSFSIYFWLRNLGQDTIKSKLIGSKEYNCGWEIYFQEIGHVFNMIDSNGNEKNIYLSDVSNNSWHYITISVDRLKEQLLIFIDDNLVVNESIKDILNIYSSNIISLLSDNKASYIEGLTILNKPTTGEEVLRNYFKNLNNSYVRDSNDERLEYNKTYQLYDYVFPDNPICEVKQDNNIYLTINNINNLNMKPCKFKLLSINSNKQYVQKWDEVIISVLYDTEKYVCISNENNRVKIIDNKIMQVKFIISNDIFISNCLTHAHNNKYICLSMKDENYNWMICNNESNIPKKAYLWILKEV

SEQ ID NO: 5752 - protein, 1163 aa, Clostridium botulinum
MKINNNFNIDSPVDNKDVAIVRGRKTDIFLKVFQVAPNIWVAPERYYGESLNINEDQKSDGGIYDSNFLLTNDEKDEFLQATVKILQRINNNVIGAKLLSLISTAIPFPYEYKPGDYRQTNYLVSKDNQHYYTANLVIFGPGTNIVENNAVYYKKEDSENGMGTMSEIWFQPFLTYKYDQFYVDPALELIKCLIKSLYYLYGIKPSDDLSIPYRLRSELNSLKYSELDMVDFLISGGTDYKLLNTNPYWVTDNYFSDAPKNFEKYKNDYETKIKNNNDIANSIKLYLEQKFKINAQDIWELNLSYLSTEFEIMMPEIFNNALNHYHRKEYYVIDYFKNYNINGFINGQIKTILPLSKYNKNIINKPELIVNLINENNSVLMKSNVYGDGLKGTMNNFYAVYKIPYNIGDEYHINYSYLNNVNVEEINNIPPINDADIYPYRKNSDPFIPVYNITETKEINTTTPLSVNYLQAQVTNSNDINLSLDFSKVISLKDRSLVYSFLDNTIDYLDSIKYDEPINTDKKYYLWLKEIFRNYSFDMTEIQEVNIPCGINKVVPWLGKALNILNTGNSFIEEFKTLGPISLINKKENIIMPKIEIDEIPNSMLNLSFKDLSENLFNIFSKNNSYFEKIYYDFLDQWWTQYYSQYFDLICMAKRSVLAQESLIKKIIQKKLSYLIGNSNISADNLVLMNLTTTNTLRDISNESQIAMNNVDSFLNSAAICVFEGNIYPKFISFMEQCINNINKNTREFIQKCTNITENEKLQLINRNIFSSLDFDFLNIENLKSLFSSETALLIKEETSPYELVLYAFQEPDNNAIGDASAKNTSIEYSKDIDLVYGINGDALYLNGANQSISFSNDFFENGLTNSFSIYFWLRNLGKDTIKSKLIGSKEDNCGWEIYFQDTGLVFNMIDSNGNEKNIYLSDVSNNSWHYITISIDRLKEQLLIFIDDNLVVNESIKEILNIYSSNIISLLSNNNASYIEGLTILNKPTTSQEVLSNYFKNLNNSYIRDSNEERLEYNKTYQLYNYVFSENPIYEIKQNNNIYLTINNTNNLNLQASKFKLLSINPNKQHVQKFDEVIISILDNMEKYIDISEDNRLQLIDNKNGAKKMIISNNIFISNCLTLSCGGKYICLSMKDENYNWMICNNESNIPKKAYLWTLKEV

SEQ ID NO: 5753 - protein, 1198 aa, Clostridium botulinum
MKINSNLTINSPIDNKNVVIVRARETSKFFKAFKVAPNIWVAPERYYGESLSIEESKKVNGGVYDSNFLSQNNEKDKFLQAIITLLKRINSNIAGEKLLSLVSTAIPFPYGYIGGGYYCPNIVTFGSTIKYNKKINSLISTTIPFPYGGYRETNYLSSKDTENFYAANIVIFGPGANIVENNTVFYKKEDAENGMGTMAEICFQPFLTYKYDQFYVDPALELMECLIKSLYFLYGIKPNNNLTVPYRLRNELSNIEFSQLSIVDLLISGGIDSKFINTDPYWFIDSYFSNAKTTFEEHKSIYETEIKGNNAIGNDIKLRLKQKFQTTVHDIWQLNLDYFSKEFQIMMPYRFNNALKYYYRKEYYKIDYPEKYSIAGFVDGQLNTQLSLSDKNQYIINKPELIVNLISENNISLMRSNIYGDGLKYTTDNFYSTYKIPYNRAYEYHFNNSSTSSLENVNVEEISNIPEIIDINPYRENSDIFSPVENIIETKEVNTKTPWPINYLQAQIPNNEEFTLSSDFSQVVSYKTQSLVYSFLSNVISYLDSVKDTNPIDTDEKYYLWLREIFRNYSFDITAIEEINTSCGINKVVSWFGKALNILNTSNSFVKEFKNLGPISLINKKENLSMPIIEVNEIPNDMLGLSLKDLNEKLFNIYLKNILYFKKVYFSFLDQWWTEYYSQYFGLICMAKQSILAQENLIKKIVQKKLSDLSKQSNISNEKLNLMNLTTEKTFIDLSNQSQIAMNNINNFLNKAAICVFESNIYPKFISFMEQYINNINIKTTAFIRKCTNITEKEKLQLINQNTFNNLDFEFFDIQTIENLLTSETNLIIKEKTSPYDLLLFSLQEADRKVIKDISGKDTLVQYSDTIDLSYGVNGDALYLKEPNQSVNFSNNIFENGLTNSFSICFWLRNLGQDNLSSNLIGNIVNNCGWQIYFENNGLVFSMVDCNGNEKNIYLSDVLSKYWYYISVSVDRLRNKLLIFINDKLIVNESIEQILNIYSSNIISLVNENNPICIEELSILNKALTSEEVLNSYFTNLNNSYIRDSYGARLEYNKNYELYNYVFPENSLYEVIENNNMYLSIKNIKNTNILGAKFKLINTDESKQYVQKWDEVIICVLGDTEKYADIQAGNNRIQLVNSKDNARKIIVNNNIFRPNCVLFSYNNKYLSLSLRNRNYNWMICNDNSFIPKHAHLWILKKI

SEQ ID NO: 5754 - protein, 488 aa, Clostridium botulinum
MDSSIKKNFNNTEEETINFTAFNLDDGNYVVNRGDGWILSRQNQILGGTEVRSGSTGIVGDLRVRDNTTPYCYPTSSFNEKYIRDIVQNVFGNFNEVNQIPIGFECSRTAPDNKNLYMYLQYTYIRYEIIKVLQQQITERAVLYVPSLGYVKSIEFNSNEKIDKNFYFQVDDKCILNEQFLYKKISSTNTNKNIKNDNIDNTNSETNKTQPLVPYSNGLYVINKGDGYIRTNDRDLIGTLLIEANSSGSIIQPRLRNTTEPIFISSNLTKFSQQYTEERLKDAFNIKLFNTSTALFKFVEEAPANKNICIKAYNTYEKYELVEYRNGTIINSAQYYLPSLGYSEVIDVPSSGAPVVETPIVETQFIQKGPEEEIVIGVISPDENIQQINTAISESYTYDIPDIVGKKPFYILFTVNNTNFYKISAEDNSVPLKIYEVIGSGNRNMQDGNLSNDNIKAINYITGFDFSDKDYLIVQLFKGKNYYIRIPQ
